United States Patent 10,760,091 (GENES AND USES FOR PLANT ENHANCEMENT) - sequence listing, part 4

SEQ ID NO: 12134 - protein, 1439 aa, Botryotinia fuckeliana
  misc_feature (99)..(99): Xaa can be any naturally occurring amino acid
MAAIEPEGFSSIVRPHEEHGNALTRALSSSSAFSDRKRQRAYDSSDEDNKKEKSMAADWSLMPELQAMQQQSDKDQAKRRDLGVTWKNLTVKGIGADAXINENVGSQFNIPKLIKEGRTKPPLRTLVDNSHGCVKPGEMLLVLGRPGAGCTTLLKMLANTRGGYAEVTGDVHFGSLNHTEAHQYRGQIVMNTEEELFFPTLTVGQTIDFATRMKVPFHRPSNSGSPEEYQQANRDFLLKSMGISHTHETKVGNEYVRGVSGGERKRVSIIEMLASRGSVMCWDNSTRGLDASSALDYTKAIRAMTDIFGMASIVTLYQAGNGIYNLFDKVLVLDEGKQIYYGPMKQARPFMEELGFICDDSANVADFLTGVTVPTERKIRDEFQNRFPRTAGEILAAYNRHSIKNEMEKEYDYPTTAIAKERTEDFRTSVQHEKNPKLGKDSPLTTSFMTQVKACVIRQYQIIWGDKATFIIKQLSTLAQALIAGSLFYNAPANASGLFVKSGALFLSLLFNALLAMSEVTDSFSGRPVLAKHKAFAFYHPAAFCIAQIAADIPVLLVQVSHFSLVMYFMVGLRQDAGAFFTYWILIFAATMCMTALFRAVGAGFSTFDAASKVSGFLVSALIMYTGYMIQKPDMHPWFVWIYWIDPLAYGFSAILANEFKGQIIPCVANNLVPNGPGYADLAFQACAGVGGALPGATSVTGEQYLNSLSYSSSNIWRNFGILWAFWVLFVVLTIYYTSNWSANGGKSGILLIPREKAKKNTAILKAANAGDEESQAIEEKRQVQSRPASQDTKVAEESDDQLMRNTSVFTWKNLTYTVKTPSGDRVLLDNVQGWVKPGMLGALMGSSGAGKTTLLDVLAQRKTDGTIKGSILVDGRPLNVSFQRSAGYCEQLDVHEPLATVREALEFSALLRQSRTVPDAEKLRYVDTIIDLLEMHDMENTLIGNTGAGLSVEQRKRLTIGVELVSKPSILIFLDEPTSGLDGQAAFNTVRFLRKLADVGQAILVTIHQPSAQLFAQFDSLLLLAKGGKTVYFGDIGEDSKTIKEYFARYDAPCPESSNPAEHMIDVVSGTLSKGKDWNQVWLNSPEYEYTVKELDRIIETAAAAPPGTVDDGFEFATPLWQQIKLVTNRMNVAIYRNTDYINNKFALHIGSALFNGFSFWMIKHSVGGLQLRLFTVFNFIFVAPGVMAQLQPLFLERRDIYETREKKSKMYSWWAFATGNVVSELPYLVICAVLYFVCWYYTVGFPSDSSKAGSVLFVMICYEFIYTGIGQFVAAYAPNVVFASLVNPLVIGTLVSFCGVLVPYAQITEFWRYWMYYLNPFNYLMGSLLVFTSWDTPVNCRESEFAIFNPANGTCGEYLSSYLQGMGAAANLINPDATEGCRVCEYTVGNDYLKGLNLKTYSYGWRDAGICALFVFSGYGLVFLLMKLRTKKTKGAE

SEQ ID NO: 12135 - protein, 385 aa, Helicobacter hepaticus ATCC 51449
METFDYYEILEITRTSDKETIKKAYRKMALKYHPDRNPDDKDAEEQFKRVNEAYEVLSDDSKRQIYDKYGKEGLQNSGFSGFSGRDFSDIFGDLGSIFESAFGANFGFSTQKRGGGKYNLDEIVGLELSFTEAVFGCKKEIHNSFKIACSDCKGTGAKGGKLNTCKDCGGKGQVYMRQGFMTFAQTCPTCKGEGQSASEKCSKCKGSGFEISEESFEVSIPEGIDDGNRIRIGGRGNADKNGSRGDLYIAVSVAEDENFVRDGENVYIEVPVFFTSIVLGTTLKIPSLRGELELKIPPNTRDKEQFVFDNEGIKDVNSAYRGKFVAQIKITYPPKLNAEQRALTEKLQESFGIESEPYKNVFEECFTKVKQWLHKHSKNDKDTTK

SEQ ID NO: 12136 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFEFARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 12137 - protein, 249 aa, Bacillus licheniformis ATCC 14580
MEEEALRFADMIENAERITVLTGAGMSTESGIPDFRSAGGIWTEDLSRMEAMSRDYYERYPKLFWPKFKELFQMKMTGTYRPNDGHLYLAELEKSGKDVRVFTQNIDGLHLKAGSRHVYELHGSIQTAACPKCGARYGLDHILQEEVPRCNRVNGKGRACGFILKTDVVLFGDAVQHFDTLFEVLNESDLLLVIGTSLEVAPVRFVPEEAHLIPGLKKAMINLDETPYDHLFDIVINQKIAEFVRKLNH

SEQ ID NO: 12138 - protein, 463 aa, Oryza sativa (japonica cultivar-group)
MGMLRWGAHLLLLLLAAATWTCAGAGAGVTSEYRRKLEATVDMPLDADVFRVPPGYNAPQQVHITLGDQTGTAMTVSWVTANELGSNTVRYGSSPEKLDRAAEGSHTRYDYFNYTSGFIHHCTLTGLTHATKYYYAMGFDHTVRTFSFTTPPKPAPDAPFKFGLIGDLGQTFDSNSTLAHYEANGGDAVLFVGDLSYADNYPLHDNNRWDTWARFVERSVAYQPWIWTAGNHELDYAPELGETVPFKPFTHRYPTPYRAAGSTEPFWYSVKIASAHVIVLASYSAYGKYTPQWTWLQEELATRVDRKLTPWLIVLMHSPWYNSNNYHYMEGETMRVQFERWLVDAKVDVVLAGHVHSYERSRRFANIDYNIVNGKATPAANVDAPVYITIGDGGNIEGIANNFTVPQPAYSAFREASFGHATLEIKNRTHAHYAWHRNHDGAKAVADAVWLTNRYWMPTNDDV

SEQ ID NO: 12139 - protein, 93 aa, Oryza sativa
MAAPLRRSLPSLGRTLLSPSPAPARMLSAAASDALVEIKPGEIGMVSGIPEEHLRRKVVIYSPARTASQQGSRGKRSGRSNAAWTKHQNPYIA

SEQ ID NO: 12140 - protein, 679 aa, Zea mays
VMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGSWLTPIPPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKLATERGRKARPNLKVGICGEHGGEPSSVAFFAKAGLDYVSCSPFRVPIARLAAAQVLV

SEQ ID NO: 12141 - protein, 223 aa, Oryza sativa
  misc_feature (9)..(9): Xaa can be any naturally occurring amino acid
MAAKSLILXGVLLASLLLVSQDVVAARELTEAHESKGKNVKPEVEQNNWGGGYMHGGGYEHGGGYSQPRYGGGYGQPGYGGGYGQPGYGSGYGPGYGGGGSGPGYGGGYGSPGYGGGYGSPGYGGGSGYGGGYGGGYGGGYGGGSGYGGGGGYGGGSGGGGQHGGSSLGKQGGRARWERRRVAAASDRRCSGDGNVGKGRRHMRGGGHRPPATGNTPTTAAQE

SEQ ID NO: 12142 - protein, 254 aa, Rhodococcus sp. RHA1
MCLVLFAWHTRPDLPLVVAANRDEFYARPTEPLSRWDDGFLAGRDLLAGGTWMGIADSLRFAAVTNVRNGAPSTGARSRGALPVDYLRGRLSPADYAEQVAATGAEYGSFNLLVGDPTELRWATNRPHGRQQRVEPGVHGLSNAELDTPWPKVTGGKQAFAAALDADDGGPDADPGTYFDVLSDSDPAPWDSLPDTGIEPELERALSSRFIHYDDYGTRASTLLRVRPDGTFDITERRFDENGPTGEVRFPARE

SEQ ID NO: 12143 - protein, 211 aa, Trachycarpus fortunei
MVNFSDYSMDSPLAQRSASDEEAYATVSSAPPKRRAGRTKFRETRHPVYKGVRRRNADKWVCEVREPNKKSRIWLGTFPTAEMAARAHDVAAMALRGRSACLNFADSAWLCPVPRSSNSKDIQRAAVEAAEAFRPQTERVDAAESREDAAMAMIAGPSLAAADDPFYMEDGLNFGMQGYLDMASGMLMEPPPIYADEEVSDGDVSLWSYSI

SEQ ID NO: 12144 - protein, 435 aa, Arabidopsis thaliana
MTPQIKTHLLPKQEPSSSENHGSSTSGIVFNVSTSIIGAGIMSMPAAFKVLGIVPAFLIITIIAWLSTISVGFLMKSTLAGESTTYAGVMKESFGKTGSIAVQIATMVATFGCMIIFSIIIGDVLSGNENGGPEHIGVLQEWFGSYWWNTRIFALLFVYGFVLLPLVLRRRVERLAISSAVSFLLAVLFVVISSVLAISALVNGQTKNPRLFPELSNGGSFWQLFTASPVIVTAFTFHFNVHPIGFELKDPLQVIPATKISVILCAAIYFATGLFGYLLFGDATMSDILVNFDQSSGSSIGSLLNDIVRLSYVLHLMLVFPLLNFSLRANLDELLYPKKPSLEKDTKRFIGLTLALLICCFLSAIAVPDIWYFFQFMGSTITVSIAFIFPAAIVLRNIHGVSTSREKIVAAIMLVLAVATSIIAISTNLYSLAAN

SEQ ID NO: 12145 - protein, 219 aa, Shewanella oneidensis MR-1
MTQDEMKKAAGWAALKYVEKDSIVGVGTGSTVNHFIDALATMKADIEGAVSSSEASTQKMKALGIPVYDLNSVDKLSVYVDGADEINGHMDMIKGGGAALTREKIVAAVAEKFVCIVDNTKQVDILGEFPLPVEVIPMARSYVARQLVKLGGDPVYREGVITDNGNVILDVYNLKILNPKELEDKINAIVGVVTNGLFAKRGADVLLVGTPEGVKTFTA

SEQ ID NO: 12146 - protein, 210 aa, Ravenea rivularis
MESFSSDSMDTPLAQRSASDEEAYATVSSAPPKRRAGRTKFRETRHPVYKGVRRRNADKWVCEVREPNKKSRIWLGTFPTAEMAARAHDVAAIALRGRSACLNFADSAWLCPVPRSSSPKDIQRAAMEAAEGFRPQTEPDAAKSREDATMAMAAGPSLAAADDPFYVEDGLNFGMQGYLDMAAGLLMEPPPTYADEEVSGSDFSLWSYSM

SEQ ID NO: 12147 - protein, 420 aa, Pyrococcus endeavori
MVEQDPFEIAVKQLERAAQYMKISEEALEFLKRPQRIVEVTIPVEMDDGTVKVFTGFRVQYNWARGPTKGGIRWHPEETLSTVKALAAWMTWKTAVMDLPYGGGKGGIIVDPKKLSDREKERLARGYIRAIYDVISPYEDIPAPHVYTNPQIMAWMMDEYEAISRRKTPAFGIITGKPLSIGGSLGRNEATARGASYTIREARKVLGWGDLKGKTIAIQGYGNAGYYLAKIMSEDYGMKVVAVSDSKGGIYNPDGLNADEVLKWKQEHGSVKDFPGATNITNEELLELEVDVLAPAAIEEVITKKNADNIKAKIVAEVANGPVTPEADEILFEKGILQIPDFLCNAGGVTVSYFEWVQNITGYYWTLEEVREKLDKKMTKAFYDVYNTAKEKNIHMRDADYVVAVQRVYQAMLDRGWVKH

SEQ ID NO: 12148 - protein, 225 aa, Streptomyces coelicolor A3(2)
MHLDHHHESAAAVSADARRPDGSRRALRIGLGGPVGSGKTATVAALCRALRAELSLAVVTNDIYTREDAEFLLREAVLPPERITAVETGACPHTAIRDDISANLEAVEDLEDEVGPLDLVLVESGGDNLTATFSRGLVDAQVFVIDVAGGDDIPRKGGPGVATADLLIVNKTDLAPYVGSDLARMAADAKAARGELPVVLQSLRGEDGVREVADWVRERIAAWTA

SEQ ID NO: 12149 - protein, 212 aa, Elaeis oleifera
MESFSSDSMDSPLASRWASDGEAYATVSSAPPKRRAGRTKFRETRHPVYKGVRRRNADKWVCEVREPNKKSRIWLGTFPTAEMAARAHDVAAMALRGRSACLNFADSPWLCPVPRSSNPKDIQRAAMEAAEAFRPQTEPNADKSREDAAMSMAGGPSLATADDPFYMEDGLNFGMQGYYLDMAAGLLMEPPPILYADEEVSDGDVSLWSYSI

SEQ ID NO: 12150 - protein, 209 aa, Elaeis guineensis
MESFSSDSLDSPVARQSASDEETYATVWSVPPKRRAGRTKFRETRHPVYKGVRRRNADKWVCEVREPNKKSRIWLGTFPTAEMAARAHDVAAMALRGRSACLNFADSAWLCPVPSSSNPKDIQKAAVLAAEAFRPRTESDATESREDAAMAMSAGPSVAADDPFFTEDRLDFGMQGYLDMAEGLLIDPPPMNADEEESDGGVSLWSYSI

SEQ ID NO: 12151 - protein, 669 aa, Bacteroides thetaiotaomicron VPI-5482
MNDNKLMNRAADNIRILAASMVEKANSGHPGGAMGGADFVNVLFSEFLVYDPENPRWEGRDRFFLDPGHMSPMLYSTLALTGKFTLDELKEFRQWGSPTPGHPEVDIMRGIENTSGPLGQGHTFAVGAAIAAKFLKARFNEVMNQTIYAYISDGGIQEEISQGAGRIAGALGLDNLIMFYDSNDIQLSTETKDVTVEDTAMKYEAWGWNVLSINGNDPDEIRAAIKEAQTEKERPTLIIGKTVMGKGARKADGSSYEANCATHGAPLGGDAYVNTIKNLGGDPVNPFVIFPEVAELYAKRAAELKKIVAERYAKKAKWTKANPELAAKLEAFFSGKAPKVDWAAIEQKAGTATRAASATVLGALAMQVENMIVASADLSNSDKTDGFLKKTHSFKKGDFSGAFFQAGVSELSMACICIGMSLHGGVIAACGTFFVFSDYMKPAVRMAALMEQPVKFIWTHDAFRVGEDGPTHEPVEQEAQIRLMEKLKNHKGHNSMLVLRPADAEETTIAWKLAMENMSTPTGLIFSRQNIANLPAGTDYEQAAKGAYIVAGSDENPDVILVASGSEVSTLVAGTELLRKDGVKVRIVSAPSEGLFRSQSKEYQESVLPADAKIFGLTAGLPVTLQGLVGCHGKVWGLESFGFSAPYTVLDEKLGFTAENVYNQVKAMI

SEQ ID NO: 12152 - protein, 806 aa, Yarrowia lipolytica CLIB122
MDLEDSLFQDRSNLFLDLLDSPTLSHRENILQMLNRNEKRYCVSLDEIRDFDRPFWQGLIDHPTPYLEAMDNALKQIVHGVRDARHMFPEHEHFYVGLTGSLGNHMRNPRTIDAKLLGQLVGVEGIVVRTSLVRPKVLRSVHYCPATGLTESKTYKDQTMGEGTVTQAAVYPTADNDGNPLITEYGMCTYMDHQTISIQEMPEKAPAGQLPTSLEIVLDDDLADKVKPGDRIQIIGVYRTHGGGNGSSRFRAYVLGNNVVILNAKSHVVEGVSDEEVRQINLISKRDDAFDILSRSLAPSIFGFEYIKQAVLLMLLGGAEKNLENGTHIRGDINILMVGDPSTAKSQMLRFVLNSANLAIATTGRGSSGVGLTAAVTMDTDTGERRLEAGAMVLADRGVVCIDEFDKMSDTDRVAIHEVMEQQTVTIAKAGIHTTLNARCSVIAAANPVFGQYDVTKPPHKNIALPDSLLSRFDLLFIVTDETNDEKDRRIADHVIKMHRYVKPGTEIGAVTRDQPPQVLAVGEPVKDTADDPMWDIEEQVLSVGFVKKYIQYAKSRVSPVLSRDASNLIVDTYTSLRNDDTSQRTAPITARTLETLIRLSTAHAKIRLSSRVDLEDAEVARDVLRYALFKDVPVESRVKRRRRAEAAVGQEVSDVEDNLEHLELSDDDGDNNVYNSQASTARQRSLAALRADSTFDEMSDFVVPSSQLVSEIDMEDSVLSSQPRARQGLSTSRLDFFTREFSNVLRASKDFENGGSMHRDAVLEAINRSIPEEDKFAEEEGYAVLQRLSDDGKIMLTDDGEVYSI

SEQ ID NO: 12153 - protein, 207 aa, Campylobacter coli RM2228
MQNFQNLNEKINWQKVNGLIPVIIQDAKSCEVLMLGFMDEKALEKSLESKKVVFFSRTKNRLWMKGEESGNFLNIVDLSLDCDNDTLLILVDPIGATCHIGNISCFENVSKNADFVFLARLEKLINSRKNADENTSYTAKLFKKGTKRIAQKVGEEGVETALAATVKDKDELICEAADLMYHLSVLLADANLSFSDVIAKLKERHKE

SEQ ID NO: 12154 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFEGARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 12155 - protein, 471 aa, Debaryomyces hansenii CBS767
MLRNTRLLTRTISSSLRFAATKNTRLPTQHKFYSKKTDKKAEEPQSILTDDLLAKAGFEDPNEPKEKSEQQESENGEPSEEEKSNGQEQRSRRKRRAQTSKDIQRERYANMFYLATLVGGIAGVGYMCRDWDSEDEQTKLEGKDIDNGFAPNLMYGRLNKRLGSLFTFFSEPVFENLLPPPAPEAYRRPLTLVVTLDDLLIHSDWDTKHGWRTGKRPGLDYFLGYLSQYYEIVIFGSNYQMYSENTVGKLDPFHAYVSYALFREACRYKDGKLVKDLSLLNRDLGKTVLIDVEEDSWSMQPDNAIPMKPWDGSYDDTLVKLIPFLEYLATQPVKDVRPILNSFKDKSNIVQEFAEREAKLREQWKKDNKHLFDSANRPNAGNFLASLMGVPTSSVNKEPKMPLDIIREHGQLQYEHFQKYLKENAPKFLEEEQKLKDEFGKVSLNKLITEGAPSADDIAKVQAERAAAQQQ

SEQ ID NO: 12156 - protein, 413 aa, Rhodococcus sp. RHA1
MTSDIVVIGGGVAGVTAAQSLRSEGYDGRLVLIGKERELPYDRTALSKAVLAGDLADPPLLFPADWYDEWQIETVLDRTVLQVDVTRREVLLDGGPWLKVDRVHLATGASARVPSFSGSDLPGVATLRTADDVHRMRRDWEPGQRLVVVGGGLIGCEVATTARKLGLEVSILEASDELLQRVLGRRIGGWCRARLMELGISVVLNTGVAEFKGVDRITTVIGTDGRSFVADRAIVCVGAEPETAIAEQSGLACNRGILVNDSGGTAAEGVFAAGDVASWPLLTGGRRSLETYINSQREATAVASAMLGKAVHGPQLPLSWTEMAGHRIQMIGDIEGSGEYVMRGDPDDGPALLFRLSDGRVTAAVSVDAPRDFAMATRLVERGAQVGREVLGDTSMELRELNRAARERALIAE

SEQ ID NO: 12157 - protein, 396 aa, Frankia sp. EAN1pec
MDGRPRGAHPQRLRRPVKPDRLQGLVRQLPEHALRPTLPLRRAGGCRSRPPETAVASARGYMGYMGAGSGAGHTAGSPGDGEIMATSGRITTPFTAESTAAEVVAGIDLGGRRVVVTGASSGIGVETARALAGAGAEVTLAVRDVEAGRWTADDIVAAMGNKEIHVAPLDLADRASVAAFVAGWDGPLHILVNNAGVMATPELRTPEGWELQFATNHLGHFAVASGLRGALAAAGGARVVSVSSSGHLRSPVVFSDIHFRERAYEPWAAYGQSKTANVLFAVEATRRWADDGITVNALMPGAIATRLQRHISTEDLDRLRGQINAPALVWKSVEQGAATSVLLATSPLLDGIGGRYFEDCNEALPNTPGVRGGVAAYALDPEAAARLWDVTVDTLT

SEQ ID NO: 12158 - protein, 353 aa, Campylobacter coli RM2228
MSEKILFIDRDGTIIEEPKSDFQIDSLEKLRFEKGAIPTLLKLKNFGFKFVLVSNQDGLGTQSFPKEDFEIAHQKMLDILQSCGIEFKDIFICPHFENENCECRKPKTALLDEYIKHNLYNKEQSFVIGDRDTDMILASNLGVRGLKYSENLTWKEIEEEILNSFRTASISRITKETNIYVKVCLNGGKIAINTGVPFFDHMLEQIAVHGGIGLEISCKGDLEIDEHHSVEDVALALGSAIKQALGDKIGITRYGFVLPMDECLASCAIDFCNRPHLVYKAKFKKEKLGELSTEMIEHFFYSLSYSMGVSLHLKVKGKNDHHKAEGLFKAFAKALKMAVKIESENLASSKGVI

SEQ ID NO: 12159 - protein, 180 aa, Carica papaya
FGGVYKGTVEDGTEVAVKLLTRDNQNRDREFIAEIEMLSRLHHRNLVKLIGICIEGRTRCLVYELVHNGSVESHLHGVDKSKGPLDWDARMKIALGAARGLAYLHEDSNPRVIHRDFKASNVLLEGDFTPKVSDFGLAREATEGSQHISTRVMGTFGYVAPEYAMTGHLLVKSDIYSYGI

SEQ ID NO: 12160 - protein, 202 aa, Carica papaya
FGGVYRGVYDAQDVAVKVLDWGEDGFATAAEAAALRTSFRQEVAVWHKLDHPNVTKFIGASMGTSNLKIPPKDATSDGHNPLPSRACCVVVEYLPGGTLKKFLIRNRRKKLAIKVVIQLALDLSRGLSYLHSKKIVHRDVKTENMLLDTHRTLKIADFGVARVEAQNPRDMTGETGTLGYMAPEVLDGKPYNRKCDVYSYGV

SEQ ID NO: 12161 - protein, 356 aa, Prochlorococcus marinus str. MIT 9301
MHKVLAIETSCDETSVSIVSNIGDTFRIHSNIIASQIEDHSKWGGVVPELAARKHLELLPFVLEKALEQAKIKIEEVDYIASTVAPGLVGCLRVGSITARSLCMLHSKPFLGIHHLEGHLSSILFSENYPKKSFLTLLVSGGHTELIKVDDNRGMQRLGKSFDDAAGEAFDKVGRLLGLGYPGGPAIEKIAKNGDPMKFNLPKCRISDKKGGFLKYDFSFSGLKTAVLRLVERINLAGKTVPIPDIAASFERVVAEVLVERTIKCAEDHRLDNVVVVGGVAANNTLRKMMISEASKKSIKVHLAPLDLCTDNAAMIGAAALFRIKFKDHLSNLKLGVAGRLSIEQANTLYEENPPF

SEQ ID NO: 12162 - protein, 364 aa, Rhodococcus sp. RHA1
MAPQTFKIASIPADGVGKEVVAAGRRVLDVLAEQSGGRFAFEWEEFPWGCGYYEQTGKMMADDGLDTLKAFDAIYFGAVGWENVPDHISLWGLRLNITQNFDQWANVRPVKFLPGVQSPLRKADDTELDWIVVRENSEGEYAGLGGRNLSGRGPGNEVALQTALFTEKGCERIMRFAFDLARTRTVKKVSSVTKSNAQQYGMVLWDEVFNRVALDYPDVATESVLVDAMSAKFILHPEDLSVVVASNLNADILSDLGSALAGSLGIAASANLNPERRFPSMFEPVHGSAPDIAGQGISNPIGAIASAALMLDHFGLHDEARRVEAAIEAATASGALTRDIGGSSDTDAVTEAIVHALQTALTPA

SEQ ID NO: 12163 - protein, 212 aa, Dypsis lutescens
MESFSSDSMDSPFAQRSASDEEAYATVSSAPPKRRAGRTKFRETRHPVYKGVRRRNADKWVCEVREPNKKSRIWLGTFPTAEMAARAHDVAAMALRGRSACLNFADSAWLCSVPRSTSPKDIQRAAMEAAEAFRPRTEPDAAKSTREDAGTSMAAGPSLASADDPFYMEDGLNFGMQGYLDMAEGLLMEPPPILYPDEEVSGGDVSLWSYSI

SEQ ID NO: 12164 - protein, 420 aa, Sulfolobus solfataricus P2
MMEEVLSSSLYTQQVKKLYKVGELLGLDNETLETLSQPERIIQVKIQIRGSDGKLKTFMGWRSQHNSALGPYKGGIRYHPNVTQDEVEALSMIMTWKNSLLLLPYGGGKGGIRVDPKKLTKEELEQLSRKFIQAIYKYLGSELDIPAPDVNTDSQTMAWYLDEYIKITGNVDFAVFTGKPVELGGIGVRLYSTGLGVATIAKEAANKFIGGIEEARVIIQGFGNVGYYAAKFLSDMGAKIVGISDSKGGVINENGIDVGKAMEIKEKTGSVTNYPEGRKVTNEELLISDCNILVPAALENVINKFNAPKIKAKLIVEGANGPLTADADEIMRQRGIVVVPDILANAGGVVGSYVEWANNKMGQIISDEEAKKLIVDRMNNAFNTLYDYHQKKLEDHDLRTAAMALAVDRVVRAMKARGLL

SEQ ID NO: 12165 - protein, 159 aa, Prochlorococcus marinus str. MIT 9301
MTKMAKEKQEKDLETGIKAGASVDVAVEQKEKNTVSETTQTLSASNLIKEFENEQLKKELPEIYVGDTVKVGVKITEGNKERVQPYEGVVIAKRHGGINQTITVRRIFQGIGVERVFMLHSPQVASLKVERRGKVRRAKLFYLRDRVGKATRVKQRFDR

SEQ ID NO: 12166 - protein, 211 aa, Cocos nucifera
MESFSSDSMDTPLAQRSASDEEAYATVSSAPPKRRAGRTKFRETRHPVYKGVRRRNADKWVCEVREPNKKSRIWLGTFPTAEMAARAHDVAAIALRGRSACLNFADSAWLCPVPRSSNSKDIQRAAVEAAEAFRPQTERVDAAESREDAAMAMIAGPSLAAADDPFYMEDGLNSGMQGYLDMASGMLMEPPPIYADEEVSDGDVSLWSYSI

SEQ ID NO: 12167 - protein, 211 aa, Rhapidophyllum hystrix
MENFSDYSMDSPLAQRSASDEEAYATVSSAPPKRRAGRTKFRETRHPVYKGVRRRNADKWVCEVREPNKKSRIWLGTFPTAEMAARAHDVAAMALRGRSACLNFADSAWLCPVPGSSNPKDIQRAAVDAAEAFRPQTERVDAAESREDAAMAMIARPSLAAADGPFYMEDGLNFGMQGYLDMAAGMLMEPPPIYADEEVSDGDVSLWSYSI

SEQ ID NO: 12168 - protein, 197 aa, Gibberella zeae PH-1
MAEDLKNPAAKPVPKGHRWILFVSGPTASGKSSVAKYLADELNLKFVEGDDFHPKSNVDKMSRGEPLTDQDRLGWLQALHEHAIHHPKGPGADHLVVTCSALKRQYRDLLRQGSENAGDLRVHFLHLDAPEEVLRQRAAARKGHFAGSALVHSQFEALERPANDERDVLTISVDQTVEEVQREALARVTELLDEDTE

SEQ ID NO: 12169 - protein, 408 aa, Kluyveromyces lactis
MLSLKAQSSVVGKSSSLRLVRNFSKNVRALSQVADETKPGDDDLVQIDLPETSFEGYLLDVPELSYQTTKSNLLQMYKDMIIVRRMEMACDALYKAKKIRGFCHSSVGQEAIAVGIENAITKRDTVITSYRCHGFTYMRGAAVQAVLAELMGRRTGVSFGKGGSMHLYAPGFYGGNGIVGAQVPLGAGLAFAHQYKHEDACSFALYGDGASNQGQVFESFNMAKLWNLPAVFCCENNKYGMGTAAARSSAMTEYFKRGQYIPGLKVNGMDILAVTKLKDWTVSGNGPIVLEYETYRYGGHSMSDPGTTYRTRDEIQHMRSKNDPIAGLKMHLLELGIATEDEIKAYDKAARKYVDEQVELADAAPAPEAKMSILFEDVYVPGSETPTLRGRLQEDTWDFAKKSFAFRD

SEQ ID NO: 12170 - protein, 428 aa, Prosthecochloris aestuarii DSM 271
MKGHIDTDFDRGHIWHPYTSMRDPLPVYPVARASGVTIELEDGRKLVDGMSSWWAAVHGYNHPVLNHAVTRQLDSMSHVMFGGLTHEPAVKLAGQLIELTPEPLQKVFFSDSGSVSVEVAIKMALQYWQAAGLSRKRRLLTVRSGYHGDTFGAMSVCDPDTGMHSLFTGMLAEQLFAEAPQCGFDAAWNENGIEDLHQKLRQHHEAVAAVIIEPVVQGAGGMRFYSPHYLIRLRELCDEYGVLLIFDEIATGFGRTGKMFALEHAGVVPDIMCVGKALTGGYMTLAATLAADHVADTISSAEPGLFMHGPTFMANPLACSVASASIDLLCSRDWEQEVQDIQGALQDGLSPCSRFSGVHDVRVLGAIGVVELCQPVDMAAVQNFFVERGAWVRPFGRLIYLMPPFIISPSEMVILTRAVRDAVRLIAS

SEQ ID NO: 12171 - protein, 180 aa, Carica papaya
FGSVYRGQLPNGQKIAVKRLSVGSGQGDLEFKNEVLLVAKLQHRNLVRLLGFCLERSERILIYEFMPNASLDYFLFHPTKRERLDWDNRYKIIGGIARGLLYLHEDSRLRIIHRDLKASNVLLDAEMLPKIADFGMARMSELDETQGNTSRIVGTYGYMAPEYAMHGQFSVKSDIYSYGI

SEQ ID NO: 12172 - protein, 307 aa, Triticum aestivum
  misc_feature (256)..(256): Xaa can be any naturally occurring amino acid
  misc_feature (297)..(297): Xaa can be any naturally occurring amino acid
VFHRTSLYKKAGRYRSGIPGISSTHASDGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGACVGSPADLALIRMQADSTLPAAQRRHYKNAFHALYRITADEGVLALWKGAGPTVVRAMSLNMGMLASYDQSVELFRDKLGAGEYQTVIGASAISGFCAAACSLPFDYVKTQIQKMQPDATGKYPYTGXSLDCAMQTLKTGGPFKFYSGFPVYCVRIAPHVMMTWLFLNXIQKYQKKIGI

SEQ ID NO: 12173 - protein, 453 aa, Arabidopsis thaliana
MDTDLISNLPDDVLGKILSLVPTKLAAATSVLSKRWRNLLPLVDSLDFDETMLFYPDNKDGEDEASSYESGQRRRHSFSHFVDKTLALLSNAPLTEKFSLKCYHEDDGARINRWIRTALERGCLELNLEAANYLPIDSQYFTSNTLVKLTISDGFYPGGHLLPFGGVFFPALKTLTLVSVCFTSVEMINFFIHGCPALEELFLCVWMQYMSSPNVKRVTITSDFDDDIQRPSMVLKTPSLVYLDYSSYVAGNYYVVLDSLVEARLDLRLYEPIIYDEDGLWNAEVFGNITNLIEAIRTIKILHLSPSSLEVFYYCCDLPVLEDLVNLSIESDKEKGWEVMPRLLNKSPNLQTLVVKGLVHRVTYCCGDACACIRMKDREIVSCLSRCRVKVLKILGYGGSFRELKQMRHFLGKLKCLETVKVGVKEGSKKSNYLVANVMALPRVSSKCKIQFI

SEQ ID NO: 12174 - protein, 79 aa, Xerophyta humilis
MADVKKCDETCGCPVPCSLDTACKCSVESGNAASRHATCTCGEHCSCNPCSCGKVPIGVQAGKGSCSCGSGCNCEKCSC

SEQ ID NO: 12175 - protein, 433 aa, Prochlorococcus marinus str. MIT 9301
MTDILNYTKSEEIFSAAQELMPGGVSSPVRAFKSVGGQPIVFDRVKGPFAWDIDGNRYIDYIGSWGPAICGHAHPEVITALHEAIEKGTSFGAPCVLENKLAEMVIDAVPSVEMVRFVNSGTEACMAVLRLMRAFTGRDKVIKFDGCYHGHADMFLVKAGSGVATLGLPDSPGVPRTTTANTLTAPYNDLEAVKKLFSENPDAISGVILEPIVGNAGFITPEPGFLEGLRELTTENGSLLVFDEVMTGFRISYGGAQEKFGVTPDLTTLGKVIGGGLPVGAYGGKKEIMSMVAPAGPVYQAGTLSGNPLAMTAGIKTLELLKQEGTYDKLDSLTSRLIEGIIQSAENNGIAINGGSVSAMFGFFLCDGPVRNFNEAKTNDAELFGKLHREMLRRGIYLAPSPFEAGFTSLAHSEEEIDKTIEAFDESFNEIKK

SEQ ID NO: 12176 - protein, 355 aa, Gibberella zeae
MSRANPPNAAGSRKISFNVSEQYDIQDVVGEGAYGVVCSAIHKPSGQKVAIKKITPFDHSMFCLRTLREMKLLRYFNHENIISILDIQKPRSYESFQEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQVIMW

SEQ ID NO: 12177 - protein, 1066 aa, Geobacter metallireducens GS-15
MPRRDDVKKVLIIGSGPIIIGQACEFDYSGTQACKALRKLGYRIVLVNSNPATIMTDPGMADATYIEPLNVDTLTEIIRKERPDALLPNLGGQTGLNLSSALAQAGVLDRYGVRVIGVNLDAIKRGEDRETFKETMTRLGIETARSEIATTMEGALDVVSRIGLPVVIRPAYTMGGTGGGFAYNMEEFRTIVARGLAASPVSQILVEESVLGWEELELEVVRDAKNQKITVCFIENVDAMGVHTGDSYCTAPMLTISSELQARLQDYAYRIVDAIEVIGGTNVQFAHDPKTGRVVVIEINPRTSRSSALASKATGFPIAMVSSLLAAGLTLDEIPYWRDGSLEKYTPSGDYVVVKFARWAFEKFKGVEDKLGTQMRAVGEVMSIGKNYKEALQKAIRSLEIGRHGLGFARDFNATSLPKLLEMLAEPSSERQFILYEAIRKGADLDQLHQLTHIKLWFLQQMKELVELEEEILRHRGSLPPDELLLQAKRDGFADRYLAKLLEIPETQVREKRLALGLTEAWEAVPVSGVENAAYYFSTYNAPDTVPVSDRKKIMVLGGGPNRIGQGIEFDYCCVHTALALREAGYETIMVNCNPETVSTDYDTSDKLYFEPLTVEDVLSIHAKEKPEGVVVQFGGQTPLNIAVELEAAGVRIIGTTPETIDLAEDRQRFARVMTELGIPQPESGMASTLDEALAVAGRIDYPLMVRPSYVLGGRAMEVVHDEEMLREYVTKAVDVSPERPILIDRFLENAIEAEADAISDGTDAFVPAVMEHIELAGVHSGDSACVIPPVSIPQKHIDTIDEYTRKIAVAMGVVGLMNIQYAIADNTVYILEANPRASRTVPLVSKVCNIPMPRIAVQVMLGAKLKDMGLARRTFPHFGVKEAVFPFPMFPEVDPVLGPEMRSTGEVLGLAGNYGLAFYKAQEGANAQLPLSGSVLFTIADRDKEGALAAARRFAELGFTIRATEGTCRFLAGHGIAATPVTKLHEGRPNLVDAIKNREIHLVVNTPAGKQSAHDDSYIRKAAIANKIPHITTVAAAVAAAEGIAARRNGKEPVMSLQEYHAGIR

SEQ ID NO: 12178 - protein, 353 aa, Arabidopsis thaliana
MEKGEDSSTFKMGNSAQERSLPYVPDCYVVPPSSKPCDSNSGIVPTIDVSRLKGGDDERRGELSLACQHLGFFQIVNHGINQNILDDALEVANSFFELPAKEKKQFMSNDVYAPVRYSTSLKDGLDTIQFWRIFLKHYAHPLHRWIHLWPENPPGYREKMGKFCEEVRKLSIELMGAITESLGLGRDYLSSRMDENGMQVMTVNCYPPCPDPETALGLPPHSDYSCITLLLQNLDGLKIFDPMAHGGSGRWVGVPQVTGVLKVHIGDHVEVLSNGLYKSIVHKVTLNEEKTRISLASLHSLGMDDKMSVPRELVNDENPVRYKESSFNDFLDFLVKNDISQGDRFIDTLRIKD

SEQ ID NO: 12179 - protein, 572 aa, Erythrobacter sp. NAP1
MPHHSLENRSQIGHVIDMNVNTASYHHPTPWDATFEPMSLPEMLARTVAHNPDAPFLHFLGRTYSYSEIEREAKSFAAGLIAMGVEQGDRIGLFLPNVPIYASAYYGAMMAGAVVVNFSPLYSVEELAWQVGDSGTKVLVTLDVPELYSTAAKVLEGSALETLIVGSLSEMLPAVKGLALKLFKRSQIADVAWGPDTLKWSEMLRSWPEGEATLDRRDDLALLQYTGGTTGRPKGAMLGHSQLTQNAQQVAAINPFEDPRKEVFMGALPFFHVFANTALLNHAVAAGASIAMVPRFEAKQVLQTIQKYKATGFPGVPTMFQALLDHPDLTKTDLSSLKVCISGGAPMPAQVHTKFEEVTGVRVVEGYGLTESSGVVSTNPYEGTRKKGTIGQLVAGTEIVLLDKEDPTKLAPDGEPGELAVHGPQVMRGYWQRPETDADVFVERDGKRYLRTGDVAVMDEDGFLEIVDRIKDMIAVGGFKVFPSVVEDAILKHEAIKEALVIGVPDDYKGEVPRAYVTLEDPETDIGADALKGWLNDRIGKHERVDQVVIRKELPKTIIGKLDRKALRAEVL

SEQ ID NO: 12180 - protein, 375 aa, Shewanella sp. ANA-3
MRILETIMNKPPIIWLNVILFSLTFLSAVILVPWYGLTHGYGASEWIAFVVLAFASGLSITAGYHRLWSHKAYKAHPAVRFLYALGGALALQNSALHWASDHRVHHKHVDDNDKDPYSANMGFWYSHIGWMLREYQAQRYHDYQNVRDLQNDRIVMWQHKHYLALVILMNIGLPALLGWFTGNIAGMLLMAGLLRLVVVHHCTFFINSLAHVWGSQPYTDKNTARDNGFLAMLTYGEGYHNFHHIFENDYRNGIKWWHYDPTKWLIKGLSWVGLAKDLRTSPQERIESARLQMQLLHAKNKVVHLPNADEVIEKIQQEYELMKEHLLEYYQAKKALLDAKRKQLVDQQLLLQVEELKTRFLTQQKSWKSLTASYS

SEQ ID NO: 12181 - protein, 255 aa, Marinobacter sp. ELB17
MSNPLFDMTGKVALITGSTKGIGLSIAEEMARLGAKVVISSRKADACEQVANELKGKGYEAIAIPCHVGKKDDLQNLVNKTNEAWGSIDVLVCNAATNPVYGPSSEMTDEAWDKIMDTNVKGTFWLTNMVLPQMAEKGEGAVVLLSSIAGIRGNTTIGTYGVSKAAEAALARNLAVEWGPKGIRVNSIAPGLIKTDFARTLWEDPVRVKRAEDKTPLRRIGDPVDIAGLAVFLSTKASAYITGQTIVADGGETIC

SEQ ID NO: 12182 - protein, 842 aa, Anabaena variabilis ATCC 29413
MRAVLMAGGSGTRLRPLTCDLPKPMVPILNRPIAEHIINLLKRHHITEVIATLHYLPDVLRDYFQDGGDFGVQMTYAVEEDQPLGTAGCVKNIAELLDETFLVISGDSITDFDLGEAIAFHKQKQSKATLILTRVPNPIEFGVVITDEAGKIKRFLEKPSTSEIFSDTVNTGTYILEPEVLEYLPLNTECDFSKDLFPLLLAKDEPMYGYVAEGYWCDVGHLDAYREAQYDALERKVKLDFAYRENSPGLWIGQNTYIDPSAHIEAPVVIGNNCRIGARVQIEAGTVIGDNVTIGADANLKRPIVWNGAIIGEEAQLSACVISRGTRVDRRAHVLEASVVGSLSTVGEEAQISPGVRVWPSKKIESGAILNINLIWGNTAQRNLFGQRGVQGLANIDISPEFAVKLGAAYGSTLKPGAKVTVSRDQRNVSRMVTRSLIAGLMSVGVDIQNLDATAIPIARTVIPTMGVAGGIHVRVHPDRADYILIEFMDHKGINISKAQEKKIEGAYFKEDMRRALTHEIGDVAYPSQVIDLYCTAFEKLLNVSTLHNSRAKVVIDYVYAVSGAVLPQMLDKFGADAVVLNASLNKNAVTTTDREGLLTQLGHVVEALKANFGVQVSANGEQLILVDESGYPIRGELLTALMVDMILTSNPRGTVVVPVHASSAVEQVARRHDGRIIRTKANATALMEACQKNPNVVLGGSGETGFIFPQLHPGFDSMFCIAKIIEMLTIQERSLATVRSELPRVIYRTHTIRCPWSAKGALMRYLVETHPAQNLELIDGVKIRQPFDDSWLLVLPDASEPLVHLYANSHERDWVDETVRDYRSRVQSFVERQQEYHPAEV

SEQ ID NO: 12183 - protein, 509 aa, Xylella fastidiosa 9a5c
MKQISILVRLFITPYVSYPCGFLHSSRPVMSFLPSFLKRKSIDLITVHEEGRRLVPTLSWPHLIALGIGAIVGTGIYTLIGVGAEKAGPAILLSFVIAGVICACAALAYAEMATMMPVAGSTYTYSYVALGEGIAWIVGWSLILEYSLVVSTVAVGWSGYMSGFLKSVGVDMPLALTAGPYAGGIINLPAVVITCVVAGLLIVGTKESTTLNAVLVVVKIIALSVFVVIALPHFDMAHLKPFMPYGFTKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRGLSTVNARTGTPIATTLFTAILVATAAGLVPLGEIAALANAGTLTAFIAVALCLLVLRVREPQRVRAFRTPLAWVVGPIAIAGCLYLFWSLPKMTQSLFLLWNALGLCVYLVYGRHTSLLSKAVSIDTPR

SEQ ID NO: 12184 - protein, 478 aa, Nicotiana tabacum
MKTTELVFIPAPGMGHLVPTVEVAKQLVDRDEQLSITVLIMTLPLETNIPSYTKSLSSDYSSRITLLQLSQPETSVSMSSFNAINFFEYISSYKDRVKDAVNETFSSSSSVKLKGFVIDMFCTAMIDVANEFGIPSYVFYTSNAAMLGLQLHFQSLSIEYSPKVHNYLDPESEVAISTYINPIPVKCLPGIILDNDKSGTMFVNHARRFRETKGIMVNTFAELESHALKALSDDEKIPPIYPVGPILNLGDGNEDHNQEYDMIMKWLDEQPHSSVVFLCFGSKGSFEEDQVKEIANALERSGNRFLWSLRRPPPKDTLQFPSEFENPEEVLPVGFFQRTKGRGKVIGWAPQLAILSHPAVGGFVSHCGWNSTLESVRSGVPIATWPLYAEQQSNAFQLVKDLGMAVEIKMDYREDFNKTNPPLVKAEEIEDGIRKLMDSENKIRAKVMEMKDKSRAALLEGGSSYVALGHFVETVMKN

SEQ ID NO: 12185 - protein, 424 aa, Brassica rapa
MATPMVEDTSSFEEDQLASMSTEDIVRATRLLDNEIRILKEDAQRTNLECDSYKEKIKENQEKIKLNKQLPYLVGNIVEILEMNPEDDAEEDGANIDLDSQRKGKCVVLKTSTRQTIFLPVVGLVDPDSLKPGDLVGVNKDSYLILDTLPSEYDSRVKAMEVDEKPTEDYNDIGGLEKQIQELVEAIVLPMTHKERFEKLGVRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPTEEARARILQIHSRKMNVHPDVNFEELARSTDDFNGAQLKAVCVEAGMLALRRDATEVNHEDFNEGIIQVQAKKKASLNYYA

SEQ ID NO: 12186 - protein, 479 aa, Nicotiana tabacum
MKTAELVFIPAPGMGHLVPTVEVAKQLVDRHEQLSITVLIMTIPLETNIPSYTKSLSSDYSSRITLLPLSQPETSVTMSSFNAINFFEYISSYKGRVKDAVSETSFSSSNSVKLAGFVIDMFCTAMIDVANEFGIPSYVFYTSSAAMLGLQLHFQSLSIECSPKVHNYVEPESEVLISTYMNPVPVKCLPGIILVNDESSTMFVNHARRFRETKGIMVNTFTELESHALKALSDDEKIPPIYPVGPILNLENGNEDHNQEYDAIMKWLDEKPNSSVVFLCFGSKGSFEEDQVKEIANALESSGYHFLWSLRRPPPKDKLQFPSEFENPEEVLPEGFFQRTKGRGKVIGWAPQLAILSHPSVGGFVSHCGWNSTLESVRSGVPIATWPLYAEQQSNAFQLVKDLGMAVEIKMDYREDFNTRNPPLVKAEEIEDGIRKLMDSENKIRAKVTEMKDKSRAALLEGGSSYVALGHFVETVMKN

SEQ ID NO: 12187 - protein, 506 aa, Wolbachia endosymbiont of Drosophila ananassae
MGIKSVVLCILDGWGNGVENSKYNAISNANPPCWQYISSNYPKCSLSACGTDVGLPGGQIGNSEVGHMNIGSGRVVIQSLQRINQEIGTIENNVNLQSFISNLKSKNGVCHIMGLVSDGGVHSHQKHISTLANKISQHGIKVVIHAFLDGRDTLPNSGKKCIQEFIKSIKGNDIRIATVSGRYYAMDRDNRWERTIEAYEAIAFAKAPRHDNAVSLIDENYQNNITDEFIRPAVIGDYQGIKPEDGVLLANFRADRMIQLASILLGKTDYAKVAKFSSILSMMKYKKDLQIPYIFPPTSFADTLGQTIEDNKLQQLRIAETEKYAHVTFFFNCGKEEPFSGEERILIPSPKVQTYDLQPEMSAFELTEKLVEKIHSQEFALIVVNYANPDMVGHTGNIKAAEKAVLAVDDCLAKVLSAVKKSSNTALIVTADHGNVECMFDEENNTPHTAHTLNKVPFIVSCDNLKLRDGRLSDIAPTILQLLGIKKPDEMTGSSLISCITLCHSS

SEQ ID NO: 12188 - protein, 717 aa, Arabidopsis thaliana
MAPNLHIKKAFMAMRAMGIEDARVKPVLKNLLALYEKNWELIAEDNYRVLADAIFDSHEDQAIQESEEKKADEVKEDEGCAAEVDRGKKKLHESIEDDEDVMAESDRPLKRLRRRGEGGSALASPSLGSPTLEGPSINDEENAPILLPYHPVPIENDHDAGELILTKVEPITNMPLSSIPDSVDRGDSSMLEIDKSNGHVEEKAGETVSTADGTTNDISPTTVARFSDHKLAATIEEPPALELASSASGEVKINLSFAPATGGKHHKVPSMEELRRAMEEKCLRSYKILDPNFSVLGFMNDICSCYLDLATNGRDSANQLPKNLPFVTTNIDALKKSAARMAYTSQASNDVVEICSNEHMRDAENGAVGDSMALVVVPECQLSADEWRLISSVGDISLGKETVEIPWVNEVNDKVPPVFHYIAQSLVYQDAAVKFSLGNIRDDQCCSSCCGDCLAPSMACRCATAFNGFAYTVDGLLQEDFLEQCISEARDPRKQMLLYCKECPLEKAKKEVILEPCKGHLKRKAIKECWSKCGCMKNCGNRVVQQGIHNKLQVFFTPNGRGWGLRTLEKLPKGAFVCELAGEILTIPELFQRISDRPTSPVILDAYWGSEDISGDDKALSLEGTHYGNISRFINHRCLDANLIEIPVHAETTDSHYYHLAFFTTREIDAMEELTWDYGVPFNQDVFPTSPFHCQCGSDFCRVRKQISKGKNVKKRA

SEQ ID NO: 12189 - protein, 142 aa, Xerophyta humilis
MASKIARSVASRLGSTRKMTTATTARMKPVAPTATDFVDQNAKGKVVKGDMFPVYVALGMITLSLGFGAHTAKQHLMHSPGVRVSKKQRDTVLDVDDPDRVASESDRFINKSFFRKVAHIQDFRLHPSWHVGSYTWQYGEQP

SEQ ID NO: 12190 - protein, 205 aa, Coxiella burnetii RSA 493
MTEFKSAPAYQEAKYLTSAAEFDQLPPDQGAEIAFIGRSNAGKSSALNIITGIKGLARTSKTPGRTQMINFFALNEHERLVDLPGYGYAKVPRMVQKRWEELVDSYLKNRRCLKGLVVVMDIRHPLKEMDEDVIEWAVNYDIPIHILLTKSDKLSQNAAKKTLGEVQTAISAYGEKLTLQLFSSHDRTGLDEVKAVLSQWFRSEP

SEQ ID NO: 12191 - protein, 196 aa, Xerophyta humilis
FVHEPSLATAEKLLATLNVTPTTPFAEQDFLNMFFKNIYEPIPLIYNLVLAMLWRHPENVELHKVKVVHYCAAGSKPWRYTGEEENMDREDIKRLVKKWWEIYDDDSLDYKGPAAMTATEKKWRYTGEEENMDREDIKRLVKKWWEIYDDDSLDYKGPAAMTATEKKPEAAGLKQLKLEALPEAGVVPFVKAPSAA

SEQ ID NO: 12192 - protein, 204 aa, Glycine max
TDESLKDAFSQYGKVTEAKVVMDKFSGRSRGFAFVTFDEKKAMEEAIEDMNGLDLEGRAITVDKAQPQGAGRDRNGDRDFDRDRGSRGGRDYGGGRAPRGGGGGDCFKCGKPGHFARECPDGDGGRGDRYGGRDDRYGGGRSDRGGDRSDRGGDRSDRDRSDRGGDRSDRDGDRSERGSDRYSSRSRDGGSGGDRYSRDRSGPY

SEQ ID NO: 12193 - protein, 259 aa, Rhizobium leguminosarum
MQSLENAVQDDDATQEMLSLVLEEPDHWAMFLDIDGTLLNLAPTPDAIEVPEALPGQLHRLSNKLGGALALVTGRSLAYADALFKPFAFPTAGLHGAEIRNAAGMQTVEATAEFQALKHALTEEAEHYPGVLIEDKGAAVAAHYRLAPEYEKVLADRMHHYAELAGPNWALQLGKMVFELRPARSSKGDALERFFQSDPFKNRCPITIGDDLTDESMFAIANARGGVSVRVGAIGAPSCATSRLSSSALVRNVIAALAA

SEQ ID NO: 12194 - protein, 275 aa, Xerophyta humilis
SLQQVEEVKCLLRIIPIWSTGIIYYIAIVQQQTYVVYEALQSDRHLGNTSFLIPAASYSVFAMLAMTIWIPIYDRIIVPRFRKLTGQEGGITLLQRMGVGLVLAIIGMVVSAIIEIQRRSYAIHRPTIGTAPSGGAISSMSSLWLIPQLVILGLSEAFNAIGQIEFYYKQFPENMRSVAGSLFFLGAATANYLSGALIGVVHRVTGRGAGKNWLAGDLNKGRLDYYYFFIAGLGVLNLVYFMMCAKWYKYKEADSSSNAGEISLVDEIISKEPLV

SEQ ID NO: 12195 - protein, 366 aa, Thermotoga maritima
MGSDKIHHHHHHMKIAVLPGDGIGPEVVREALKVLEVVEKKTGKTFEKVFGHIGGDAIDRFGEPLPEETKKICLEADAIFLGSVGGPKWDDLPPEKRPEIGGLLALRKMLNLYANIRPIKVYRSLVHVSPLKEKVIGSGVDLVTVRELSYGVYYGQPRGLDEEKGFDTMIYDRKTVERIARTAFEIAKNRRKKVTSVDKANVLYSSMLWRKVVNEVAREYPDVELTHIYVDNAAMQLILKPSQFDVILTTNMFGDILSDESAALPGSLGLLPSASFGDKNLYEPAGGSAPDIAGKNIANPIAQILSLAMMLEHSFGMVEEARKIERAVELVIEEGYRTRDIAEDPEKAVSTSQMGDLICKKLEEIW

SEQ ID NO: 12196 - protein, 468 aa, Haloarcula marismortui ATCC 43049
MSGPEAEQQSVVLYDIEDKPPLGKAIPLGIQHVLAMFLGNVAPPLILAGAVGSVTGETTFLVQMALIVAGIATIVQAYPVGPVGARLPVVMGTSFAFLGPLIGIGNQFGIAAVFGASLLAAPVEVIMGVSFDRFRRFFPPLVTGIVVMLIGLTLIPTGMNYAAGASAGPSAEGYGSFVNLGLAGLVLIVTVGLNQFFEGFLRVISVFVGIIVGYLAALALGVVDLSAVAAAGWVTVPVPLKYGLAFEPSAVVTVAFLYIITGMETIGDISGTVSATGRNATREEIRGGLVADGVMSVFGAVFNALPNTSFSQNVGLVNFTGVASRYVAGIGGVVLLALGFIPKVGAVVSAMPDAVLGGGALILFAMIFSSGARLITQNVELDHRNSTILAMSMALGLGVAFRPEILQNFPSEVQTLFGSALVTGGMAALILNIVFPGGSVGTGPTEYTAGLEPDPVETGAGAPPVDDD

SEQ ID NO: 12197 - protein, 817 aa, Ostreococcus tauri
MDRDHASSGTGDGSGTHATSRTNAEGSLTERVKHAVRSMSANEYSCVKSTLPTFASIKRKHLERLVRATWASEFEAENAEEIARALARVNVLRSPLSALRRAGLLHALARYGSNSMLYPLYAWREKLFDEPLEAYSSDDRSELARARRKMCAEFNRGAGAKDRQGQNACAGLVAPCAALVRAKVKFHRHFVAFENNYSVDAREEVLLDDEDDIGMSDPISSLSLCALIAISGKARRVLDVAAPLLPDLSEWVTEANAADGLQWAELVAFVARMALQEADLAYGAALFVAATLAEEKRLSESDNEKFQVEYDALRQCFAVARSKVYLHEESVHELGVNAPDFLETETDIKEILSANAPAKKHVLDTTFINLMDADVSGEPMSVTYATPVVGETPPLIEFDGPGSHAVDWYNPFGLAPPQDLGVRPGHRRKPSDFDLEAFAAPLEFTPLQSGPASELTYVDPFATPANAPNADALDMNALTQLLGTPKRMPSPSRQGAHTPQKPPRSPMHQPDWFVEIPLAELEFGRQIGRGAFGEVFRGKFRGTDVAIKRLCVLDGSAAAPMMTSEETSDDRGLAEFKRELSFLSRLRHRHIVQFIGAATEPPNLCIVMDYCDKGSLYAYLHNQSKTLSAFKVLKWMSEAAKGLVYLHASGIIHRDVKSGNLFIDDGGSIKIGDFGLSKFHSGASTSGGMMSVVGTYQFMAPELLNGQPRYTSAVDVYSFGIVMWECLTREEPFVGLSPMQIVAALLRGERPGDGATETNDMELPEEYLERMRACWDAEPGVRPAMKDVAPELERLFLNEKRRVLAAKRAVDQTPSLI

SEQ ID NO: 12198 - protein, 429 aa, Ralstonia metallidurans CH34
MSAIVDIIGREVLDSRGNPTVECDVLLESGVMGRAAVPSGASTGSREAIELRDGDKSRYLGKGVLKAVEHINTEISEAIMGLDASEQAFLDRTLIELDGTENKGRLGANAMLAVSMAVAKAAAEEAGLPLYRYFGGSGAMQMPVPMMNIVNGGAHANNSLDIQEFMIMPVSQTSFREALRCGAEVFHALKKILSDKGMSTAVGDEGGFAPNFSSNEECLNTVVQAIEKAGYKAGEDVLLALDCAASEFYHEAEGVYSLEGEGLKLTSTQFADYLANLCDKFPIVSIEDGMAEGDWEGWKTLTDKLGKRVQLVGDDLFVTNTKILKEGIEKGIGNSILIKINQIGTLTETFAAIEMAKRAGYTAVISHRSGETEDSTIADIAVGTNAGQIKTGSLSRSDRISKYNQLLRIEEDLGDIATYPGKSTFYNLR

SEQ ID NO: 12199 - protein, 1232 aa, Oryza sativa (japonica cultivar-group)
MAGKKRKSASSDKQQKQQWLPLGADADAAKRRRSGAAKILREALTQQQEESLADKRPATSATAAPSPSFSFPVPNKDGEEEEDDDVDEFDGLDAQSKYDGGVPEIDEENEKALAAFMSKDTSSKRTLGDIILKKIRQKDAEISTDALSVHVGLLSLHVRRLILLMSSPFCASVQLPLALMDRQWMYADRRSKEFIDGVHYFLRVAEANRQRGFICCPCNKCKNQKEYSASRTIHFHLFESGFMPSYNCWTSHGEQGVEMEEDEVEDDNIPDFAQYVGFEGNQTGEEEIAADGNDVADDLGQMLQDAREDCESEKEAHKLDKMLEDHRTSLYPGCEQGHKKLDTTLELLQWKAKNGVSDKAFGDLLKLVKNILPGGNKLPETTYEAKKIVCPLGLEVHKIHACPNDCILYRGEEYENLEACPVCKALRYKIRRDDPGEVDGQLTKKRIPAKVMWYFPIIPRLRRLFRNKGNARMLRWHAEERQQDGMLRHPADGSQWRNIDRKFKEFGKDARNIRFGPKQPGNDIDVYLRPLVEDLKQLWKKEGVPVWDEDKQEEFNLRALLFVTINDWPALSNLSGQSNKGYKACTHCMDETESTYLKHCRNVVYMGHRRFLAANHPVRKKGKHFEHKADHRTKPKHRSGKTVFAMVKNLKVVFGKGPGSQHIESEDGHAAMWKKNSIFWELPYWEFLDVRHAIDVMHLTKNLCVNLLGFLGVYGKSKDTLEARNDLKHMEQRGDLHPEPKEKGSHYLSPASYTLSKAEKESMFECLESIKVPSGYSTNIKRIISTKEKKFTNLKSHDCHVLMTQLLPVVIRGILPDNVRATITKLCAFMNAISQKVIDPDRLEALQNEVVQCLVSFELIFPPSFFNIMTHLLCHLVKEIRILGPMYLHNMFPFERYMGVLKKYVRNRARPEASIAKGYGTEEVIEFCVEFIEDLRPIGVPESRHEGRLRGKGTLGRKAIMTVDNNLFRKAHFAVLQHSSLVAPYIEEHLALVRARNIGKSDAWITRHHIDTFPAWLRQHLMGNESINQQLAFLARGPSGSITTFQGYEINGYTFYTRAQDMKSTNQNSAVRVDAMGHDGTTATYYGAIEDIWELDYGPLKVPLFRCQWVRLTGGGVMIDDSGMTTVDLNKVGYSDKPFVLANDVIKGKKGRGPDEPKRQVVLPGKRKIVGVEDKTDEDYDQLDGQPPFTVTIDPSILLSNEDTPYSRSDHKEGTIVRRKYVRSTVTADVMP

SEQ ID NO: 12200 - protein, 482 aa, Frankia sp. EAN1pec
MLEREQMFVGGAWVAPSTDSRIEVTSPHTEKLIGRVAAASTEDVDRAVAAARRAFDEGPWPRTDPAERVEVIRRLATLYRGHRDELAELITAELGAPISFARRAQVALPGALMTALADTAAGYSWQEKRPGTYGQDIILRKEPVGVVAAVVPWNMPQFLTVTKVIPALLAGCTVVLKPAPESSLDALFFADLLDQVGLPPGVVNVLPADREVSAYLVAHPGIDKVSFTGSTAAGRQVAAACAPNLTKVSLELGGKSAAIALDDADPATVARAVRLSGMGMAGQICNSLTRVLVPTSRVGDYADALAATLSAIRIGDPADPATEMGPLVARRQQERVRQYIDTGVREGARLVVGGTDLPDGIDRGWYVRPTVFSDVDNAMTIAREEIFGPVLVVIPYGDEDEAVRIANDSEYGLAGSVFTADTGHGLEVAGRVRAGTFGVNQGYSMDPAAPFGGVKASGYGRELGREGLEGYLDVKSISVATA

SEQ ID NO: 12201 - protein, 413 aa, Pyrococcus furiosus DSM 3638
MKAVILAGGFGTRLRPISSTRPKPMVPVLGKPNLQYILEALEKVSEIDEIILSVHYMRGEIREFIQERMVDYPKDIRFVNDPMPLETGGALKNVEDYVSDDFLVIYGDVFTNFDYSELIKAHKENDGLITVALTKVYDPERFGVVIVDEEGKIIDFEEKPRKPKTNLVDAGIYMVNKEVLKEIPKNKEVYFEREILPKFVSQGLVYGYRMPKEYYWIDLGTPEDLFYAHQIALDQLSRENGYMILGENVEIPEDVEVQGPVYIDNNAKIGHGVKIKAYTYIGPNTIIEDKAYIKRSILLGSDIIKERAELKDTILGEGVVVGKNVIIKENAVVGDYARINDNLVIYGAKILPWKKVEEYEAYIRIKLDPTKVRPELTPERCPLGLPECIYKKFKAIAGEKPPCDECIENQWLF

SEQ ID NO: 12202 - protein, 389 aa, Enterococcus faecalis V583
MATKRDYYEVLGLAKGASDDEIKKAYRKLSKKYHPDINKEADAEEKFKEVSEAYEVLSDPQKKAAYDQYGHAGTDPNYGGGAGGFGGFGGGGFSSSGFGGFEDIFDSFFGGGGGRSVDPNAPRQGADLQYTIQLKFEEAIFGVEKEIKYNREDTCATCGGNGAKPGTHPETCHKCHGSGTINVERQTPLGRMMSRQTCDVCHGTGKEIKEPCPTCHGTGHEKKAHTVKVNVPAGVEDGQQMRLANQGEAGTNGGPYGDLYVVFRVEDSDIFDRDGAEIYYDLPVSFVQAALGDEVTVPTVHGDVKLKIPAGTQTGTNFRLRGKGAPRLRGGGNGDQHVKVKLITPKNLNEEQKDALRAFAKAGGQNVTEQQEEGFFDKMKDAFGGKKKK

SEQ ID NO: 12203 - protein, 145 aa, Brassica napus
MRALLHLRLINPCSPRAPRLPATPARALVASFSGAWQAPSGRARARAAPPAVRAMASQQVFRAQQQQQQQFPAQQQESQPGKEHAMDPRPEAIVQDYKAANKLKDKVALVTGGDSGIGRAVCLCFAKEGATVAFTFVRGQEEQGR

SEQ ID NO: 12204 - protein, 129 aa, Pseudomonas fluorescens PfO-1
MSITRYGTGSTAAGGQPRPFARAVEADGWLHVSGQVPAVDGEIIVGGIVEQTHQTMKNLIAILEEAGYGLEDVVRAGVWLDDPRDFSSFNKVFGEYFKPEHAPARACVQASMMVDCKVEIDCIAYKKKA

SEQ ID NO: 12205 - protein, 948 aa, Sorghum bicolor
MAASVSGATICLQKPGSKSRRARDATSSFARRSVAAPRSPHAAKASVIRSDAGAGRGQHCAPLRAVVDAAPIATKKRVFYFGKGKSEGDKSMKELLGGKGANLAEMSSIGLSVPPGFTVSTEACKQYQDAGCILPAGLWAEILDGLQFVEEYMGATLGDPQRPLLLSVRSGAAVSMPGMMDTVLNLGLNDEVAAGLAAKSGERFAYDSFRRFLDMFGNVVMDIPRSLFEEKLEHMKESKGVKNDTDLTAADLKELVGQYKEVYLTAKGEPFPSDPKKQLELAVRAVFNSWESPRAKKYRSINQITGLVGTAVNVQSMVFGNMGNTSGTGVLFTRNPNTGEKKLYGEFLINAQGEDVVAGIRTPEDLDAMKDVMPQAYEELVENCNILESHYKEMQDIEFTVQGNRLWMLQCRTGKRTGAGAVKIAVDMVSEGLVERRQAIKMVEPGHLDQLLHPQFENPALYKDKVIATGLPASPGAAVGQIVFTAEDAEAWHAQGKAAILVRAETSPEDVGGMHAAAGILTERGGMTSHAAVVARGWGKCCVSGCSAIRVNDAEKTVAIGDHVLSEGEWLSLNGSTGEVILGKQPLSPPALSGDLGTFMSWVDDVRKLKVLANADTPGDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQTAEKVFANAGKTIGYKIGTMIEIPRAALVADQIAEQAEFFSFGTNDLTQMTFGYSRDGVGKFIPIYLAQGILQHDPFEVLDQRGVGELVKFATERGRQTRPNLKVGICGEHGGEPSSVAFFAKVGLDYVSCSPFRVPIARLAAAQVLV

SEQ ID NO: 12206 - protein, 391 aa, Coxiella burnetii RSA 493
MSNLNLHNKRVMIREDLNVPMKNGKITNDERIVRALPTIQKAIEQKARVMILSHLGRPEEGKFEKEFSLAPVARLLSKKLNQKVPLINDWLKGVAVEPGQAILCENVRFNKGENENNTELAKRMAELCDIFVMDAFATAHRAQASTAGVAAYAKLACAGPLLISEVEALSRALENPQKPLVAVVGGSKVSTKIHLLENLLDKVDQLIVGGGIANTFLKAQGYSIGKSLCENEWLDAAQQFWEKAAEKNVSLPLPVDVIVADELSEDAKATVKNIDAVTSNESIFDVGPNTSATYAKLMAQAGTIVWNGPIGVFEIEAFSQGTRALAQAVAKSTAYSIVGGGDTLAALDKFNLTDQMSYVSTAGGAFLEFLEGKILPAIKILTQRAKEYEQK

SEQ ID NO: 12207 - protein, 135 aa, Brassica napus
  misc_feature (84)..(84): Xaa can be any naturally occurring amino acid
  misc_feature (92)..(93): Xaa can be any naturally occurring amino acid
  misc_feature (101)..(101): Xaa can be any naturally occurring amino acid
  misc_feature (103)..(106): Xaa can be any naturally occurring amino acid
  misc_feature (108)..(112): Xaa can be any naturally occurring amino acid
  misc_feature (114)..(115): Xaa can be any naturally occurring amino acid
MASSMLSSAAVATSPAQATMVAPFTGLKSSAAFPVTRKSNTDITSIASNGGRVSCMKVWPPVGKKKFETLSYLPDLTDVELAQXADYLLRNXXIPCVEPEXGXXXXVXXXXXRXXPGVYLLRFSPSPPHPSYTFP

SEQ ID NO: 12208 - protein, 334 aa, Coxiella burnetii RSA 493
MSFNIAINGYGRIGRNILRALYESGKNKDLKIVGINDLGDIKTNAHLTKYDSVHGRFSGEVGVSGNSLVINGDKIEVCAIRNPEELPWRNLEVDLVLECTGLFTSKEKAEAHLKAGAKKVLISAPAGNDVKTIVFGVNENIISSDDEIISNASCTTNCLAPLVKVLNDEIGIERGLMVTVHAYTNDQNLTDSYHKDLHRARAATQSMIPTKTGAAAAVGLVLPELDGKLDGYAIRVPTINVSVIDFTFDAKKLVSASDVNAMMKKAAQGKMKGVLGYNDEPLVSIDFNHDPHSSVFDAGQTRVIDQLVKVVSWYDNEWGFSNRMLDTALAFLKA

SEQ ID NO: 12209 - protein, 664 aa, Coxiella burnetii RSA 493
MPSRRDCANAIRALAMDAVQKANSGHPGMPMGMADIAEVLWRDFLKFNPANLNWVDRDRFVLSNGHGAMLQYALLHLTGAGLTIEDIKQFRQWHSRTPGHPEFGDTPGVETTTGPLGQGLATGVGMAMAEQMLAATFNRENFPIVDHYTYVFAGDGDLMEGISHEACSLAGTWGLGKLIVFYDDNGISIDGEVSGWFTDDTPKRFEAYHWHVVPNVDGHDPDAILKAIEAAQNVTDKPSLICCKTIIGYGAPILAGKAVTHGAPLGEEEVAGVRKILNWPHPPFEIPEEIYAAWDCKEKGEKNETQWNRLFTEYEKQHPDLAKEFRRRQEKELPEQWEQTGKELLATMQASKENNATRKLSLKCLNTFAPLLPELIGGSADLSESNCTKWTGAIIQGQDNRSGNYIEYGVREFAMTAIMNGMALHGGFIPFAGTFLTFSDYARNAVRLAAMMKAHAIFIYSHDSIGLGEDGPTHQPIEQLPSLRMIPGLHVWRPCDGVETAVAWKKIIEEPGANCLLLTRQTVAHQDRDEKQIAQIVKGGYILWESAANPEVILIASGSEVAVTIEAAKALAKENISVRVVSMPCCELFKKQNTDYRNSVLPPNVKKRVAIEAAHPDYWYQFVGYEGLVIGIDRFGASAPWQVVYREYGFTVENILNVVNQLYK

SEQ ID NO: 12210 - protein, 254 aa, Oryza sativa (japonica cultivar-group)
MSSAAGEPSSSSAAAAAISCSSSNDDEKPPPSLEGKELRRVEEEEPAAAARPEKLTEGSSRAAEAEEEEEVVEDEEDDDEEDEGKVAEAIDLGPRVSIKEQLEMDKEDESLRRWKEQLLGSVDLNSVGESLEPDVRITSLCILSPGRPDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKVMKSDTVIHL

SEQ ID NO: 12211 - protein, 104 aa, Zea mays
MSGRGKSGGKGLGKGGAKRHRKILRDNIQGITKPAIRRLARRGGVKRISGLIYEETRGVLKIFLENVIRDSVTYTEHAKRKTVTSLDVVYALKRQGRTLYGFGA

SEQ ID NO: 12212 - protein, 525 aa, Streptomyces coelicolor A3(2)
MTSVVGDRLRLVVRVLGSLVADEVGQATRLRRRTKRDTRSPAEGLVGSAGSAAEATAGAEQRRAKAVRHALESLGPFYVKLGQVLSTRPDMVPQSIRDELQNLHDEVDVQPFSEFEPVLARDLGADWKLRFDDIETVAPLGAASLAQVYRVTLPGGRAAVVKIQRPGIREGVLADMALMRRASKIVARVAPRFNEVIDIEAMLGSVFDAMEPELDFTGEARNMDEARGQVRSFRSLEVPRVLHASPRVLVQSLADGKSVRHVDRAHFTDDERVEIGKDLLRFMYHGYFVHRFFHADPHAGNVFAAPGGPATLIDWGMVGRLDRRTSLQLLPLFMTLAQNDGAGLAQHWAEMGRVTPWANMPAFAADMAAFVPKVSHLSLEDMNFGVALTTVLAKATKRGIGSPPAVSLLGKSFANLDGSVRCLAPEITLPEVFQGEVPKILFALGREFLGRNQFARNSMELLLAAVTSPEQVRGVLSDVANRQFALNIHEPRTPDAMGGQRPTRPSASLLALGAAAFLLGRRRSG

SEQ ID NO: 12213 - protein, 436 aa, Synechococcus sp. WH 8102
MLHSAHDVARFKSDHAVVVIGAGQAGLSVAYQLQQRGIRPVVLEKHRIGYAWDQQRWDSFCLVTPNWQCRLPDFPYDGNQPEGFMPKAEIVAYLQRFARHVGGDVREGVAVQRLTPKGSGYRLITSEGEMEAEHVVVATGGYHAPRRHPLAERLPASVLQLDARAYRNPAALPEGPVLVVGSGQSGSQIAEDLHLSGRTVHLSVGSAPRSPRVYRGRDVVDWLDRMGYYAMPISDHADPRSVRAKTNHYLTGRDGGREIDLRHRATEGMRLHGRLATIATDHIGFADDLAGNLDQADAVYCRIRSSIDSWIQQQGIEAPLEPPYSPCWQPSAMADPGIDLSRDPLAAVIWCTGYRSDFSWIDAPVFDGAGLPAHERGVTQSAGLYFLGLPWLHTWGSGRFCGVSDDADYLARLISLRLQRRDASQERLECTAILGS

SEQ ID NO: 12214 - protein, 168 aa, Anabaena variabilis ATCC 29413
MTILGNWGLGIGDWEKCFPSHQYPVFNPNYELRIMPTMDSPTPKAFSYPQTTIERARRSLICSPFNIGLFATMRSQSVSLGAIANEAGVKNGYTKNSLLELTCDNELDWLIQVGLLRREVDGQGITDSFRLTPLGHQLIEQYQGKNLPAPSWRDRLYDIVIRWFRLPF

SEQ ID NO: 12215 - protein, 201 aa, Sinorhizobium meliloti 1021
MSEALNELASYLREARGALIADAEVKYGELTVTAKAENLIALLTFLRDDVQCGFVSFIDVCGVDYPQRPDRFDVVYHLLSPRQNQRVRVKVATGENDPVPSATSVFPGADWFEREAYDMYGILFTGHPDLRRILTDYGFEGYPLRKDFPLTGFVEVRYDNEAKRVVYEPVELKQEFRNFDFLSPWEGTEYVLPGDEKARPR

SEQ ID NO: 12216 - protein, 259 aa, Triticum aestivum
AGRVWGTILPYSGTFLNFVSYAAGSVRLSALSRVRTIWVATHDSIGLGEDGPTHQPIETLAHFRALPNTMVWRPADGNETSGAYYVCLTSKHTPSIIALSRQNLPQLEGSTIEKAAKGGYVLHEVEGADITLVSTGSEVSIAVDAAKYLEEKKNIKARIVSMPCFEAFDLQDKEYRLSVLPDGVPSLSIEVMSTMGWERYTHEQFGINRFGASGAYKDVYKKFEFTPEGIAKRAVATIDFWKDVPNVRSPINRAFQQII

SEQ ID NO: 12217 - protein, 294 aa, Ralstonia metallidurans CH34
MTQITGSIVAIVTPMHEDGSLDFPALRALIDWHAAEGTDGIVIVGTTGESPTVNVDEHCELIRVAVEQSAGRVPIIAGTGGNSTSEAIELTAFAKKVGANASLQVVPYYNKPTQEGMYRHFRTIAEAVDLPVVLYNVPGRTVADMNNDTILRLAQVPGIVGVKEATGNIDRAAQLINGAPEGFAIYSGDDPTAVALILLGGHGNISVTANVAPRKMHEMCVAALKGDVVTARRLHMELIDLNRAMFVEANPIPVKWALQQMGKMEGGIRLPLTPLAEGQHETVRRALAAAGLLG

SEQ ID NO: 12218 - protein, 261 aa, Maackia amurensis
MASSKERETFVYVAKLAEQAERYEEMVDSMKNVATLDVELTVEERNLLSVGYKNVIGARRASWRILSSIEQKEEAKGNEVNAKRIKEYRQKVESELTNICNDVMRVIDEHLIPSASAGESTVFYYKMKGDYYRYLAEFKTGNEKKEAGDQSMKAYESATAAAEAELPPTHPIRLGLALNFSVFYYEILNSPERACHLAKQAFDEAISELDTLNEESYKDSTLIMQLLRDNLTLWTSDIPEDGEDAQKANGTAKLGGGEDAE

SEQ ID NO: 12219 - protein, 1085 aa, Frankia sp. EAN1pec
MECRTPAGRRRARGPRPAGAMPVNSPNAQRLPDADPVGRVQPQPVAGLGAEDVVELVEVAHDVGAQVRRAVRVGGQVLPLQLEPALGAPHVGPVHEQPTSVLPRRLAVLGDDVGLVGDGQAAEVADVLPDSERAVHLLARQVARLEPVVLLDQRLRLHLEGRLVGGRPPVVEVAGAVVLRALVVEAVTDLVADHRADAAVVLGRVAVRAEERLLENGGREADLVGARVVVGVDGLREHEPLVAVHRRADLGQLPVGLERGGCAGVAHQVAAADRQRRVVPEPVGVADLRPERLELLVRPLLGLLRHPVQLGDRRAVGREQVRDEVVHLRLGVRREVPGDVLPADRLPDRALDERHRALPAGPQLGRAAERAAVEVEVGLGEHVGQVGRGRAQHAADQPVAPHVDRRVGQHGRQVLEERRLPHARLRQRRVRAGQRPTETGDVGVPVERRAERGQLSARHQVVGLLDVAGLGPLPVALREQGFHVEDPLRGALGVGVPAQPEHPGQVVDVLLAGRGELVVVVVRLVRQAEAALAQVEQVAVRVAVVGVDVGAEQSGAADPLELAEERGEAADVAQPARAVQQRPHRAQAERLERLGVHEGVVEVADLPRVLALGGLVPRGEVGDDVADLPLGVIGQLHERAPARPVGRDLRLGEPPAVHVAEQVVLRSDVEVHALAGVVEDVHRTEVSNRLPPGHGATPSCPARPVHPLDGICPHVGIRSVRGHPLSITGGRRAARDQALSGLTNDTLWVSLWPGARSTPAARTRPHCSGPRCGTPPFACSATASGPADLMEMFLPPYADRPVAVVTGASSGIGRATARTLAEQGWQVIGVGRDPVRSAATEAEIAAAARKDGGFTMLRGDFTLMADVRRVAGEIQHLTPRLDILINNAGGVRDRQIISAEGTEATFAVNHLAPFLLTRELTPLLRASAASLPAGSTRVIAVSSSGHRAVDGLDWDDLQSLGEFRPAVAYCRAKLANILFTRELARRAGPDGIVAQAMHPGVVASNFSAHGDAAMRAHMAAADTVPPDEPAETLAWLATEPEGGRTGGRYFHRRAEELPAEAARDDAAAARLWTESERLLDGLGFR

SEQ ID NO: 12220 - protein, 745 aa, Wolbachia endosymbiont of Drosophila ananassae
MIDNTKLAGFIVAEVLEVIQHPNADKLKLCKVDDGSKILQIVCGANNVREGMKTVLASLGSTLPESDFTIKPTKIRGVLSEGMLCSASELALVQEESEGIIELSDDYKVGDKFFNCDPVIDINVTPNRGDCLGIFGIARDLAATGIGTLKTLSIPQLTSFINSPIDVEVTDGESFISGIYIANVKNQESPKWLKDRLESIGMRSISAIVDITNYIMISFSRPMHAYDAKKIEGELTVRKANDGEKFAGLNGKEYLLNKDISVIAGDKNIHGIAGIIGGKCSECTLETTDIFLESAWFDPISITKSSRQLGISTDASYRFARSVDPGFTFDGLNLAAKMILDLCGGETSSVVSAGSLDSVDTKVSFDYQDVNKFGSVSVSPDEVLDILTKLGFSIDKKTEGNWNVQVPSWRPDVTIPADLIEEVTRIYGYDKIKEEPLPNNVEEVDSTYDNLRILMTNRGFHEVLTWSFMSESTAEKFGYSNKLFIIDNPFNNNFNIMRPSIMPNLLQVTADNIAHGISDLAIFEIGPIYDGEARSKHVLSGIRTGNNLPRNHYNTDRKVDVFDAKADCIAALEFFNVNCDNLTIEKAEKEHYHPGKSGTLSFKNKVAGYFGELHPNILDLFDIKQKVVGFEVILENIENLPVSRKKFIDYKYQSVKRDFAFIVNKDVEVGNIINVIKKSSELITEVLIFDVYHGNNIEPNKMSIALSVTFCSPIHTLTEKEIQKESSAIVNLVCENTGGTLRTYR

SEQ ID NO: 12221 - protein, 322 aa, Nostoc sp. PCC 7120
MQQQGQPAYRGKQLHDWIYHKGVRSLTDISVFSKQWRAAVADVPIGRSTIHHRSVASDGTVKYLLQLSDGEIVEAVGIPTDKRLTVCVSTQVGCPMACDFCATGKGGYKRNLERHEIVDQVLTVQEDFQQRVSHVVFMGMGEPLLNTENVLAGLRSLNQDVGIGQRSLTLSTVGIRDRISELAEHHLQVTLAVSLHAPNQALREQLIPSARSYHIEDLLAECREYVAITGRRISFEYILLAGVNDLPEHALELSKHLRGFQNHVNLIPYNSIDEVDYKRPSGDRIQAFLTVLQQQHIAVSVRYSRGLEADAACGQLRTKASR

SEQ ID NO: 12222 - protein, 186 aa, Triticum aestivum
  misc_feature (78)..(78): Xaa can be any naturally occurring amino acid
MRVGDSGTNSDSQLSVRQNIQEFGTRVGSWAAQLITEAGGKVVSIRDVTGAVKNSNGVDIAQLMKHSAKNRGIKGSDXGDAVDPTSLLTEECDMLIPAALAGVINKDNVDAIKAKYIIEAANHPTDPKAEEILAKKGVLILPDILANSGGVMVSYFEWVQNIEGSMWDEEKVNRELKTYMTRASNI

SEQ ID NO: 12223 - protein, 441 aa, Coprinopsis cinerea okayama7#130
MQRRSFTALNSVFCVDAQYEFVKELGQGAYGCVVAARHRQTGEGCAIKKITNINTKRILTKRCLREIRRDRLLHHFRGHKNITCLYDMDIVFQPNGNFDEVYLYEELMEADLHAIIRSGQPLTDAHFQSFIYQTLCGLKYIHSANVLHRDLKPGNLLVNADCELKICDFGLARGYTPGSGTSRAAGNQGFMTEYVATRWYRAPEIMLSFANYSTAIDVWSVGCILAELLGGRPIFKGRDYVDQLNQILHYLGTPSEDTLRRVGSPRAQDYIRSLPIRPRISFSTLFPQANPLAIDLLSRMLCFDPARRISCEEALNHPYLAVWHDPADEPNCDSIFDFSFEEEDSIEGMKRLIVEEVNNFRAEVRAQARGSAQNHRSTKDSDNLGIPSRDEIISSPVKEFGPHPGHTSNYTTNAPRAPSPIMDDPSAELERELASTHISKK

SEQ ID NO: 12224 - protein, 260 aa, Shewanella oneidensis MR-1
MALRRPMVAGNWKMNGSAALAQELFKKFASKLQNDSAEVVLCPPSIYLESVRQLLEANKEALDGSLVRMGAQNLSQHDFGAYTGEVSGQMLKDCGCRYVIIGHSERRRMYGETSNIVAEKFAAAQKHGLTPILCVGESGPAREARRTFEVIAEELDIVIQKNGTMAFDNAIIAYEPLWAVGTGKSATPEQAQEVHAFIRKRLSEVSPFIGENIRILYGGSVTPSNAADLFAQPDVDGGLIGGASLNSTEFLSLCTIAMSA

SEQ ID NO: 12225 - protein, 500 aa, Beta vulgaris
MSMPIPSRQLFIDGEWREPIKKNRIPIINPSNEEIIGDIPAGSSEDIEVAVAAARRALKRNKGREWAATSGAHRARYLRAIAAKVTERKDHFVKLETIDSGKPFDEAVLDIDDVATCFEYFAGQAEAMDAKQKAPVTLPMERFKSHVLRQPIGVVGLITPWNYPLLMATWKIAPALAAGCTAVLKPSELASITCLEFGEVCNEVGLPPGVLNIVTGLGPDAGAPLAAHPDVDKVAFTGSSATGSKVMASAAQLVKPVTLELGGKSPIIVFEDVDVDQVVEWTMFGCFWTNGQICSATSRLLVHESIAAEFIDRLVKWTKNIKISDPFEEGCRLGPVISKGQYDKIMKFISTAKSEGATILCGGSRPEHLKKGYFIEPTIISDISTSMQIWREEVFGPVLCVKTFSSEDEALELANDTEYGLASAVFSKDLERCERVSKLLESGAVWVNCSQPCFVHAPWGGIKRSGFGRELGEWGIENYLNIKQVTSDISNEPWGWYKSP

SEQ ID NO: 12226 - protein, 396 aa, Sinorhizobium meliloti 1021
MTEHNVRNFNINFGPQHPAAHGVLRLVLELDGEIVERVDPHIGLLHRGTEKLIEAKTYLQAIPYFDRLDYVAPMNQEHAFALAVERLTGTQVPIRGQLIRVLYSEIGRILSHLLNVTTQAMDVGALTPPLWGFEEREKLMVFYERACGARMHAAYFRPGGVHQDLPHQLVEDIGNWIDPFLKTVDDIDELLTGNRIFKQRNVDIGVVSLEDAWAWGFSGVMVRGSGAAWDLRRSQPYECYSDLEFDIPIGKNGDCFDRYLIRMIEMRQSARIMRQCVDRLLGDAKIGPVSSLDGKIVPPKRGEMKRSMEALIHHFKLYTEGYHVPAGEVYAAVEAPKGEFGVYLVSDGTNKPYRCKIRAPGYAHLQAMDFLCRGHQLADVSAVLGSLDIVFGEVDR

SEQ ID NO: 12227 - protein, 718 aa, Sulfolobus solfataricus P2
MALFFRTRDRPLRPGDPYPLGSNWIEDDDGVNFSLFSENAEKVELLLYSLTNQKYPKEIIEVKNKTGDIWHVFVPGLRPGQLYAYRVYGPYKPELGLRFNPNKVLIDPYAKAINGSVIWNDAVFGYKIGDQNQDLTYDERDSGEYVPKSVVINPYFEWDDEDFIKGKKVPLKDTVIYEVHVKGFTKLRLDLPENIRGTYEGLASEQMISYLKDLGITTVELMPVFHFIDQRFLTDKGLTNYWGYDPINFFSPECRYSSTGCLGGQVLSFKKMVNELHNAGIEVIIDVVYNHTAEGNHLGPTLSFRGIDNTAYYMLQPDNKRYYLDFTGTGNTLNLSHPRVIQMVLDSLRYWVTEMHVDGFRFDLAAALARELYSVNMLNTFFIALQQDPILSQVKLIAEPWDVGQGGYQVGNFPYQWAEWNGKYRDSIRRFWRGEALPYSEIANRLLGSPDIYLGNNKTPFASINYVTSHDGFTLEDLVSYNQKHNEANGFNNQDGMNENYSWNCGAEGPTNDQNVVICREKQKRNFMITLLVSQGTPMILGGDELSRTQRGNNNAFCQDNEITWFDWNLDERKSKFLEFVKKMIQFYRAHPAFRRERYFQGKKLFGMPLKDVTFYTLEGREVDEKTWSSPTQLVIFVLEGSVMDEINMYGERIADDSFLIILNANPNNVKVKFPKGKWELVISSYLREIKPEERIIEGEKELEIEGRTALVYRRIEL

SEQ ID NO: 12228 - protein, 384 aa, Haloarcula marismortui ATCC 43049
MFLYLYSIFGNCFHPITRPGGCDRRHENGFPQPTRNGSMRAAIYRGPGDITVEEVPRPEIESPTDAIVRVTHTAVCGSDLWFYRGQSDREEGSRVGHEPMGIVEEVGDDVRSVEPGDRVFAPFVVSCGRCEFCRKGLHTSCVNGDSWGGDNGGGQGEYVRATEADGTLVRVPDRHADDEDTLEAILPLTDVMGTGHHAAVSAGVSEGDTCIVVGDGAVGLCGVLAARRLGAERIIAMGHHEDRLELAESFGATETVAARGQDAVDAADDLTNGGANHVLECVGAASAMETAIDVCRPGGTVGYVGVPHGLDDSGLDMFSLFGDNIGLNGGIAPVRAYADELLADVLQGTLDPSPIFTKTVDLNGVPEGYQAMDEREAIKVLVKL

SEQ ID NO: 12229 - protein, 159 aa, Zea mays
PVACAETGVTLISPFVGRILDWYKKSTGKEYTAETDPGVKSVQRIFNYYKQHGYNTIVMGASFRNTGEITELAGCDYLTIAPKLLEELKNSDAKVPKKLDAAPADQAKEEKVSFVDNEAAFRWELFNDPMAFDKLHEGIRGFAKDGDACKEMLREKLRA

SEQ ID NO: 12230 - protein, 641 aa, Bacteroides fragilis YCH46
MNYGFVKVAAAVPRVKVADCKFNSERLEGLITIAEGKGVQILTFPEMCITGYTCGDLFAQQLLLEQAEMALIQILNSTRQLDIISILGMPVVVNSTVINAAVVIQKGKILGVVPKTYLPNYKEFYEQRWFTSALQVSENSVRLCGQIVPMGNNLLFETAETTFGIEICEDLWATVPPSSSLALQGAEIIFNLSADDEGIGKHNYLCSLISQQSARCISGYVFSSSGFGESTTDVVFAGNGLIYENGYLLARSERFCMEEQLIINEIDVECIRAERRVNTTFAANKANCPGKEAVRISTEFVNSKDLNLTRTFNPHPFVPQGSELNSRCEEIFSIQIAGLAQRLLHTGARTAVIGISGGLDSTLALLVCVKTFDKLGLSRKDILGITMPGFGTTDRTYHNAIDLMNSLGVSIREISIREACIQHFKDIGHDLNIHDVTYENSQARERTQILMDIANQTWGMVIGTGDLSELALGWATYNGDHMSMYGVNAGIPKTLVKHLVQWVAENGMDETSKATLLDIVDTPISPELIPADENGEIKQKTEDLVGPYELHDFFLYYFLRFGFRPSKIYFLAQTAFSGVYDDETIKKWLQTFFRRFFNQQFKRSCLPDGPKVGSISISPRGDWRMPSDASSAAWLKEIAEL

SEQ ID NO: 12231 - protein, 164 aa, Sinorhizobium meliloti 1021
MMAGLSNAVSSLFLKEFVGAFLLSMRYFFRPKATLNYPFEKGPVSPRFRGEHALRRYPNGEERCIACKLCEAICPAQAITIEAGPRRNDGTRRTVRYDIDMVKCIYCGFCQEACPVDAIVEGPNFEFSTETREELYYDKEKLLANGDRWEREIARNIAMDSPYR

SEQ ID NO: 12232 - protein, 137 aa, Yarrowia lipolytica CLIB122
MERHPITCHILDTTRGRPAENVLCQIYRIGNVSGGPQRATSETEALGKARTNKDGRVALWTLENSFPEFTTAPLPGLYKIRFETEQYFVTAANGDVEKTKSFFPFVDVHFTIPSPADAHYHIPLLISNYSYSTYRGS

SEQ ID NO: 12233 - protein, 431 aa, Anabaena variabilis ATCC 29413
MLSIPINQHLPHTPHLVTSLPGPRAKAIVERDRAVTSPSYTRDYPLVVNRGEGCMVEDVDGNVFLDMTAGIAVTATGHAHPEVVRAIQEQSARLIHMSGTDFYYEPMVELAENLASQAPFVHDTKVFFTNSGAESNEGAIKLARYYTKRSLIIAFLGAFHGRTYGAMSLTGSKTVQRANFGPLVPGVTHIPYGTHASLDYLENNLLTTIIPAHEVAAIVVEPIQGEGGYIVPEDGFLQRIRNICDRYGILMVVDEVQSGMGRTGRLFAIEHWNVTPDIITTAKGIASGMPLGAILARAELMTWPPGSHATTFGGNPVACAAGIVTLKLLESGLMDNATQMGELLQTGLTQLHQQFPRMSLPRGKGLMVAVDLLDEDGNFDSKLRDRIIQEAFYHGLLLLGCGKAAIRFCPPLVINREQIQTTLDILAEILR

SEQ ID NO: 12234 - protein, 608 aa, Oryza sativa (japonica cultivar-group)
MHPLCALPLLITLLLISSVPLSVQESDAFFRYTNCTTASYQCGSLKLDVDYPFSANGVDRPNYCSYPGYRLICNPDNKLMIHMNSTVFQVTDIDYGNKFLAVIDQTQPQETCPDRYHNTTIDESRFMYTDLDQFLTVYVNCSAKSSSLPFIYDLLSCVSGGSSYYRLHKNKDDSLESDILGSCSSSFVVPFNSTMAGSLAAGNSSLVDVIRGGFTARWKVGVGYRIMFFIRYRLYLLTNLRASQGSKISKKKAIAIGVSVVSGVILLFLLLMCTLCVKKFWHGLLSSMGKSKEAPNIESFLQKHEAQHPKRYSYSEVKTMTKSFSHKLGQGGFGTVYMGKMPNGKPIAVKLLKSCKDDGQEFMNEVASISRTSHVNVVTLLGYCIQGSKRALIYEFMPNGSLERFAFRPNSETEDSLSWEKLFDIAIGIARGLEYLHRGCNTRIVHFDIKPHNILLDQDFCPKISDFGLAKLCKQKESIISIDGARGTIGYIAPEVFSKQFGDASSKSDVYSYGMMILEMVGARKNISASADVSSKYFPQWIYEHLEGYCVTANEIRLDTSVLVRKMIIIGLWCIQLLPNNRPSMTRVVEMLQSSADDLKIPPQSFLS

SEQ ID NO: 12235 - protein, 212 aa, Triticum aestivum
MGGQTGASEPLQFTNDAAFWNQSAGFGMGMAAPPATDNTSVRLAKQPAPAPRGANLALKTVLESVGDSSSIVTKKASGEPAFKKPRMETPSPLPTFKVRKEKLGDRITALQQLVSPFGKTDTASVLHETIEYIKFLHDQVGVLSAPYLKSGHHQHQVPQYLKSSSNGSPDKSCKDGGEVSLKGRGLCLVPISSTFPVASDVPVHFWDPLAPF

SEQ ID NO: 12236 - protein, 110 aa, Pseudomonas stutzeri
MQVLDTEARIRQQLAEHPVLLYMKGTPGVPECGFSRAAVEALKNSGRPFATVNVLLAPHIREKLPKISQWPTYPQLFLRGELVGGCDIILGLEADGSLVARLDAALAAES

SEQ ID NO: 12237 - protein, 676 aa, Corynebacterium glutamicum
MDTKAVDTVRVLAADAVENCGSGHPGTAMSLAPLAYTLYQRVMNVDPQDTNWAGRDRFVLSCGHSSLTQYIQLYLGGFGLEMDDLKALRTWDSLTPGHPEYRHTKGVEITTGPLGQGLASAVGMAMAARRERGLFDPTAAEGESPFDHHIYVIASDGDLQEGVTSEASSIAGTQQLGNLIVFWDDNRISIEDNTEIAFNEDVVARYKAYGWQTIEVEAGEDVAAIEAAVAEAKKDTKRPTFIRVRTIIGFPAPTMMNTGAVHGAALGAAEVAATKTELGFDPEAHFAIDDEVIAHTRSLAERAAQKKAAWQVKFDEWAAANPENKALFDRLNSRELPAGYADELPTWDADEKGVATRKASEAALQALGKTLPELWGGSADLAGSNNTVIKGSPSFGPESISTETWSAEPYGRNLHFGIREHAMGSILNGISLHGGTRPYGGTFLIFSDYMRPAVRLAALMETDAYYVWTHDSIGLGEDGPTHQPVETLAALRAIPGLSVLRPADANETAQAWAAALEYKEGPKGLALTRQNVPVLEGTKEKAAEGVRRGGYVLVEGSKETPDVILMGSGSEVQLAVNAAKALEAEGVAARVVSVPCMDWFQEQDAEYIESVLPAAVTARVSVEAGIAMPWYRFLGTQGRAVSLEHFGASADYQTLFEKFGITTDAVVAAAKDSINS

SEQ ID NO: 12238 - protein, 275 aa, Cryptomeria japonica
VVEQQGLAAKDYTDPPPAPLVDFEEFKLWSFYRALIAEFIATLLFLYITVATVIGHKRTAANCGSVGILGIAWAFGGMIFVLVYCTAGISGGHINPAVTFGLFLARKVSLPRAVLYMVAQCLGAICGVGLVKAFQKSFYDMYGGGANSVAPGYSKGTGLGAEIIGTFVLVYTVFSATDPKRSARDSHVPVLAPLPIGFAVFMVHLATIPITGTGINPARSFGAAVIYGHDKIWDDQWIFWVGPFLGAFAAAFYHQYILRAAAIKALGSFRSNPNV

SEQ ID NO: 12239 - protein, 322 aa, Coccidioides immitis RS
MENYQKIEKIGEGTYGVVYKARDLSNQGRIVALKKIRLEAEDEGVPSTAIREISLLKEMHDPNIVRLLNIVHADGHKLYLVFEFLDLDLKKYMEALPVSEGGRGKALPDGSLNMSRLGLGEAMVKKFMAQLVEGVRYCHSHRVLHRDLKPQNLLIDRDGNLKLADFGLARAFGVPLRTYTHEVVTLWYRAPEILLGGRHYSTGVDMWSVGAIFAEMCTRKPLFPGDSEIDEIFKIFRIRGTPDERSWPGVTSFPDFKSSFPKWRREDIRKIVTGLEESGLLLLDAMLEYDPARRISAKQACVHPYFRSCSSTYSGRSKTNYQ

SEQ ID NO: 12240 - protein, 552 aa, Pseudomonas fluorescens PfO-1
MYVYDEYDQRIIEDRVKQFRDQTRRYLAGELSEEEFRPLRLQNGLYIQRFAPMLRVAVPYGQLTSRQVRMMAKIARDYDKGYAHISTRQNVQFNWPAVEDIPDILAELATVQMHAIQTSGNCLRNVTTDQFAGVAADELIDPRPWCEIVRQWTTFHPEFAYLPRKFKIAVNGSTSDRAAIEVHDIGLEPVHNAAGELGFRVLVGGGLGRTPVVGAFINEFLPWQDLLSYLDAILRVYNRYGRRDNKYKARIKILVKALTPEVFAQKVDAEMEHLRGGQTTLTEAEVHRVAKHFVDPDYKALSNQDAELAALDKEHPGFARWRTRNTLAHKKPGYVAVTLSLKPTGVAPGDITDKQLDAVADLAERYSFGQLRTSHEQNIILADVEQSQLFTLWGELREAGFATPNIGLLTDIICCPGGDFCSLANAKSIPIAESIQRRFDDLDYLFDIGELDLNISGCMNACGHHHVGHIGILGVDKKGEEFYQVSLGGSASRDASLGKILGPSFAQEDMPDVISKLIDVYVEQRTEDERFIDTYQRIGIDLFKERVYAANH

SEQ ID NO: 12241 - protein, 333 aa, Prochlorococcus marinus str. MIT 9301
MKSILEQLSSMTVVVADTGDLDSIKKFQPRDATTNPSLILAAAKNPDYVKLIDKSLESSENALPQGFTEIDLIKETVDQVSVFFGKEILKIISGRVSTEVDARLSFDTQATVEKARKLINLYKNFGIEKERILIKIAATWEGIKAAEILEKEGIKCNLTLLFNFCQAVTCANAKITLISPFVGRILDWHKAKTGKTSFVGAEDPGVISVTQIYKYFKEKGFKTEVMGASFRNLDEIKELAGCDLLTIAPKFLEELKKEKGELVRKLDVSTQINHSIDYEFEEKDFRLSMLEDQMASEKLSEGITGFSKAIEELEELLLKRYSEIKNHKLISAN

SEQ ID NO: 12242 - protein, 339 aa, Coprinopsis cinerea okayama7#130
MESLIQVQDVVQRFIREQPCWTTFLLALGSFNALRIIYQTLSVVLQTFVLPGTSLKRFGAKKGAWAVVTGATDGIGKEFAMQLGKAGFNVLLVARNPATLAATAGEIEQKYKVQTGTFSIDFAAATEEKYTALGEVLTGLDVGVLVNNVGKSHNMPAYLVDTPRDEMRDIVEINVNATLRVTYAILPGMVKNKRGLILNIGSFAGAIPSPMLATYSGTKAFLSTFSSALGEEVKKDGIIVENVNTYFVVSKLSKIRKSSLLIPTPAPYVRSVLSKVGLACGAAFSGRPNTSTPYWSHALLDYAMTLVGIPSLFIRYTHNLHIDIRRRALRKLEREAKAQ

SEQ ID NO: 12243 - protein, 500 aa, Solanum lycopersicum
MAIGSLARRKASTILSSRYLKYSFSLSRGFASGSDENDVVVIGGGPGGYVAAIKAAQLGLKTTCIEKRGTLGGTCLNVGCIPSKALLHSSHMYHEAQHSFASHGVKFSSVEVDLPAMMAQKDKAVAGLTRGIEGLFKKNKVNYVKGYGKFLSPSEVSVDTVEGGNTIVKGKNIIIATGSDVKSLPGLTIDEKRIVSSTGALALTEIPKKLVVIGAGYIGLEMGSVWGRLGSEVTVVEFASDIVPTMDGEVRKQFQRSLEKQKMKFMLKTKVVSVDTVGDSVKLTLEPAAGGEQTTLEADVVLVSAGRVPFTSGLGLDKIGVETDKAGRILVNERFASNVPGVYAIGDVIPGPMLAHKAEEDGVACVEFIAGKEGHVDYDLVPGVCYTHPEVASVGKTEEQVKALGVDYRVGKFPFLANSRAKAIDDAEGIVKVIAEKGTDKILGVHIMSSNAGELIHEAVLALNYGASSEDIARTCHAHPTMSEALKEAAMATYDKPIHM

SEQ ID NO: 12244 - protein, 231 aa, Zea mays
MASSSDPWMKEYNEASRLADDISSMIADRGSLPQSGPEIMRHTSAIRRKITILGTRLDSLESLFGRIPPKSITDKEMHKRQDMLSSLKSKAKQMATSFNMSNFANREDLLGQSKMPDDMSRVAGLDNQGIVGLQRQIMKEQDEGLEKLEETVLSTKHIALAVNEELTLHTRLIDDLEDHVDVTNSRLQRVQKRLAILNKRTKGGCSCTCLLLSVVAIVILAVIVWLLVKYL

SEQ ID NO: 12245 - protein, 374 aa, Bacteroides fragilis YCH46
MKKKVLFIDRDGTLVIEPPVDYQLDSLEKLEFYPKVFRNLGFIRSKLDFEFVMVTNQDGLGTSSFPEETFWPAHNLMLKTLAGEGITFDDILIDRSMPEDCASTRKPRTGMLTKYISNPEYDLEGSFVIGDRPTDVELAKNIGCRAIYLQESIDLLKEKGLETYCALATTDWDRVAEFLFAGERRAEIRRTTKETDILVALNLDGKGTCDISTGLGFFDHMLEQIGKHSGMDLTIRVKGDLEVDEHHTIEDTAIALGECIYQALGSKRGIERYGYALPMDDCLCRVCLDFGGRPWLVWDAEFKREKIGEMPTEMFLHFFKSLSDAAKMNLNIKAEGQNEHHKIEGIFKALARALKMALKRDIYHFELPSSKGVL

SEQ ID NO: 12246 - protein, 457 aa, Helicobacter hepaticus ATCC 51449
MRTQWVQQRADDKIRTQLHYAKKGIITKEMEYVANIENISAELIRQEIERGRLIIPANINHTNLKPMGIGIATRTKINSNIGSSSLASSIDEEVEKVKVSIKYGADTIMDLSTGGDLDEIRTAVIQASSVPIGTVPIYQILYDVKNDILQLDIDTMLSVLKKQAKQGVSYFTIHCGFLLSHMPFVAKRKMGIVSRGGSLMASWMMHYHKENPFYEYFDEILKICQEYDVSLSLGDSLRPGCLADASDEAQFAELKVLGELAKRAWKADVQVMIEGPGHVPLNQIERNVELQKQYCNHAPFYVLGPLVTDIAAGYDHIASAIGACVAAWKGVAMLCYVTPKEHLGLPNAKDVREGILAYKIAAHAADIARGRIGARDRDDAMSDARYSFDWNRQFELALDPDRAREYHDEALPQEVFKDAEFCSMCGPKFCSYKISQDIFKAHNAKESEDTQPLASNQ

SEQ ID NO: 12247 - protein, 525 aa, Graphium sp. ATCC 58400
MMDPFYLLGGCCVFGIVYKSVATLYVNYVHGKTARELGCKPLPKERTRFFGLDILRREMKADREMYLPSDIMTRFEEVGATTYEYQMLNEKHIATCDPLVIQTVLATQFKEFTFGNRPWGTVLGNGIFSIDNIGDNKEWLHTRAMLKPQFLRNQVSDLELEEGHVRNFMSVLKVGDDGWTPKVNLQHMFFNFTLDSATEFLFGKSADCQLLFAPGGDPKGVSKPLRAFLKALDVAKETVNTKWFLGNNGWIADSPTFRKNCAYVNDFMDALIAKTKAELEAKPKGSKPSGGREKYHFLHAMLDETDDKVELRGQALNILLAGRETTASLLGWLWYYLARHPIEFQKLRAAVLKDFGTAENPKPMSFESLKACDQLQYCNNEILRLFPLVSYNSRMALTDTTLPRGGGPDGNSPIFVKKGQQIVYHPHAMHRRKDIWGQDADEFRPDRWKTLRPGWEYIPFNGGGRICMGQQFALTEASYLTVRLLQRFDRIENLDPNPVLKQKFRIVNTPGEGVLVRLHEAAAGA

SEQ ID NO: 12248 - protein, 303 aa, Ashbya gossypii ATCC 10895
MSVILASAGYDHTIRFWEALTGVCSRTIQHADSQVNRLEITSDKRYLAAAGHLHVRMYDIRTTNPNPVTSFEGHRGNVTSIAFQQDNKWMVSSSEDGTIKVWDVRSPSVQRNYKHDAPVNEVVIHPNQGELISCDQDGNIKIWDLGENQCTNQLALEDNTALQSLSIASDGSMLVAGNNKGNCYVWKMPNHTDTASLKPVTKFRSHSKYITRVLLSVDVKHLATCSADHTARVWSVEDNFQLETTLDAHSRWVWDCAFSADSAYLVTACSDHYVRLWDLSTREIVRQYGGHHKGAVCVALNDV

SEQ ID NO: 12249 - protein, 407 aa, Streptomyces avermitilis MA-4680
MAAEIVNPRSDSSTDQEGGAEPLDSFDPAFALHRGGKMAVQATVPIRDRDDLSLAYTPGVAKVCTAIAEQPELVHDYTWKSSVVAVVTDGTAVLGLGDIGPEASLPVMEGKAILFKQFGGVDAVPIALGTTDADEIVETVVRLAPSFGGVNLEDISAPRCFEIERKLQERLDIPVFHDDQHGTAVVTLAALRNAAKLTGRTLGELRAVISGAGAAGVAIAKFLLAAGLGDVAVADRKGVVSKDRDDLTPVKRELAEITNKAGLSGSLESALAGADVFIGVSGGTVPEPAVASMAEGAFVFAMANPNPEVHPEIAHKYASVVATGRSDFPNQINNVLAFPGIFAGALQVRASRITEGMKIAAADALADVVGDDLAADYVIPSPFDERVAPAVTAAVAAAARAEGVARR

SEQ ID NO: 12250 - protein, 548 aa, Propionibacterium acnes KPA171202
MSRKPEPMTNPITNRGTAFTRAERLEHGMIGRLPAAVETLEQQAQRCYRQLQGLGCNIDRYVFLEELQNRNETLYYKLLVDHLVELLPVIYDPTVGEAIKKWSHAYRRSRAVYLSVDHIEDVRPSFETLELGPDDVDLLVVSDSEQILGIGDWGVNGTDISIGKLAVYTAAAGIRPERTIAVNLDVGTDNAYLLNDPSYLGNRHARVRGERYDELIHEYLEVASELYPHALLHFEDFGASNARRILVQNAANHRIFNDDMQGTAAIVLAAVISGLKVTRQSFADQRLIVYGAGTAGTGIADQIRAAMISDGLSQQEAVDRIWLVDRNGLVTDDMKGLPDYQEPYAKPVEKTRHWAHTNRHIGLTETIRRIHPTILIGTSTDHDAFTQQVVEEMCREVERPIIMPLSNPTEKIEAMPADVIAWSKGKALVSVGIPVAPFHYEGTRYEIGQGNNALLYPGLGLGVIVSGAERVSARMIRAAAEAVASQVDPRPAGSSLLPAVENLRASSATVAVAVVQAAIEEGLATKKPSNVVQAVQDAMWWPHYPPVG

SEQ ID NO: 12251 - protein, 729 aa, Pisum sativum
MAVSTISLYASPPSSVCSAPHQISPHASYDFDFGSRSSSPASTATATASTSAKPMIGGLSCLFSSSVAMKHVPLASSFSGGDEDELKELGSSFSYSPSKFGGSWKRDYQNQIQSPVSVFQCPVSCGSSMGTVRSSRSSAGGFFEGFVRRALGSSCLEYDSTGVRLRRGGGGGGEFDGGSSSALVDELTFNLEDTFIEGCFGFEFEPYAKKLLMSAQLRHKIFCEEFVIKAFCEAEKAHRGQMRASGDPYLQHCLETAVLLALIGANSTVVAAGLLHDTLDDAFLTYDYIFGMFGAGVADLVGGVSKLSHLSKLARDNNTASKSVEADRLHTMFLAMADARAVLIKLADRLHNMMTLDALPVAKQQRFAKETLEIFAPLANRLGIANWKEQLENLCFKHLNPVQHMELSSKLVESYDDAMIASAINRLEQALKDEGISYHVISGRHKSLYSIYCKMLKKKLTIDDIHDIYGLRLIVEKEEDCYKALKVVHQLWLEVPGKLKDYIRGPKFNGYQSLHTVVMGEGKIPLEVQVRTKDMHSQAEFGFAAHWRYKEDHCQLSSYVLQMVEWARWVVTWQCEAMSKDSTSVGCVDSIKPYCKFPSHADNCPYSYKPDCAQDGPVFVIMIENDKMSVQEFCANSTVLDLLERAGRASCRLTTYRFPLKEELRPRLNHKPVSDPNCKLKMGDVVELTPAIPDKYLTEYREEIQRMYDRGLTVSKMGTTTASSMVGTS

SEQ ID NO: 12252 - protein, 945 aa, Nicotiana tabacum
MKLKKLQFGGSVRLLVLLLYVVSSVYSQEGSAANDAAVMQELKKRINPPSSLGWNDPDPCKWGKVQCTKDGRVTRIQIGNQGLKGSLPPNLNNLTELLVFEVQNNGLTGSLPSFSGLDSLQSLLLNNNGFTSIPTDFFDGLTSLQSVYLDKNQFSPWSIPESLKSATSIQTFSAVSANITGTIPDFFDAFASLTNLHLSFNNLGGSLPSSFSGSQIQSLWLNGLKGRLNGSIAVIQNMTQLTRTSGCKANAFSSPLPDFSGLSQLQNCSLRDNSLTGPVPNSLVNLPSLKVVVLTNNFLQGPTPKFPSSVQVDMLADTNSFCLSQPGVPCDSRVNTLLAVAKDVGYPREFAENWKGNDPCSPWMGITCDGGNITVLNFQKMGLTGTISPNYSSITSLQKLILANNNLIGTIPNELALLPNLRELDVSNNQLYGKIPPFKSNVLLKTQGNVNIGKDNPPPPAPGTPSGSTPGSSDGSGGGQTHANSGKKSSTGVVVGSVIGGVCAAVVLAGLFVFCLYRTKRKRSGRVQSPHTVVIHPHHSGSDQDAVKITIAGSSVNGGDSCGSSSAPGDLHIVEAGNMVISIQVLRDVTNNFSEVNILGRGGFGTVYKGELHDGTKMAVKRMESGVMSEKGLDEFKSEIAVLTKVRHRHLVTLLGYCLDGNERLLVYEYMPQGTLSRYLFNWKEEGLKPLEWTRRLTIALDVARGVEYLHGLAQQSFIHRDLKPSNILLGDDMRAKVADFGLVRLAPDPKASVVTRLAGTFGYLAPEYAVTGRVTTKIDVFSFGVILMELITGRKALDESQPEESMHLVPWFRRMHINKETFRKAIDPTVDLDEETLSSVSTVAELAGHSCAREPHQRPDMGHAVNVLSSLAELWKPAEVDEDEIYGIDYDMSLPQAVKKWQALEGMSGIDGSSSYLASSDNTQTSIPTRPSGFADSFTSADGR

SEQ ID NO: 12253 - protein, 388 aa, Coccidioides immitis RS
MASPRHASRRLLGSLGSCRAYSSQAAPGARLNLPVDYKSTPLLHHASSTLSNNPELPQNASTKRLNLYQSINSALRTALAADERVLLFGEDVAFGGVFRCSVDLQTEFGSERVFNTPLTEQGIVGFGIGAAAEGFKPVAEIQFADYVFPAFDQLVNEAAKFRFREGATGGNIGGLVVRMPCGAVGHGALYHSQSPESLFTHVPGLRVVIPRSPTQAKGLLLNAILNCKDPVVFMEPKILYRAAVEYVPTEPYYLPLDKADIVKPGKDLTVISYGQPMYLCSDAIAKAEKDFGASIELIDLRAIYPWDRETVLESVRKTGRAIVVHESMMNAGVGAEVAATIQEGAFLRLEAPVKRVTGWGTHCGLIFEKFNLPDVARIYDAIKQTLHY

SEQ ID NO: 12254 - protein, 318 aa, Triticum aestivum
MAASCTLTVPALFAASSSSSSTSARRYRRFGVVAMASAGQKVYAPGVAVSEGNGGLPKISLKSPHGSEAEIYLFGACVTSWKVPSGKDLLFVRPDAVFNGQKPISGGIPHCFPQFGPGPMQQHGFARNVNWSITDSEVTEGDPTVTLELKDDSYSRSMWDFSFQALYKVVLHSTSLSTTLKIINTDDKPFSFNSALHTYFSASIAGVSVKGLEGSKTLNKDPDPKNPLEGKEERDEVTFPGFVDCVYLGAPSELTLDNGLGDKIVISNTNWSDAVLWNPHLQMEACYKDFVCVENAKIETVQLGPKESWVAEQKIELV

SEQ ID NO: 12255 - protein, 212 aa, Helicobacter hepaticus ATCC 51449
MKLHNDYRLLTPRINRDKQSFLARVIITLKTSFSLDLFSGLKTALGAFFSPKVTIHYPLESAPLSPRYRAIHKLQRLLESENERCIGCGLCEKICTSNCIRIITDKGEDGRKKILNYSINFGRCIYCGLCAEVCPELAIVHGDLVENASTQRAFFGFKPQLLEHKSSLLEFGGFGSISVNADERVKTTPLSYCTQDSQNMLSESAPQENTNV

SEQ ID NO: 12256 - protein, 494 aa, Klebsiella aerogenes
MSEITLLAEVTAFLRQPHGQFIAGQREAGRGAPFAVINPATGRAIAEVTAADSDQADRAMESARQALSQWREMPTLARGALLLKLADTLAEHREALAQLESLCSGKTITLVRMLELDQSVALLRYFAGWAGKVTGETLDVSLPSMAGEKYTAFTRRQPLGVVVGIVPWNFSIMIAIWKLAAALVCGCTIVLKPSEYTPLTLLRVAELAKAVGIPDGVINVVNGAGGEIAQRLITHPACAKVSFTGSVATGEKVQQSASASGKRVTLELGGKYAALFLDDLTPEAMVNGIIEAGYLNQGQICAAAERFYLPQGKLDAVLALLKDKLSAFAPGSPLDERTLMGPLANRQQYDKVLRLIQTARDEGDTIVCGGEALPGEGYFLQPTAVKVRSEESTLMREETFGPVCSFIGYRSEEEALARINASPYGLAASVWSDNIRQALRYSEAIEAGIVWVNMHTFLDPAVPFGGMKGSGIGREFGSAFIDDYTELKSVMVRY

SEQ ID NO: 12257 - protein, 334 aa, Streptomyces avermitilis MA-4680
MTVRVGINGFGRIGRNVFRAAATRGADLEIVAVNDLGDVATMAHLLAYDSILGRFPEEVTAEPGAIRAGDTTVKVLAERDPAALPWGDLGVDVVIESTGIFTDAAKARAHVDGGAKKVIIAAPASNEDVTVVLGVNQDAYDPERHTIISNASCTTNCLGVLAKVLHDAVGIESGMMTTVHAYTQDQNLQDAPHKDLRRARAAGLNIVPTSSGAAKAIGLVLPELQGRLDAFALRVPVPTGSVTDLTVTASRSTTVEEVKEAYAKAAAGAYKGLLSYTEAPIVSTDIAGDPASCVFDAELTRVLGSQVKVVGWYDNEWGYSNRLIDLALLVGDTL

SEQ ID NO: 12258 - protein, 477 aa, Ashbya gossypii ATCC 10895
MSSMMKLGSATRSHLVRSLARNTFARVGGASACRAYSNGEKSLKERFAEIFPAKAEEIKQFKKQHGKVVIGEVLLEQAYGGMRGIPGVVWEGSVLDPHEGIRFRGRTIPEVQKELPKAPNGREPLPEALFWLLLTGEVPTETQTKALSADLMSRSELPGHVEQLLDSLPRDLHPMAQFSVAVTALESESKFAKAYAQGVSKKDYWNYTFEDSLDLLGKLPVIASKIYRNVFKDGKMGKIDVDADYGKNLGHLLGFENPEFVELMRLYLTVHSDHEGGNVSAHTTHLVGSALSSPYLAFAAGMNGLAGPLHGRANQEVLEWLFKLREEVKGDYSPETIRQYLWDTLKGGRVIPGYGHAVLRKTDPRYTAQREFALRHFPDYDLFKLVSTVYEIAPKVLTEHGKTKNPWPNVDSHSGVLLQYYGLTEASFYTVLFGVSRAFGVLPQLIIDRAVGAPIERPKSFSTEKFKELVASKASKA

SEQ ID NO: 12259 - protein, 204 aa, Bacillus sp. TB-90
MEPIRIGIGGPVGAGKTMLVEKLTRAMHKELSIAVVTNDIYTKEDAQFLLKHGVLPADRVIGVETGGCPHTAIREDASMNFPAIDELKERHPDLELIFIESGGDNLAATFSPELVDFSIYIIDVAQGEKIPRKGGQGMIKSVLFIINKIDLAPYVGASLEVMERDTLAARGDKPYIFTNLKDEIGLAEVLEWIKTNALLYGLES

SEQ ID NO: 12260 - protein, 409 aa, Helicobacter hepaticus ATCC 51449
MKQNYTKLKPNFENIFFEQENDKMILNFGPQHPSAHGQLRLILELENEKIIKATPDIGYLHRGIEKMAENMIYNEFMPTTDRLDYIAATSNNYAFALGVEKLIGVDIPLRAQVIRTMLLEINRIISHIFLLGVQGMDVGALSIFLYCFIEREYGLDLMEDYCGARLTHNAIRIGGVPLDLPHNFLESVEKFTHSVPKTLDLVRGLLDKNRIWRIRLENVGYISQDFAKQWSLSGIMARGSGIKWDIRKHNPYELYSELDFEVPIATEGDCYARYQLYIEEIYESLKIIKQLIAMYPSTPKEIMAKDARYISAPKEDIMTQNYSLMQHFVLVTQGMRPPVGEVYVPTESPKGELGFFINSQGAPSPHRLKIRTPSFYHIGVLQELLIGHYFADIPAILASTNVVFGEIDR

SEQ ID NO: 12261 - protein, 228 aa, Bacillus sp. TB-90
MDQVDLLSILTLGFVLGIKHAMEPDHVIAVSTIVCQSKKLWRSSLAGVFWGIGHTSTLLIFGMTIILMKKKISQEWSMSLEFLVGIILVYFGISAILSLKKTHEHSHSRLHLHTDHPIYTYKGIPYVKSLFIGIIHGLAGSAAMVLLTMSTVEKAWEGLLYILFFGAGTVLGMLSFTTLIGIPFTLSARKIRIHNAFIQITGFISTVFGIHYMYNLGVTEGLFKLWIR

SEQ ID NO: 12262 - protein, 276 aa, Glycine max
  misc_feature (98)..(98): Xaa can be any naturally occurring amino acid
MDSQVAVALALSLVGGVSTSIGALFVIVNKAPSLKMLGLLQGFAAGLMLSISFFDLAHNALNSLGFLKGNLWFFAGVIFFAVVASFIPEPTLTPTSDXGQKDKNGDEGGKDIMKKHRRQVLFSGIVTAVGISLHNFPEGMAVFLGSLKGLRVGINLALAIALHNIPEGVAVALPVYFATQSKWQAFKLASLSGFAEPLGVIIVAYLFPSSLSPEILEGLLGSVGGVMAFLTLHEMLPLAFDYAGQKQSVKAVFLGMAFMSASLYFLSISLPEDLSL

SEQ ID NO: 12263 - protein, 447 aa, Ustilago maydis 521
MLQVRNDYFGSDSPLSGPSSGEASPSTSAMLSPGSSSVATSQLSLLALSSERNSPSTSACTSVSDLSSEADKLSLSDPKTGRTTEIAHFTQANVRASAVEEPESTTEDSEAAAVEAENRRVEEELDSALAFGTQIVQREARALAMAARRLSKHSVQQDGFRQAVRLVMRATTGERGGKVVLTGVGKSGIIAKKLSATFLSLGTPSMFLHPTEALHGDLGLLTPHRDVVIALSHSGSSPEILTLVPHLNARRCPIIALVGKRDSALVKASDAWIDCATGKDDLDTEDEEDAEQAVASDRSGNVEVGSNSADGQLARRSASEPAARAAAHQSQFMPEARRGTVPQCDSCDCGKQMSRLKARRNKAPQPNTDEAWDDVPAPSSSTTVALAMGDALAFSVTRAKGLGRDMFAFNHPGGKLGADFRLQGQSAPLQSYDPKGTESAVATPIAA

SEQ ID NO: 12264 - protein, 368 aa, Glycine max
  misc_feature (260)..(260): Xaa can be any naturally occurring amino acid
  misc_feature (300)..(300): Xaa can be any naturally occurring amino acid
  misc_feature (329)..(329): Xaa can be any naturally occurring amino acid
  misc_feature (344)..(344): Xaa can be any naturally occurring amino acid
MEVVEKEKYITSEELKGHNKEGDLWISIQGKVYNVSDWVKEHPGGDVPISNLAGQDVTDAFIAYHPGTAWSHLEKFFTGYHLSDFKVSEVSKDYRKLASEFSKLGLFDTKGHVTSCTLASVAVMFLIVLYGVLRCTSVWAHLGSGMLLGLLWMQSAYVGHDSGHYVVMTTKRSNNVAQILSGNCLTGISIAWWKWTHDAHHIACNILDHDPDLQHMPVFAVSSRFFNSITSHFYGRKLEFDFIARFLICYQHFTFYPVMXVARVNLYLQTILLLFLRRKVQDRTLNIMGILEFWTWFSLXVSCLSNWSERVMSELASLADGSIHHIHSXWNCYDADVFVGPPEXNVLFETYISGISDVTSAYLMDWYF

SEQ ID NO: 12265 - protein, 307 aa, Mycobacterium avium 104
MAVGDTDPVPNNDVHPDLQRFARFAPRRLVGPRTLPLMRVALAWRGRLGKPVRDVEVITLGSGVGVRLFRPAGAAETTPALLWIHGGGYVLGTAQQDDQLCSRFSRRLGITVASVDYRLAPEHRYPVPLEDCYTALTWLAGLPSVDRYRIAIGGASAGGGLAAALALLARDRAEVSPAFQLLTYPMLDDRSSDTAPSPNYRLWDNRSNRFGWAAYLGDADPHVAVPARRDDLSGLPPAWIGVGTHDLFHDEDLAYAERLRAAGVPCQVETIPGAFHGFDLILPKVQVSQRFFDSQCNSLRAALTPAG

SEQ ID NO: 12266 - protein, 758 aa, Coccidioides immitis RS
MSSNHHAVRRYFGLGLIKLLLPLLARLPIVTGLPIFSPALATQEDGEPVNQPSFWLYLGVATALVVAGGAFAGLTIALMGQDEIYLQVIKTSGEGAEKRHAEKVLNLLKKGKHWVLVTLLLSNVITNETLPIVLDRSLGGGWPAVLGSTALIVVFGEVVPQSICVRYGLPIGAWMAPCVLILMYIMSPVAWPIAKLLDKLLGVDHRTLYKKAGLKTLVTLHKTLGSAGEQLNSDEVTIISAVLDLKEKPVGSIMIPMEDVFTMSTETVLDEKMMDLILSQGYSRIPIHSPDNPQNFVGMLLVKMLITYDPEDCKQVRDFALATLPETRAETSCLDIVNFFQEGKSHMVLVSEFPGEDHGALGVVTLEDVIEELIGEEIIDESDVFIDVHKAIRRMAPAPKARVPKGQIVTDPPDNLGALQNGDSEAASTGHKGPDASSSGTGDLQASRRKGSIGDIGSPPPPIFKLRKSSTHDAVEGPDAAIIQRGATPEIREHLKHLGPSNLASRPRQTRYNNVKIKPGSSSPLVSAVDSRLQSPDPQRRMSEVTSFSGNTGPGGGVKSAGKSASDAVLALRRYGSTTEAPSRRSITRDTVPTMNRDIINVRSDLLQPAPHRPSYRQGCLSPSEAPTLSAGGTTNSSPLSPPYLAHGPARSGSITEQVVDSNGIRKVILQTSDTHPASGEEGQGHSRQPSATQTKPVPPHAAVEHNSDDEDGQNEADISQSSTKQDKTKKKRRRKKRKPASSKSGDGAVDERQPLLG

SEQ ID NO: 12267 - protein, 264 aa, Propionibacterium acnes KPA171202
MNDMEATRDERPWALVSGASGGLGQAFSRHLASCGVNLVVTGRRHDVLDDLADQLTTRYGIQTIVHPCDISSASERLALVNEIAGRGIIIDTLVNNAGFGAAGRIAETDPERQTSQVEVNCEAVVHLCGLLLPGMITAKRGSIINVASTAAFQPIPQFATYAASKSFVLSFTRALWAETNGTGVRATAICPGPTETGFFDVAGVPRMAAGARRDPDDVVRTAFDALARHRPYAVDGFVNRTVARLAPHLPARLVMTQAEKYLQV

SEQ ID NO: 12268 - protein, 358 aa, Pseudomonas fluorescens PfO-1
MRWRYLVLLLIIGVLAFLLLMPTKVKPVAWTPQPAPSLTEGQYADNQRLKGAAQVGPSDIEGPEALLLENDFLITGLHDGRLLRTSLDGQQRKVLADTGGRPLGLARHPNGLLVIADGVKGLLSLDEQGRLVALTTEANGLPFGFTDDVAIDKSGHYAYFSDASSRWGYGHDGEAIIEHGGDGRLLRYDFQTGKTSLLLDKLEFANGVTLGPEDAYVLVNETGAYRISRYWLTGPRAGTHDLFIDNLPGLPDNLAFNGRDRFWVALYTPRNPLLDSTAGHPFVRKMIVRAMTVLPKPVEKRGFVLGLDLEGKVIANLQDASAGNYSPITTAREYGQWLYFGSLKATHMARMPLEAALK

SEQ ID NO: 12269 - protein, 171 aa, Glycine max
MGGEVLTMADVTANLQAATTASTPYALPTNLPLLSAFLSFALAQFLKIFTSWYKEKRWDSKRLLDSGGMPSSHSATVSALAVAICLQEGAGSPAFAIAVVLACIVMYDATGVRLHAGRQAELLNQIVCELPPEHPCSNVRPLRDSLGHTPLQVVAGGTLGCIIAFLMRRSS

SEQ ID NO: 12270 - protein, 230 aa, Zea mays
MCPIKRETTSAESGSPCSSSTSTSSSSEHHQTAWASPPKKRPAGRTKFRETRHPVFRGVRRRGRAGRWVCEVRVPGRRGCRLWLGTFDTAEAAARAHDAAMLAVAAGAARLNFADSAWLLAVPTASYASLADVRRAVAEAVESFLRRREEEEGDALSAASSTSPNDKDGDESSSATTTDDDSPFELDMFGGMSWDLYYANLAQAMLVEPPPIVPALCDDGVASELPLWSY

SEQ ID NO: 12271 - protein, 175 aa, Aggregatibacter actinomycetemcomitans
ALRNRANTPVLVDGKDVMPEVNAVLAKMKSFCERVISGEWKGYTGKAITDVINIGIGGSDLGPYMVTEALRPYKNHLTMHFVSNVDGTHIAETLKKVNPETTLVLVASKTFTTQETMTNANSARDWFLATAKDEKHVAKHFAALSTNAKEVEKFGIDTDNMFGFWDWVGGRYSLW

SEQ ID NO: 12272 - protein, 387 aa, Haloarcula marismortui ATCC 43049
MSMNAVVYKGPKEVAVEEVDEPEIEHPNDVLIDITTSCICGSDLHMYEGRTAAEPGIVFGHENMGIVTEVGEAVSSLEEGDRVVAPFNVACGFCENCEAGYTGFCTNVNPGFAGGAYGYVAMGPYKGGQAEKLRIPYADFNALKLPDGDEHEDAFSLLADIFPTGWHGTELANLEPGDSVAIYGAGPVGLMAAYSAKIKGAAEIYSVDRVPSRLELAEEHCDATPINFEDGNPVEQIKAQHGGGVDKGVDAVGYQAIDPDKEADDAYDPARENPAVVINNLIRTVKPTGELGIPGLYVPEDPGAPDDMAAQGRLGIDFGLLFEKGQALGTGQCNVKSYNRELRDLIVEGRADPSWVVSHRVGLEEAPEMYEAFDNREEGVTKVLLEP

SEQ ID NO: 12273 - protein, 175 aa, Aggregatibacter actinomycetemcomitans
ALRNRANTPVLMDGKDVMPEVNAVLAKMKSFCERVISGEWKGYTGKAITDVINIGIGGSDLGPYMVTEALRPYKNHLTMHFVSNVDGTHIAETLKKVNPETTLVLVASKTFTTQETMTNANSARDWFLATAKDEKHVAKHFAALSTNAKEVEKFGIDTDNMFGFWDWVGGRYSLW

SEQ ID NO: 12274 - protein, 1103 aa, Haloarcula marismortui ATCC 43049
MSTDKSIPRVPDLHDPQPETPVTHEFETGTANDPDVGTDTDDPTTLTVDGERVTVAPGSTIIDALQDLDDDIVSVDPGAEGVEDDADVPALCYYDRDGDCSDEVGPRSECRTCMVETEEHGLVPSCSFPAEDGLSVSTDTPDAEEARSVNLDLVLSNHNLRCTTCNGNGRCELQDAAISEGVDHPRYGVFDERDQYEPIDDTSSFIQIDRNKCILCNRCVDACNDVQVEGVLRIEGHGEDTRIGFQSDAETMHDSECVSCGHCATVCPTGSLTEKGIDGAATLPLPGFTQRNSIGKVIEHEDAETIDDTTAPNRGFEPGDPRAAKSKQGLAKFASQAKRRAGDIAKDYGKKAFLAGEHTAESIAANTMPEGRLFDIADIVSDYRLSKIDKEETTCGFCAVGCRFEMWGKDGDSLGVVPVDDPDDAPANNFSTCVKGKFGHEFANSEQRVTEPLIRNDDGELEPTTWDEALEYVAERFTEIQDAHGIDSLGCLASSKGSNEEAYLVQKFARQVLGTKNIDNCARLCHSSTVAALQQTLGYGAMTNRINEDIGEADAYLISGSNTTESHPVLATRIKQNVRDGADLVVFDPRKVGIAEHADQYTRTNPGYDVAWLNGLIRYIIEHDLHDEAFIERNTKNFEEVREKVQAFTPEKVKELAGVSPEELASAAETLAEADTVVFGWAMGMTQQSHGTENLIAMADLALVLGQVGKPGAGLSPFRGQNNVQGGGGDMGTLPGSLPGYQNPADDEVGEKFADAWGERPPKEPGLKVPEMLAEAHAGNLRGMYVVGENPALSEPDIQHAAEALEDLEFLVVQDIFMTETAEYADVVLPAATSPEKHGTFTNTERRIQRVRPTSEPPGKARQDWEITQALARRLGYDWDYDHPREVMDEINSLAPIYGGVTYDRLESGEEHGLQWPCWDEDHDGTPYLYDYDEGNFNFEDGKARFVPADGGHPGEIPDEEFPLTLTSGRVLYHWHTGQITRRVEGLMSHVGESFVEVHPETAEKLGIADGEYVRVESRRGDIVVKAQVTDRVGPGTLFIPMHFAAGAVNKLTGETFDPTAGIPEYKVSSVRVEVLGPETDETVLRTPDAGGKQIRKRGTGDD

SEQ ID NO: 12275 - protein, 449 aa, Streptomyces avermitilis MA-4680
MSQHTFVAGTAPGAVPVVGHAWQMMRRPLHFMSSLSAHGDLVKIRIGPTSAYVPCHPELLRQVLTNDRVFDKGGVFYDRARDIAGNGLVTCPYRDHRRQRRLMQSAFQRTQLERYSTAMRAEIDATAARWHDGTVIDAFPELYGMALRTVARTLYSTPVTEELAQRVEQAFDTVLNGLFRQMFLPHSLRRLPTPANLRYRNNLRFLHDTVQDLITEYRRDDTQRDDLLSALLASRDEDGGRLGDTEIHDQVITVMAAGTETVAGTLTWIFHLLSRHPEIEARLYEEIDTVLDGKPPHWDDLPSLSLTDRIITEALRMYPPAWIFTRLTASDVDLAGVRLPEGTTIVFSPSSVQRHSEAYDDASRFDPDRWLPDRTSAVARQAFTAFGTGARKCIGDLFARTEATLALATMLSQWRVTVEPDADVRPVALATVYHPRRLRLRLTARTPGQ

SEQ ID NO: 12276 - protein, 1099 aa, Caulobacter crescentus CB15
MPKRTDISSILIIGAGPIVIGQACEFDYSGVQACKALRAEGYRIILVNSNPATIMTDPDVADATYIEPITPEMVAKIIEKERPDALLPTMGGQTALNTALALEADGTLAKFGVEMIGAKAEVIDKAEDRQKFRDAMDKLGLESPRSRACHTLDEAMEGLEFVGLPAIIRPSFTLAGTGGGIAYNVEEFKEIVERGLDLSPTTEVLVEESVLGWKEYEMEVVRDKADNCIIVCSIENIDPMGVHTGDSITVAPALTLTDKEYQWMRAASIAVLREIGVETGGSNVQFAVNPADGRMVVIEMNPRVSRSSALASKATGFPIAKVAARLAVGYTLDELKNDITGGATPASFEPSIDYVVTKIPRFAFEKYPGSEPLLTTAMKSVGEVMAIGRTFKESVQKALRGLETGLSGFDEVEIAGADDPDNGKEAVIRALGVPTPDRLRVIAQAFRHGLTVDEVNAACSYEPWFLRQIAEIVRQEGWVKAGGLPQTAQGFRELKAQGFSDARLAKLTASTEKAVRAARQALNVRPVFKRIDSCAGEFLASTPYMYSTYEFGALGQIPQCESDPSAAKKAVILGGGPNRIGQGIEFDYCCCHAAFALDQIGVESIMVNCNPETVSTDYDTSDRLYFEPLTAEDVLELLHVEMSKGTLAGVIVQFGGQTPLKLAHALEEAGVPILGTSPDAIDLAEDRERFQQLLNGLNIAQPENAIARSWDEARAEGDKIGFPFVMRPSYVLGGRGMEIIRDHEAMERYIAGAGEISLEHPILLDHYLSRATEVDVDALCDGKDVFVAGVLEHIEEAGVHSGDSACSMPPFSLKAETVEELKRQTVQMALALNVRGLMNVQFAIEEPHSDNPRIYVLEVNPRASRTVPFVAKTIGQPVAAIAAKIMAGESLASFGLKDVPYDHIAVKEAVFPFARFAGVDTVLGPEMRSTGEVMGLDWKRDGETGMGPAFARAFAKSQLGGGVKLPTKGTAFVSVKESDKPWIVEPVKLLQAAGFKVLSTEGTQAYLAAQGVQVEHVKKVLEGRPHIVDVMKNGGVQLVFNTTEGKQALEDSFEIRRTALMMKVPYYTTSAGALAAAQAIAGAPAEALDVRPLQSYAAE

SEQ ID NO: 12277 - protein, 397 aa, Ralstonia metallidurans CH34
MDLTHVTRYIAGRDTREPVCAYLYDLDDLRLRTTRLRAALPEQCALYYAVKANSDAPVLRALLGVADGFEVASFGEIERVRGVDAEVPIAFGGPGKTDAELEGALRLGVGLIHVESTLQLSRLDAVARRQGRCADVLLRANPAYGLPGATLQMGGGATQFGIDEALLPDVLAQSRTMPNVRVVGLHVHAGSNSLDADTHLALIDRHIALAKRLRDLHGLTLEWLNVGGGIGIDYQNPERHFDWDRFCHGLAALLRETAPSTRIVFECGRFISAGCGCYVAEVIDLKRNHDKWFAVLRGGTHHFRLPVSWQHNHPFQVLPNDHWDYPFPRPVVERQPVTLCGELCTPKDVLAREVPVDRLRVGDRIAFTMAGAYGWHISHHDFLSHPHPERVFIGGQP

SEQ ID NO: 12278 - protein, 108 aa, Glycine max
TLKFLNTPCYPLKSIGIVGLSPQILTQALQWACRPNPSSYLHILTRDTADPSYLRSLCTRTGLLLNCVGPLQLHGEPVVDDCSAADCYYLDIFCEPEFIERVEAEHHK

SEQ ID NO: 12279 - protein, 188 aa, Zea mays
MAAAAASTPQGVAERRGIPAAAFVEDVEAYLRQVGLDVNSALAFLQERLQQYKIVEMKLLAQQRDLQAKIPDIEKCLDIVTTLQAKKDLGEALIADFELSEGIYSRAKIEDTDSVCLWLGANVMLEYSCDEANALLKKNLENAKASLEVLVADLHFLRDQQTITQVTIARVFNWDVHHRRSKQAVKET

SEQ ID NO: 12280 - protein, 596 aa, Mycobacterium avium 104
MAFSVQMPALGESVTEGTVTRWLKQEGDTVELDEPLVEVSTDKVDTEIPSPAAGVLTKIIAQEDDTVEVGGELAVIGDAADDAAAGGGAQAPSQPSQPQAPAQPEPQAQAQPEAPAQPQAPAQPAPQESGGGAATPVLMPELGESVTEGTVTRWLKKVGDSVQVDDALVEVSTDKVDTEIPSPVAGVLISITAEEDSTVPVGGELARIGTGAQAPAPAAPQPPPAPKPEPKPEPAPQPQAQPAPQPQPQPQAQPAPEPKAQPAQAQPAQAQPAAGGEGTPYVTPLVRKLAAENNIDLSSITGTGVGGRIRKQDVLAAAEQKQRQQQAAAQPSAAPAPAAAEARKPAAPTPAPALAHLRGTTQKASRIRQITAAKTRESLLATAQLTQTHEVDMTRLVGLRARAKAAFAEREGVNLTFLPFIARAVIDALKIHPNINASYNEETKEITYYDAEHLGFAVDTEQGLLSPVVHNAGDLSLAGLARAIADIAARARSGNLKPDELSGGTFTITNIGSQGALFDTPILVPPQAAMLGTGAIVKRPRVIVDEFGNESIGVRSVCYLPLTYDHRLIDGADAGRFLTTIKHRLEEGAFEADLGL

SEQ ID NO: 12281 - protein, 213 aa, Zea mays
MAAENPSNGVDVDTSLASDSNDNRKASDLTNHDSSMALTVPSTAVCLGRFAGDAAGGAVMGSIFGYGSGLFKKKGFKGSFADAGQSAKNFAILSGVHSLVVCLLKKLRGKDDAINVGIAGCCTGLALSYPGAPQAMLQSCVTFGAFSFILEGLNKRQTALAHSVSSRHDQTRSLKDDLPLSLALPIHEEIKGAFSSFCKSLTKPKKLAFPSSR

SEQ ID NO: 12282 - protein, 257 aa, Mycobacterium avium 104
MQVAIVTGASSGIGLGCATRLAGTGMAVLGTGRDPKRLAELETAIGDPDRVATVAVDLTDDDAPRRIVDRALQRWGHIDFLINNAGVGSPKPLHETDDETLDYFLNLMLRAPFRLAREVLPHLPPGSAIINVTSTFAVVGGLRGGAYSAAKGGLTALTTHIACQYGASGIRCNAVAPGVTVTPMVENRLQDPRFRKINTEMTPHQRLGSVDDIAATVAFLCSPGGSFINGQTIVVDGGWSSTKYLSEYALTSEWIAP

SEQ ID NO: 12283 - protein, 117 aa, Photorhabdus luminescens subsp. laumondii TTO1
MSNIIKQLEQEQMKQDVPSFRPGDSVEVKVWVVEGAKKRLQAFEGVVIAIRNRGLHSAFTVRKVSNGEGVERVFQTHSPVVDSINVKRRGAVRRAKLYYLRERSGKAARIKERLNSK

SEQ ID NO: 12284 - protein, 1091 aa, Arabidopsis thaliana
MMMSNLPKDLVEEILSRVPFKYLRAIRSTCKNWYDLSKNRSFANKNIDKAAVSGEKEFLMITQFNVFWVGVNLHRSQNNSFDLSIQLKAKIVSRDKKDDLFQKSQVIHCNGVFLCVREKMLVVLNPYWGQTKRIMPRPPFGCFDRYALGYDKSSGSHKILRLFGVNQNNLNIYDLSSSSWMIPDGTLERDMEYMKQGVSLNGDTYWYAKDKESIDWYLLCFDFTRERFGTPLPLPFSNEGYTLHKGYKSLSALKEEKLAVLLWDTMVIWVTNKIEPDAVSWSIFLKLDMEPSIYCRYGNFFIDEEKKVAVVFEKDSSSWSWMYNPNYNKAYIAGENENSFTLHFTKKRVDKGRASYTSILDSVQSSTCLSRRFLKLDLTYRCDVVSSLKLETTIIMMMMSNLPNDLVEEILSRVTVTFMRTVRSICKKWNALTKDRSFTNKYIRNIAALGEREFLMIKEFSIYLVGVNLHGIQNNNFDLSIELKGKLISMDNTIRRFCISQIFHCNGLFLCVSQKDMDNRLVVWNPYCSKPRWIKPSYNYRTVDRERFGPRLPLPFMNLDDVSLSVVKEEKLAMLLKRWDTCEVEIWVTDKIEPDVSWSKFLKVGIKPRFDFANFVVIDVVKKVALVFDKNKAEKFQYSYNIAYIIGEKASPEELSSHRERKKRVESCLKHEKASPQGFVIGFLPKRPHTSCRDCIQSQPYGQASKAHACGNLRSCQDRLYPTISPSNQRPRTWASFLRHILISNLPDELVEEILCRAPVTSLKAMRSTCKKWYVLTKDQRFAKKRGKEFLMIMNRRVYLIGVNLHNNIDLSIKCRGRLISRDETAQGFYVSQVFHCNGLLLSVSGKTIDDTRLVVCNPYGVKPKWINPKDNYGRLDIFSLGFDKLCGSYKILRIYDFDNKLQIYDLSSNSWMIPRDTLGRDIEYMQNGVSSKENTYWCARDKQSQYCFLFCFDFTRERFGPRLPLPFNGAYVSLSAVKEEQLAVLFQPSDKSEIEIWVTNKIEPEEVSWSVFLKVEMKLRVLSWNFLIDKEKKFAVVFDKDKAKGFKTNYDIAYVIGENGYYRRVDLRESPNKPLCRIVSCYVPSCVQIE

SEQ ID NO: 12285 - protein, 97 aa, Glycine max
  misc_feature (72)..(72): Xaa can be any naturally occurring amino acid
  misc_feature (86)..(86): Xaa can be any naturally occurring amino acid
MASSMISSPAVTTVIRAGAGMVARFTGLKSMAGFRSSKTINDITSIATNGGRVHCMQVWSPVGNKLFETLSXLPFLDDVQLAHELXYLLMNGWIPCL

SEQ ID NO: 12286 - protein, 560 aa, Coprinopsis cinerea okayama7#130
MPNSTIIPLRFSPVWLVRDMSVYNSILAALGSSVVYLFYKLYRRVTRISIAHVPGPEPESFWLGNLRELFQSQAGVPDFKYQREFGDVVRVKGALGEDRLFISDPKALQYIIHTSGYAYPKWPERTEISRVLMGRGLLWADGEIHKRQRKVMLPGFGVPESKSYVPIFRRVGAELTAQWSDILASSADQSAVLNVANWLSRTTMDSIGEAAFDYHFGALANQENEFMEAYLGLMSDTLGSPSTSAIFMQTVMPLWYLQLMSRFSRKRNLVHARHTAKLANAVAKELVNSKAEALLQGKGNKDILSLLVKANASENAETRLTEEEIYAQMRTILLAGHETSATTLCWVLLELARHPEVQEKLRKEIRDTERAIRARGGSDFTATDLDNMTYLHAVIKESMRFHPALYQNYRQAARDDVLPLSKPIVGPDGELTNKLPIPKGTKIILSIAAYNRNQEVFGEDAHEYNPERWLSDREKKGPTLGVYGNLLTFAGGIRTCIGWRFALYEVLSLTVEIISNFELAPSPDIQRLRREACLVMLPTLEGEELKGEQLPLKITLAARD

SEQ ID NO: 12287 - protein, 882 aa, Frankia sp. CcI3
MSSRSLVVVGHGMVGHRLLAALRDRDVEGRWDVTVLAEEPRPAYDRVGLSAYFTGATAEDLSLVEDGFLEHPRLRVRLGEPVVAVDRAARTVTTGAGRTYRYDALVLATGSYPFVPPVPGREATGCHVYRTIEDLDAISASARGSRTGTGVVVGGGLLGLEAANALRSLGLATHVVEFAPRLMPAQVDEAGGQTLRAHITGLGIGVHTDTATERIEADADGRVARMVFARHPEGLAGLDTDVVVFSAGIRPRDALARECGLDVGDRGGIVVDEGCRTSDEHIYAVGECALAAGRVYGLVAPGYAMAEVVADRLLGGDATFTGADMSTKLKLLGVDVASFGDAFGTTPGALPITFADPVAKVYKKLVLSDDARSVLGGILVGDAGEYGTLRAMVGSAGVVPDDPARLILPAGDVAGAGGSGAGVALSAGAQICSCNNVTHGQICAAISANGLTDVAGIKGCTNAGTSCGSCVPMLRTILGQQLAAAGLEVSKALCEHFDVSRAELFEIVRVRGITTFSQLIAEHGRGRGCEVCRPVVASILASLYNGYVLVGEQAALQDTNDHLLANMQKDGTYSVVPRLPGGEVTPETLILIGEVARDFNLYTKITGGQRIDLFGARAEQLPKIWKRLTDAGLESGHAYGKALRTVKSCVGETWCRYGVQDSTTLAVDLELRYRGLRSPHKIKMAVSGCARECAEARSKDVGVIATEQGWNLYLGGNGGHRPRHAELFASDLDTETLVRYIDRFLMFYVRTADRLQRTAPWVESLDGGLGHVREVIVDDSLGICAELDTAMAYHVATYQDEWKTTLADPVALRRFASFVNAPEGADPDVIHVLERGQPRPARPAERAALIAGATLPVVADRFLAYPGSLPIQRDETDTKASG

SEQ ID NO: 12288 - protein, 319 aa, Brassica napus
VDPRVRLKPSNILVMGEGEEHGIMKIADFGLARIFQAPLKPLSDNGVVVTIWYRAPELLLGSKHYTSAVDMWAVGCIFAELLTLKPLFQGAEAKSSQNPFQVDQLDKIFKILGHPTVDKWPTLANLPHWQSDLQHIQAHKYDSAGLHNVVHLNLKSPAYDLLSKMLEYDPLKRITASQALEHEYFRMDPLPGRNAFVASQPMEKNVNYPTRPVDTNTDFEGTTSINPPQGVAAGNVPGGHGMGSRSMPRPMVAHNMQRMQPQGGVMAYNFPAQAGMNPSVPMQQRGMAQPHQQQQQQLRRKDPGMGMSGYAPPNKNRRL

SEQ ID NO: 12289 - protein, 135 aa, Haloarcula marismortui ATCC 43049
MRWGQVRPDMKRVVSTDEAPAAVGAYSQATSNGDLLITAGQLPLTTDGELLDDEPVADQTRQCLHNVAAILESEDLSLDDVLKTTVYLDDIDDFDSFNEAYSEFFESEPPARSAVGVGAVPKGAAVEIEAIATTE

SEQ ID NO: 12290 - protein, 254 aa, Zea mays
  misc_feature (212)..(212): Xaa can be any naturally occurring amino acid
  misc_feature (214)..(214): Xaa can be any naturally occurring amino acid
  misc_feature (237)..(237): Xaa can be any naturally occurring amino acid
  misc_feature (242)..(242): Xaa can be any naturally occurring amino acid
APVRRRATAVLHLHCPRSAATPHANQESGAEKPESASTPEQSKRAVVSYWGIEPRKLVKDDGTEWPWFCFRPWDTYRPDTSIDVTKHHEPKALADKVAYFVVRSLRVPRDLFFQRRHASHALLLETVAAVPPMVGGVLLHLRSLRRFEHSGGWIRALMEEAENERMHLMTFMEVTQPLWYERALVIAVQGVFFNAYFFGYLISPKFAHRVVXYXLEEEAVHSYTEFLKDLDDGKIDXVPASXIAIDYWRLPANA

SEQ ID NO: 12291 - protein, 175 aa, Aggregatibacter actinomycetemcomitans
ALRNRANTPVLVDGKDVMPEVNAVLSKMKSFCERVISGEWKGYTGKAITDVINIGIGGSDLGPYMVTEALRPYKNHLTMHFVSNVDGTHIAETLQKVNPETTLVLVASKTFTTQETMTNANSARDWFLATAKEEKHVAKHFAALSTNAKEVEKFGIDTDNMFGFWDWVGGRYSLW

SEQ ID NO: 12292 - protein, 527 aa, Burkholderia xenovorans LB400
MHDKILILDFGSQVTQLIARRVREANVYSEIHPYDVDASFIRDFAPKGVILSGGPSSVTETDTPRVPQAVFELGVPVLGICYGMQAMAEQLGGKVDIGHLREFGYAEVRARNHTSLLEGISDFTTPEGHGMLKVWMSHGDKVLEMPPGFALMASTESCPIAAMADETRHFYGLQWHPEVTHTVQGRAMLERFVLKICGAQPDWEMGHYIDEAVAKIREQVGQEHVILGLSGGVDSSVAAALLHRAIGDQLTCVFVDHGLLRLNEAEQVMATFADHLGVKVIHVDASEVFLRKLAGVTDPEAKRKIIGAEFVEVFQTEAGKLTDAKWLAQGTIYPDVIESAGKGKKATQTIKSHHNVGGLPETLNLKLLEPLRELFKDEVRELGVKLGLPPAMVYRHPFPGPGLGVRILGEVKRDFADLLRRADAIFIETLRTFIDKETGKSWYDLTSQAFAVFLPVKSVGVMGDGRTYEYVVALRAVQTLDFMTAHWAHLPHELLGHVSNRIINEVRGINRVVYDISGKPPATIEWE

SEQ ID NO: 12293 - protein, 106 aa, Sorghum bicolor
AGMGGGQFQPAREEHKTGGILHRSGSSSSSSSEDDGMGGRRKKGIKEKIKEKLPGGHKDNQHATATGGGAAYGQQEHTGAGTYGTEGTGEKKGIMDKIKEKLPGQH

SEQ ID NO: 12294 - protein, 300 aa, Caulobacter crescentus CB15
MAPPPADTAAALARFIDQERLPPAFAALAQRLHLPLAARIAEWAQERDEPLVVGVCGPQGSGKSTLAALLVRLLAARGLRTATLSLDDLYLPRAARERLAREVHPLLRTRGVPGTHDPTLGLAVLDALARPGPTPLPRFDKAADDRAPQTEWPLFEGPADVVLLEGWCVGARPQSPEALAAPVNALEAAEDPDGAWRAYANDALAGPYRALFDRIDRLVLLTAPDFATVRAWRGEQELKLRARLAAEGRDAARSMDDAALDRFLAHYQRVTEWIAQDLPAIADIAVTLDARRWPAKTHGL

SEQ ID NO: 12295 - protein, 386 aa, Bacillus megaterium
MTQRIEDLSIATIRTLSIDAIEKANSGHPGMPMGAAPMAYTLWTKFMNINPKNPNWFNRDRFVLSAGHGSALLYSLLHLAGYDLSIEDLKNFRQWGSKTPGHPEFGHTAGVDATTGPLGQGIAMAVGKAMAERHLAETYNKEGLEIVDHFTYGICGDGDLMEGVSAEAASLAAHLKLGRLVVLYDSNDISLDGDLDRSFSENVEDRFKAYGWQVIRVEDGNDLTAIANAIEEAKGDLTRPTLIEVKTTIGFGSPNHAGTSGVHGSPLGSDETKLTKEAYAWTFEEDFYVPEEVYAHFKATIAEDGQKKENEWNDVFAQYKEKYPELGRQFELAVEGKLPEGWEETLPAYETGSSLASRASSGEVLNAVAQAVPQFFGGSADLAGSN

SEQ ID NO: 12296 - protein, 307 aa, Anabaena variabilis ATCC 29413
MSIIVFGSINIDLVATAPKLPIAGETLLGEDFFKVPGGKGANQAVAVAKLGVPTQMVGRVGAHGFGAELMENLQDAGVQTDNIFVDETASSGVAMITVAHDGENQIVVIPGANGRVNQADVERLSYILPTATALLLQLEIPITAVIAAAQAARSNNITVILDPAPAPSDLPAELYPLIDIITPNEVEAGQIVGFPVDGEEAARKAAGVLLQRGVKSAIVKLGAKGVVCATDKETFFVPAFFVDTVDTVAAGDAFNGGLATALYSGLSLHQAVIWGAAAGALAATKLGAQTSLPDKLTFEAFLKERGL

SEQ ID NO: 12297 - protein, 463 aa, Bacillus clausii KSM-K16
MFSKPYNEVYIFLGVVPLEKEQQLKRTLTLVPLLVIGLAYMDPLVVFDTYGVVAQLTQGHVATSYLFTIAALLLTAYSYGRMVQAFPKAGSAYTYAQQSIHPNVGFAAGWSLLLDYLFLPMVNFAIGMAYLNAAFPEVPAFIWVVILAAAITTVNILGIQLTANITGLFVAFQVLVAAVFVVFMIRGLMNGLGTGELLSPVPFFSDTFAFQTAFTGASILCFSFLGFDAISTLSEETKNPKKTVPLAIVLVVLIGGALFVAVSYLLQLVYPNYDAFISAEAASLEIAQYVGGAFMHAFFLAGTMVAVVSSSMSSHASASRLLFAMGRDNTLPKRFFGYVHPRFKTPTFNIVLIGLLSLTAIFGELEIIYSFISFGALIGFISVNASVVFHYYIREKRRSLKGTVANLLLPALGAAFCIWLLYSIDRHALTIGVIWTILGLIYFLVRRKNSPHFTADAANRHKE

SEQ ID NO: 12298 - protein, 257 aa, Triticum aestivum
GGRPSSKPGGKAKTKWGTEIKGKGSLQPWSHAYTWEEDFTASDDDDELEVEERRPEKPKKLKEDDKKTKKKPARTCVQIEEIPEDNTAGCDAIRKAFAMGNGKGKAKELSPQDAALLIQMNYRAHLAHRSQVLRCLRDLAVAKAKLKELRSLFYNLSYRRRLSHDHEERQRFSEKIIVLLLTVDALEGPDFMVRTAKKSMLEELESMLEIVDPQPPGKQRSFNRRKFDLPEGGAIPNEKTAGVNNAVRVINTGKGKQ

SEQ ID NO: 12299 - protein, 542 aa, Oryza sativa (japonica cultivar-group)
MEAATVVAAPIPAADAAAKALEKKLLDLELPPFPAPAKKAAAKVVAAAPKKKLAGGAGGYVLEDVPHLTDYLPNLPSFPNPLQNHPAYSVVKQYFVNADDTVAKKIVVHKGSARGTHFRRAGPRQRVFFQPDEVSAAIVTCGGLCPGLNTVIRELVCGLHDMYGVTSVVGIEGGYRGFYARNTVELTPRSVNGIHKRGGTVLGTSRGGQDTGKIVDSIQDRGINQVYIIGGDGTQKGAATIHAEVQRRGLKCAVVGVPKTIDNDIAVIDRSFGFDTAVEEAQRAINAAHVEAESAENGVGVVKLMGRNSGFIAMYATLASRDVDLCLIPESPFYLEGKGGLLEFAEKRLRENGHMVIVVAEGAGQDVIARSMRLADAHDASGNKVLLDVGLWLCAKIKDHFKKKANFPITLKYIDPTYMIRAVPSNASDNVYCSLLAHSAIHGAMAGYTGFTVAPVNGRHAYIPFYRITEKQNKVVITDRMWARVLCSTNQPCFLSTEDVEKAGQDDEEPIVPLVEGENSLVKAPPLLANAGDRAALCNGAA

SEQ ID NO: 12300 - protein, 1619 aa, Magnaporthe grisea
MSQPVEDPSHDQARNDNAQTTTDTGNASMPKTNGHDQESSATGISSSPADTLMDKEKQAAPTPEPSTEKAAVPDPAASVASDTAEDEFFDDNDSEQRRRNEMVQQLARTYTSRSNASAAADEYGNANPFLIASEDPDSPLNPSGNNFKAYAWAKAIAGMVAAEGGSFRTIGICFQNMNVFGFGAATDFQKTVSNVWLEAANMLRTAVGMGKTTRIDILRGFNGVVRNGEMLVVLGPPGSGCSTFLKTIAGETNGLNVDQSAYFNYQGLSAEEMHKRHRGEAIYTAEVDVHFPQLSVGDTLTFAANARAPRRAPPGVSKTLFANHIRDVVMAIFGISHTINTRVGNEYIRGVSGGERKRVTIAEAALSGAPLQCWDNSTRGLDSANAIEFCKTLRVCTRLFQTTACVSIYQAPQSAYDMFDKAVVLYEGYQIYFGPADEAKQYFVNLGFECPARTTPDFLTSMTAPHERIVRPGFEGKAPRTPEEFAIAWENSAEYTALQADIEEYKSSHPINGPDAEAFRKSRAAQQGRGQRPNSPYTLSFYQQTKLCLWRGWKRLLGDPTLTVGALFANTLMALVISSIFFNLQMTTSSFFQRGALLFFACLLNGFAAALEILILFAQRPIVEKHDRYALYHPSAEAVASMLCDMPYKVFNAIVFNLVLYFMANLRREPGAFFFYLLISFATVLAMSMMFRTIASMSRSLSQAMVPAAAIILILIIFTGFVIPLDYMLPWCRWLNYIDILAYSFESLLINEFAGQRYTCTEFVPRAEFPGYGDLSGTNRVCQAVGSVAGQPFVKGEDYLYSSFRYESANKWRNFGILIAFMIFFCSRTWLRPRMCERKKSKGEVLVFRRGQRPAAIKDAKTDPEAGPPKVGGAVVAANMTGENAGFIQRQTSTFGWRDVCYEVQIKKETRRILDHVDGWVKPGTLTALMGVSGAGKTTLLDCLADRTSMGVITGEMLVDGHQRDASFQRKTGYVQQQDLHLQTTTVREALNFSALLRQPAHVPRAEKLAYVDEVIRLLDMQEYADAVVGVPGEGLNVEQRKRLTIGVELAAKPPLLLFVDEPTSGLDSQTSWAILDLLEKLTKSGQAILCTIHQPSAMLFQRFDRLLFLAKGGKTVYFGDIGENSKIMTDYFERNGGFPCPHDANPAEWMLEVIGASPGTTSDIDWHQAWRESPECADVHAELDRLKEQVPNTPPPTEDKASYREFAAPFHQQIYAVTHRVFQQYWRTPSYIYAKAALCAVTALFIGFVFYDAPNTQQGLQNQMFAIFNILTVFGQLVQQTMPHFVIQRDLYEVRERPSKVYSWKVFMLSQIIVEIPWNSLMAVIMFFCWYYPVGLERNAILADQVTERGALAFLYLWGFLIFTSTFTDLMIAGFETAEAGGNIANLFFSLCLIFCGVLANPDTMPRFWIFMYRVSPFTYIVSGLLSVAVANSEVRCASNEFLHFDPLNGTCAEFMRNYINGTTIPGLGRIPGAGGYLRPDTESSRSNCAFCPIKDTNIFLQGAHANYNDRWRNFGLIFVYIIFNIIAALFVYWAVRVPKKKLGGKDAAAGVGAGAGAARASASNEKGKMQREKGEVEGLTTAVLGTSVAGSDAPMTTTTEGEGERAKRRTSGDEVVR

SEQ ID NO: 12301 - protein, 572 aa, Propionibacterium acnes KPA171202
MPSLRTCKPTRRPDPMRTLSGLGVSAGVGQAHALVVSPAPGLPASDPSRGAEADLAKVEAALGKVADRLDERSLHADPSALAVLQATAMMARDPGLLTSIKSHLSDGHGPAHALWAAFEDFCAQLSAAGGYLAERVTDLRNVRDRAVAVMQGLPEPGVPSFDSPVILVAEDLAPADTATLNPELVRGLITAAGGPTSHTAILASQIGIPAVVRCSEARDIEDGTPLALDGVTGTVLVEPDEASVSELTERANRRAEVLASAPDGDATLSDGERILVLANIGNPSDAPTAKKKGAEGVGLFRTEFLFLDRQDAPTIDEQTEAYATVLKTFDEGAKVVFRTLDVGADKPLAFADLGAEENPALGRRGLRLSQVRTDLIDAQLEALAKAAEQTGRDPYVMAPMVATKAEAEWFSSRARAAGIKTVGIMVEVPSTALRSSQVLESVDFASIGTNDLTQYAMAADRLQGELAELLTPWQPAVIQLVKATCDGAGERLIGVCGEAAGDPLLALVLVGVGVRSLSMAAGKITAVKAALSRHNLEQCRRIADAALAACSPEEARTAALKLADPSVEVLVS

SEQ ID NO: 12302 - protein, 258 aa, Thermosynechococcus elongatus BP-1
MEWQEVRGNWLCIPQRPLGWIHFLGGAFVAAAPQLTYRRLLEHLAEANYGIIATPFVNSFDHGAIALDALNKLDYALDWLVHRQGYPPALPIYGLGHSMGCKLHLLINSLYDGDRAGNMFMAFNNYPASQSIPWMDNLGPASVEFTPSPTETEHFIQKRYPVRRNLLIRFQDDDIDQTARLRSLLRAKFGDMVTALKLPGNHLTPLSQDLKWQVGAEFSPLDALGQWIKQSLFPEMPVLEACLLEWLNPLGAARRCRP

SEQ ID NO: 12303 - protein, 124 aa, Haloarcula marismortui ATCC 43049
MEELTTDDAPDSIGPFSQGIASGDRMYVSGQGPVDPDTGEVIQGTPGEQTRRTLRNVAAVLQAGGASLDDVVKATVFVKDMRYYDEVNEVYGELMSPPYPARSAVEVVKLPVDIDVEIEVVAER

SEQ ID NO: 12304 - protein, 193 aa, Shewanella oneidensis MR-1
MNRRQFFKLCAAGAATSAISALGLMSEKAYAAVREFKLLGAKETRNNCPYCSVGCGLLMYSQGSGGKNSEHAIFHIEGDADHPVNRGALCSKGAGLVDYVNSPHRLQYPEYRAPGSNKWERISWQDAFKRIARLMKDDRDANLIEKNADGVTVNRWLTTGMMTSSGMANESGLATQKFARALGLVAIDTIARN

SEQ ID NO: 12305 - protein, 385 aa, Sinorhizobium meliloti 1021
MAQMSKRSAVEPFHAMDVLAEATRRRDSGHPVISMAVGQPAHPAPKAALDAARRALDHGRLGYTDALGTHSLKRAIAAHYHSRHGITLDPQRIAVTTGSSAGFNLAFLALFDPGDRVAIARPGYPAYRNIMAALGLEVVEIEANAEAGFTLTPDSLEGAAARAGKPLKGVLLASPANPTGTVTGKAQLKALADYCRDHSIAFISDEIYHGLTFAGEETTALEVADDAVVINSFSKYYCMTGWRIGWMVLPEARVRAFERIAQSLYISPPELSQIAAEAALGAHEELDGYKRAYAANRALLLERLPQIGFSIASPMDGAFYAYADVSRFTNDSMAFARRMLAEIDVAATPGFDFDPLEGHRTMRFSYAGAATEMEEAMNRIARWLA

SEQ ID NO: 12306 - protein, 249 aa, Triticum aestivum
  misc_feature (110)..(110): Xaa can be any naturally occurring amino acid
MPGSIAFGRFDDSFSLASFRAYIAEFISTLIFVFAGVGSVIAYTKVSGGAPLDPSGLIAVAICHGFGLFVAVAIGANISGGHVNPAVTFGLALGGQITILTGIFYWVAQXLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWVYWAGPLIGGGLAGVVYRYLYMCDDHSPVAGNDY

SEQ ID NO: 12307 - protein, 168 aa, Triticum aestivum
DGAAKAASRILPENVAKILSQKGTIERVLTCGNASDVLKCAFDLTEAALNHQYEGCTATALLIWFDQNKDCFAQCANLGDSACIMNVDGKPIAMTEDHRVVSTTERARIAKLGNPLKDGESRICGLNLCRMLGDKFLKEQDPRFSKEPYVSPVVQISKSCSAFALIAS

SEQ ID NO: 12308 - protein, 173 aa, Brassica napus
  misc_feature (3)..(3): Xaa can be any naturally occurring amino acid
  misc_feature (46)..(46): Xaa can be any naturally occurring amino acid
  misc_feature (87)..(87): Xaa can be any naturally occurring amino acid
  misc_feature (92)..(92): Xaa can be any naturally occurring amino acid
  misc_feature (151)..(152): Xaa can be any naturally occurring amino acid
  misc_feature (157)..(157): Xaa can be any naturally occurring amino acid
SLXPGIISSLRFKKRSGAGIQGLKGCSYCPTPPLSSPFELLSPSDXMKADSSGWFGSEDGEKPGVWAVEDSMITLLEKKMSRVYAAXPAERXKAVYNTPPSKFETIDQGRGLFFRMIRMGFEDMYVGSPGSMWDKFGKQHYFVCTGPASMXXPIDVXAGETWRGAMVIEHDNL

SEQ ID NO: 12309 - protein, 173 aa, Ureaplasma parvum serovar 3 str. ATCC 700970
MINIDYIKSKIRDVPDFPKKGIVFKDITPLFLEPKIIEKIVDDFADFAKSLNIDAIIGAESRGFLFAAPLSIKLNKPFILVRKPNKLPNDVYSAEYTLEYGSSRVEMHKDALKPNQRVLIVDDLLATGGTVAAIENLVRQAKGIVAGSVYLIRLGFLKGEEKLSGKVHALINY

SEQ ID NO: 12310 - protein, 310 aa, Capsicum annuum
EVAAERLEPRVEEKDGYWILKEKFRQGINPQEKVKIDKEPMKLFMENGIEELAKIPIEEIDQSKLSKDDIDVRLKWLGLFHRRKNQYGRFMMRLKLPNGVTTSAQTRYLASVIRKYGEEGCADITTRQNWQIRGVVLPDVPEIIKGLAEVGLTSLQSGMDNVRNAVGNPLAGIDPEEIVDTRPYTNLLSQFITGNARGNPAVSNLPRKWNPCVVGSHDLYEHPHINDLAYMPATKDGRFGFNLLVGGFFSAKRCDEAIPLDAWVPADDVVPVCKAMLEAFRDLGFRGNRQKCRMMWLIDELGVEGFRAEV

SEQ ID NO: 12311 - protein, 923 aa, Pisum sativum
MELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVANFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 12312 - protein, 432 aa, Zea mays
  misc_feature (69)..(69): Xaa can be any naturally occurring amino acid
MRCLPFLHGDAKEKDPVTKSASVRSMSTTSTERDVRSGSDFTSLNVSDMSAESIRRTQYPSFTDRPSNXLRVFSFAELKSATRNFSRSLMVGEGGFGCVYRGVIKTSDEPNERIEIAVKQLNRKGLQGQKEWLTEMNVLGIVDHPNLVKLIGYCADDDERGVQRLLVYEYMPNGSVDDHLSSRSTSTLSWPMRLKVALDSARGLKYLHEEMEFQVIFRDLKTSNILLDENWNAKLSDFGLARHGPAEGLTHVSTAVVGTLGYAAPEYMQTGRLTAKSDIWSYGVLLYELITGRRPIDRNRPKSEQKLLDWVKPYISDVKRFPIIVDPRLEGHYNLKSMTKLSSVANRCLVRMPKSRPKMSEVYDMVQKIVDCVGTGPPQPPLLHYHGSASEPGPGDKRARKGSVKRRRLWELRFGCRHIVWRGWKPAIVKDL

SEQ ID NO: 12313 - protein, 249 aa, Propionibacterium acnes KPA171202
MTAKLILLRHGESEWNSKNLFTGWVDVDLNEKGEGEARHAADLLKQENLLPDIVHTSLLRRAIHTAYLALDGCDRHWIPVHRSWRLNERHYGALQGLNKAETKEKYGNDQFMAWRRSYDVRPPDLDRDSEFSQFHDPRYADIPASERPVAECLKDVVARMVPYFTSDIAADLKDGKTVLVAAHGNSLRALVKHLDEISDEDIAGLNIPTGIPLFYELDDNLKPVTRGGRYLDPEAAAAGAKAVANQGNK

SEQ ID NO: 12314 - protein, 135 aa, Arabidopsis thaliana
MNGSSAFHIILSVTFMVFLFGGLCEAGVVVNVDIINDIGPNVQLGLHCKSKDKDLGPQSLAPQQHWGFRKTLDFWGVTLFFCHFEWENQSKWFDILVAGRDRNTCAEHPCVWSIRPSGPCRLTGKEKCFPWNDQY

SEQ ID NO: 12315 - protein, 286 aa, Dehalococcoides sp. CBDB1
MQTIPDALFGIIGYPVSHSVSPAMQNAAFKHCKLNYLYLTIAAKPEDLQNVIASMRPLNIRGLNVTIPHKIEVIKYIDTLDPAAKKIGAVNTIVNENGQLKGYNTDFGGFVRLLEHNRIAPAKHRFALLGAGGSAHAISLAICTLGGHLTVLARQEEKAKDLAAKMCLRFKGKAQGLELNEANLEETLAESDIIVNCTPIGMGNLAGQSLIPPRLLRPDLTVIDAIYNPCKTRLLEDAEKKGAKIINGLEMLVWQGAMSFEIWTSQKAPFRVMMKEAEMALDENEK

SEQ ID NO: 12316 - protein, 222 aa, Dehalococcoides sp. CBDB1
MKIPPICCVITQLPQAETLKKSEGAAFYELRLDLLGENWRETAVLLNKPFMATCRRSAEGGSFKGNEAERINRLEKAASAGAFMLDIEYSTPNLEEVLGRLRPQAKCLLSHHNFTDTPSAAKLKTLLKDMLTHQADIYKVITTATSINDNINLLNLTKEIPDKKIVAFAMGEPGILSRILCPLAGSPFTYASLNDGNKSASGQMTLAQMIEIYRSVNYANHT

SEQ ID NO: 12317 - protein, 453 aa, Streptomyces hygroscopicus subsp. yingchengensis
MSQPIDSVTAGHTPEETSAGPDTSAWSFETKQIHAGAAPDPTTGARATPIYQTTSFVFRDTQHAADLFSLAEPGNIYTRLHNPTQDVFEQRIAALEGGVAAVALSSGQAAETLAILTLASAGDHIVSSTSLYGGTYNLFRHTLPKLGIEVSFVDDPDDVEAWRAAVRPNTKALFAETLGNPRGNVLDVRAVADVAHAAGVPLIVDNTVPTPYLLRPIEHGADIVVHSATKFLGGHGTAIAGVVVDGGTFDFGAHADRFPDFTEPDPSYHGLRYWPALGPGAFAVKLRVQLLRDLGPALSPHSAFLLLQGVETLSLRIERHSANAQALAEWLEQRDEVAVVHYPGLPSSRWYEAGQRYLPRGAGAIVSFELRDGVEAGKRFVDAVELFSHLANIGDVRSLIIHPASTTHSQLDEEQLAATGTSPGLVRLSVGIENLADLKADLEAGFRAAKDAS

SEQ ID NO: 12318 - protein, 342 aa, Streptomyces hygroscopicus subsp. yingchengensis
MAQPPALPVIDISRFRAPDAADRDAFLAELRSAAHEVGFFYVTGHGVPAPLRDEVLSAARAFFALPVERRLEIENLNSPQFRGYTRTGTEYTAGSAYWREQIDIGPEREALALGPDDPDYLRLIGPNQWPSALPELRDIVLRWQAEALRVSREVLRALAAALGQDEGYFDQWFDDEAAVHVKIVHYPPRAAEDADQGVGAHKDYGYLALLQQDEVGGLQVQREDGEWIDAVPVPDAFVFNIGEMLEIATQGYLKATQHRVVSPQAGVHRYSIPFFLGPRLDAVVKPLNLPAELAALSRGVTDDPDNPLLAAFGENAVVGWLRSHPRVAERWWSDVLEKRESR

SEQ ID NO: 12319 - protein, 248 aa, Coprinopsis cinerea okayama7#130
MSGIGLSKTVEVLKSHVLSQLDLRRERPLFVALQGPQGSGKSWVSGELQKELGKGTDALRVVVLSIDDLYLPHSGLVSFANSHTHNRLLQGRGQPGTHDIGLGIEILSGLKVGRDKVRLPRFDKSRFNGEGDRVPVEDSPVVEQPPRVDVVIVEGWCVGFRSLSDQELSARWETWEQERTKLEIPEELCTLRDIQEINESLKQYDALWDFFDVFVQAGVGHWASLLPPRRADHAIASSTNGALSKNTI

SEQ ID NO: 12320 - protein, 261 aa, Picea abies
MGRGRVQLRRIENKINRQVTFSKRRNGLLKKAYELSVLCDAEVALIIFSTRGKLYEFASSSMNKTLERYEKCSYAMQDTTGVSDREAQNWHQEVTKLKGKVELLQRSQRHLLGEDLGPLNVKELQQLERQLEVALAHLRSRKTQVMLDQIEELRQRERLLHEVNKSLQKKLSETEGRDVITGIEQTSNTNTGTNGPWDSSITNTAYALSHPQQNSNASLHHVDCEPTLQIGYQPVPPESIGPPHQPQHNQTQNQYMQGWWV

SEQ ID NO: 12321 - protein, 233 aa, Triticum aestivum
  misc_feature (6)..(6): Xaa can be any naturally occurring amino acid
  misc_feature (10)..(10): Xaa can be any naturally occurring amino acid
LQSGRXKVDXRIPASDYLEVNQDLLDILMAGFNNRDIAIHYSTILRDCVRHQVAARYVLYSQHMKKFFDYIQFPDFSPSSEAFKTFKELLTRHKSSAAEFFTKNYDWFFSDFHTKLLHSSNYVTKRQSIQLLGDILLERTNSSVMLRYVSSKENLIVLMNLLRDPSQPIQVEAFHIFKLFTANKNKPRDIISILVANKSKIIRFLNAFTLEKEDRVFESDKAQVRVDITALKL

SEQ ID NO: 12322 - protein, 331 aa, Vibrio harveyi
MTIKVGINGFGRIGRFVFRAAQERNDIEVVGINDLIDVDYMAYMLKYDSTHGRFNGTVEVEGGNLIVNGKTVRVTAERNPEDLKWDAIGVDVVAEATGLFLTDETARKHITAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELAGVLGYTEDQVVSQDFIGEVQTSVFDAKAGIALTDNFVKVVSWYDNEIGYSNKVLDLIAHISK

SEQ ID NO: 12323 - protein, 631 aa, Shigella flexneri 2a str. 301
MSATKLTRREQRARAQHFIDTLEGTAFPNSKRIYITGTHPGVRVPMREIQLSPTLIGGSKEQPQYEENEAIPVYDTSGPYGDPQIAINVQQGLAKLRQPWIDARADTEELTVRSSDYTRTRLADDGLDELRFSGLLTPKRAKTGRRVTQLHYARQGIITPEMEFIAIRENMGRERIRSEVLRHQHPGMSFGAHLPENITAEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAEDLTWEAFRDTLLEQAEQGVDYFTIHAGVLLRYVPMTAKRLTGIVSRGGSIMAKWCLSHHQENFLYQHFREICEICAAYDVSLSLGDGLRPGSIQDANDEAQFAELHTLGELTKIAWEYDVQVMIEGPGHVPMQMIRRNMTEELEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKISQEVRDYAAAQTIEVGMADMSENFRARGGEIYLHKEEA

SEQ ID NO: 12324 - protein, 151 aa, Ralstonia metallidurans CH34
MKVSDILQLKGNTLFTVTPDTPLMQAVQAMAEHDIGSLVVMEYGDLVGMLTFREIIETMAANNGTLGTHSIRKVMDDAPLTCTPETDVNEVRRMMLERHTRYLPVLDNRTLMGVISFYDVAKSVVEEQSFENKMLKAYIRDWPEEKEERAS

SEQ ID NO: 12325 - protein, 925 aa, Medicago sativa
  misc_feature (635)..(635): Xaa can be any naturally occurring amino acid
MELQVIRIFRLVVACVLCLCIFIRSASSATKGFESISCCADSNYTDPKTTLTYTTDHIWFSDKRSCRPIPEILFSHRSNKNVRIFEIDEGKRCYTLPTIKDQVYLIRGVFPFDSLNSSFYVYIGVTELGELRSSRLEDLEIEGVFRATKDYIDFCLLKEDVNPFISQIELRPLPEEYLHGFATSVLKLISRNNLGDTNDDIRFPDDQNDRIWKRKATSTPSSALPLSSNVSNVDLKDSVTPPLQVLQTALTHPERLEFVHDGLETDDYEYSVFLHFLELNGTVRAGQRVFDIYLNNEIKKEKFDVLAGGSKNSYTALNISANGSLNITLVKASGSEFGPLLNAYEILQARSWIEETNQKDLELIQKMREELLLHNRENEALESWSGDPCMIFPWKGITCDDSTGSSIITMLDLSSNNLKGAIPYFVTKMTNLQILNLSHNQFDSLFPSFPPSSLLISLDLSYNDLDGRLPESIISLPHLKSLYFGCNPYMKDEDTTKLNSSLINTDYGRCKGKKPKFGQVFVIGAITRGSLLITLAVGILFFCRYRHKSITLEGFGGKTYPMATNIIFSLPSKDDFFIKSVSVKPFTLEYIEQATEQYKTLIGEGGFGSVYRGTLDDGQEVAVKVRSSTSTQGTXEFDNELNLLSAIQHENLVPLLGYCNEYDQQILVYPFMSNGSLLDRLYGEASKRKILDWPTRLSIALGAARGLAYLHTFPGRSVIHRDVKSSNILLDQSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQTLTHPQPR

SEQ ID NO: 12326 - protein, 178 aa, Triticum aestivum
  misc_feature (5)..(5): Xaa can be any naturally occurring amino acid
  misc_feature (55)..(55): Xaa can be any naturally occurring amino acid
MRKAXMESLTSPAAFVEGGVQDACDDACSICLEAFCESDPSALTGCKHEFHLQCXPTSQELLEAVQWERNIRTNQTQNTTIFHHPALGDFEVQHLPVVGNDAELEERILQHLAAAAAMGRSHQHGRREGQRNRSGSHGRPQFLVFSAHPNTPAGSVSSSSTQGEGADDLGIGLFQTLR

SEQ ID NO: 12327 - protein, 232 aa, Candidatus Protochlamydia amoebophila UWE25
MTQTNDSPSIKAKKAAALKAVEFVQDQMIIGLGTGSTIAYFIEALGKRCQAGLKITAIASSERSMRQARLVGIPIVDSDTILELDLTIDGADEIDPLKQMIKGGGGALLREKLIASASKEMIVVIDETKLVNKLGKFPVATEISIFTFRHIVKKLKDHGYCGSLRVNQDQSLYRTDNGNYIFDICFPEPIDNPIFEHNRLKSFAGVLETGLFFNLAGRVIIGYQNGMTKIVA

SEQ ID NO: 12328 - protein, 423 aa, Oryza sativa (japonica cultivar-group)
MEYGAATRGALLAAAPLSGARRSWLPLSSPPSPPSIQIQNRLYSISSLPLKARGVRRCEASLASDYTKASEVADLDWENLGFGIVQTDYMYITKCGQDGNFSEGEMIPFGPIALNPSSGVLNYGQGLFEGLKAYRTTDDSILLFRPEENALRMRTGAERMCMPAPSVEQFVDAVKQTVLANKRWVPPTGKGSLYIRPLLMGSGAVLGLAPAPEYTFIIFVSPVGNYFKEGLAPINLIVEDKFHRATPGGTGSVKTIGNYASVLMAQKIAKEKGYSDVLYLDAVHKKYLEEVSSCNIFVVKGNVISTPAVKGTILPGITRKSIIDVALSKGFQFFGKSSINVFGFLKVEERLVSVDELLEADEVFCTGTAVVVSPVGSITYQGKRVEYAGNKGVGVVSQQLYTSLTSLQMGQAEDWLVWTVQLS

SEQ ID NO: 12329 - protein, 506 aa, Oryza sativa (japonica cultivar-group)
MPTVSVGRDRFFVALGRTYRLARALRIFTGTEATPMYKISCIPRDSMLLMHVKPQILTLSTFMMEKRKRTLVAIGTHDLDTLKGPFSYEALPPQEINFVPLKQEESFRADKLMEFYKSDMKLKKFLHIIENSPVYPVIYDSNRTVLSLPPIINGAHSAITLKTRNVFIECTATDLTKAKIVLNTMVTMFSEYCENKFEVEPVEVVSHDGSKTIYPDLSCYKMEVSLSEVVGPIGISLDETKVISLLNKMQLQAESCPSKGEPRISVSVPPTRSDILHARDLVEDVAIAYGYNNVPKSKPKCMTIGGRQPLNRFSDKLRAEVARAGYMEVLTFTLCSREENFDMLNRTQDVNKAVIIANPRTSEFEVVRTSLMSCLLKTLKHNIDHPRPIKIFEVGDVVTLDGSRDVGASNNRRLAALYCNKQSGFEEIMGLVDRIVNVVRAPHIKFGQNYYVPTNEPEFFPKRQCKIVMSDGKQIGYLGIVHAEVLRKFGIPDPCTFVEIDVEALL

SEQ ID NO: 12330 - protein, 482 aa, Propionibacterium acnes KPA171202
MQEGDSVTPHTSTTVDKGDAGYDKALKNRHLQMIAIGGSIGTGLFLGTGGRLAQGGPGLAISYAVCGIFAFLMVRALGEMAIRRPSSGAFVSYAREFMGEKGAYATGWFFFLDWSVTVMADITAVALYLHYWTPLRAIPQWVLALIALGVVFTLNMLSVKMFGEAEFWFAAIKVAAIILFMIAAIWAIVTGARVGNYTAGLHNIAQHGGFFPAGLAPVFALTLGVIFAFGGTEMVGVAAGETKDASKILPKAINSMILRIFVFYVGSIILMALVLPYTAYSSNESPFVTFFTGIGIPYAGDIIQVIVLTAALSSLNAGLYSTGRTLRSLAVAGEAPKAAAKLNRHHVPSGGIAMTAALGLLGVALNAFLPDSAFEIVMNLAGIGIAGTWAMVLLAHTRFVSAVRRGKDNRPEYRMPGAPVTNYISLAFLLIVVLSNVTSESGRWTLALFALVAIAMVAGWYAVRNSIKPDLLDNVVPSDEGM

SEQ ID NO: 12331 - protein, 1090 aa, Xanthomonas axonopodis pv. citri str. 306
MAGPTLLRTPMPKRTDLETILIIGAGPIVIGQACEFDYSGAQACKALRDEGYRVVLVNSNPATIMTDPNMADAVYIEPINWQTVEKIIAKEKPDALLPTMGGQTALNCALDLADHGVLEKYNVELIGAKREAIRMAEDRELFRVAMGEIGLDCPTAAVAHTLEEALEIQTRVGYPTIIRPSFTLGGSGGGIAYNREELIEIVGRGLELSPTTEVLVEESVLGWKEFEMEVVRDTADNCIIVCAIENLDPMGVHTGDSITVAPAQTLTDKEYQRLRDASIAVLRKIGVDTGGSNVQFGISPTTGRVVVIEMNPRVSRSSALASKATGFPIAKVAAKLAVGYTLDELKNEITGGLTPASFEPSIDYVVTKIPRFAFEKFPQADARLTTQMKSVGEVMAMGRTFSESLQKALRGLETGKIGLDPTGLDLSSEDDIATLKRELKAPGPERLFYVADAFRAGMTVADVYALSFIDPWFLDQIEEIVSHEQQLADDGMAALDAPRLRMLKRAGFSDARMAQLIGSNEESVRTLRRALKVRPVYKRVDSCAAEFATSTAYLYSTYEDECEALPTDRDKIMILGGGPNRIGQGIEFDYCCVHAALALRDDGFETIMVNCNPETVSTDYDTSDRLYFEPLTLEDVLEIVELEKPKGVIVQYGGQTPLKLARALEANGVPVIGTSPDSIDLAEDRERFQQLVDKLGLKQPPNRIARNAEEALVLAREIGYPLVVRPSYVLGGRAMEIVYGESDLARYVRDAVKVSNDSPVLLDRFLDNAVEVDVDIIADKDGNVLIGGVMEHIEEAGVHSGDSSCSLPPYSLSPQTQAELRRQVVMLAEGLNVVGLMNTQFAVQVNEAGDDIVYLLEVNPRASRTVPFVSKAIGMPLAKIAARCMAGKTLAEQGATKEIVPDYYSVKEAIFPFAKFQGVDPILGPEMRSTGEVMGVGRSFSAAFARAQEAGGIKAPPLGKAFVSVRDPDKQRVLPVAQALVERGFTLVATRGTGAWLQQNGLSCEIVNKVAEGRPHIVDSIKNGEIVYIVNTTEGRAAISDSFSIRREALQHRVTYSTTVAGAKALVQSLEFRGTGPVWSLQELHKELEA

SEQ ID NO: 12332 - protein, 559 aa, Arabidopsis thaliana
MTLLSSLGRASRSAPLASKLLLLGTLSGGSIVAYADANEEANKKEEHKKKKVVVLGTGWAGISFLKDLDITSYDVQVVSPQNYFAFTPLLPSVTCGTVEARSIVESVRNITKKKNGEIELWEADCFKIDHVNQKVHCRPVFKDDPEASQEFSLGYDYLIVAVGAQVNTFGTPGVLENCHFLKEVEDAQRIRRGVIDCFEKAILPGLTEEQRRRKLHFVIVGGGPTGVEFAAELHDFIIEDITKIYPSVKELVKITLIQSGDHILNTFDERISSFAEQKFTRDGIDVQTGMRVMSVTDKDITVKVKSSGELVSIPHGLILWSTGVGTRPVISDFMEQVGQGGRRAVATNEWLQVTGCENVYAVGDCASIAQRKILGDIANIFKAADADNSGTLTMEELEGVVDDIIVRYPQVELYLKSKHMRHINDLLADSEGNARKEVDIEAFKLALSEADSQMKTLPATAQVAAQQGAYLAKCFNRMEQCKELPEGPKRFRTGGHHQFRPFQDESSSLDYRYKHFGQFAPLGGDQAAAELPGDWVSAGKSAQWLWYSVYASKCTEFET

SEQ ID NO: 12333 - protein, 217 aa, Pimpinella brachycarpa
MVRGKTQMRRIENATSRQVTFSKRRNGLLKKAFELSVLCDAEVALIIFSPRGKLHEFASSSMHETIERYRKHTKDVQSNNTPVVQNMQHLKHETASLAKKIELLEVSKRKLLGEGLGTCSINELQQIEQQLEKSVCTVRARKMQVFKEQIEQLKEKEKTLAADNAILLAKYDVQPRQESPEDGGNLTSTTENSENSDVETELFIGPPEKRFKRIMEK

SEQ ID NO: 12334 - protein, 261 aa, Agrobacterium tumefaciens str. C58
MTLAYRKVALVTGAGSGIGRAAALHLAAAGFSVGLLGRTESELQTVAAEIEAASGSSRLLLADVSDEAAMRHAVATLVDDFGRLDVVVANAGVNGVWAPIDELKPSDWDDTIRINLRGTYLTVHASVPHLKAAGGGSIVIVSSINGTRTFTSPGATAYSVTKAGQLAMAQQLALELGRHRIRVNAVCPGEIETAINENTDIRGRERTEVPVRFPAGDIPVTGGVAGTSEDVAELIGFLASDASRHITGTPVWIDGGQGLLR

SEQ ID NO: 12335 - protein, 961 aa, Oryza sativa
MDEKRAARTPRAGARNAVNGGESGCCSEKAARWGWRAPVEVAVVGFVATLTLLVLLYGGTGSLLSFTSPRTEFVQKLAAGGGVARGGGGAGDGRDGEDKCRPAMEAAEAGSMAWRTAVRGRQRSARTTVRPTVAGAIGAERRGQAGGGGEAGTMGMGGGLVSTFSRMLRSNRMLAGLRLRCTSDSGLVWWRNSSAVMPKDKVFRVPPPENARLFQHYTRRARRHARCSCVRVCSWLLLMLVLLVVALTAFASVVYLVGQLLRRLSAAARQSAPFRADRPRPPSAAPPCTPTAPSTAFPAPLCAMPCCAASAASMAGRHLSSPSRPSPARLLRVLRLLQPPPIPIVPAFQLHRAAAAASPSHGAPEDTPETSTRHDDDRLLGGLLSPAFDEHSCRSRYTSSLYRRRSPFRPSTYLVERLRRYEARHKRCGPGSALFQEAVEHLRSGRNAARSECQYVVWTPFNGLGNRMLALASTFLYALLTDRVLLVHAPPEFDGLFCEPFPGSSWTLPADFLITDFDGVFTMWSPTSYKNMRQAGTISNATAEQSLPAYVFLDLIQSFTDAAFCDDDQQVLAKFNWMVIKSDVYFAAMLFLMPAYERELTQLFPEKEAVFHHLARYLFHPSNDVWGIVHRFYEAYLARADELVGLQVRVFPEMPIPFDNMYEQIIRCSEQEGLLPKLGQTVVVTAANGSSVVAPSTKLTSILVTSLFPDYYDRIRGVYHARPTETGEYVAVHQPSHEREQRTEARGHNQRALAEIYLLSFCDRVVTSAVSTFGYIAHGLAGVRPWVLLRPPSPVARAEPACVRSETVEPCLQALPRRMCGAAEGSDIGALRLATSGPSRGERGEAVGKAPASLRARRAGALLADDDSSRRRPPPVTSSTTGRATLRQTGLLHQTRLAPIRSPSIGRASCAKPASISAARASRTEPASAVIGCASLRQAGLRPLHQTMPRRLDVVASHALS

SEQ ID NO: 12336 - protein, 1157 aa, Coprinopsis cinerea okayama7#130
MALARLQSLGRQSFLRPCIRPFSTTPTSRFTNSKPCNAVAAPAVGDYQPKDGEHVLNSPSEIARRISAKVLPKIPRANVQKVLVVGSGGLSIGQAGEFDYSGSQALKALNEEGVSAVLINPNIATWQTSHQLASEVYFLPITADYVAYVLEKERPDGILLTFGGQSALNVGIALDRMGILDRLGVKVLGTPIRTLEVSEDRDLFVQALKEIDIPVATSTAVSSVPAALEAAEQIGYPVILRSAFTLGGLGSGFANNPEELSNLAAKSLSLSPQVLIERSMKGWKELEYEVVRDAADNTIICCNMENFDPLGTHTGDSIVVAPSQTLPDDEYHMLRSAALKAIRHLGVVGECNIQYALNPTSREYCVIEVNARALASKATGYPLAYTAAKIALGYTLPELPNAVTKTTTACFEPSLDYIVTKIPKWDLAKFSSQVNREVGSSMKSVGEVMAIGRTFEESLQKAIRQVDPRWKGFEVVIEPKDLDHALSVPTDMRLFAIAYAMYKKNYSVDKIHDLTKIDKWYLHKIDNIVQTRHALEAAGSVENISYDLMLRAKKMGFADAQIADIFGSTEQIVRAHRKSLNITPFVKRIDTLAAEYPAHTNYLYTTYNASEHDVKFDEHGTIVLGSGVYRIGSSVEFDWCAVTCARKLRDMGNRTVMINYNPETVSTDFDEADRLYFEELGYERVMDIYELEQAQGVVVSVGGQLPQNIALRLKDAGVNVLGTDPAQIDKAEDRHKFSSILDSVGVDQPEWTEVTSVEAAKEWAKKVTYPVLIRPSYVLSGAAMNVVYEESELEHKLSAAADVSPLHPVVMTKFIDGAQEIDVDAVAHKGKLLVHAVSEHVENAGVHSGDATLVLPPFSLAQSDIERVKVIAEKVAAAFEISGPFNMQIIRKPTSSPDEVAELKVIECNLRASRSFPFVSKVLAHNFIDTATSAIVGQQVPEPVDLMKQQRDYTAIKVAQFSWTRLGGADPFLGVEMASTGEVASFGKDVYEAYWASLLSTTGFKVPKAGSGVLIGGDIRKPEMARIAKKLTDLGFKIYVSSPVVEEHLNAIPYVAAKRIFFPKTDKRKLREVFDEYEIQMVVNLAKSRGTTFTDEDYVARRNAVDFGLPLLNDAKTAELFVEALARKIPQGGLRPYTEGRIPSEVRSWSEFVGARV

SEQ ID NO: 12337 - protein, 444 aa, Agrobacterium tumefaciens str. C58
MDNPSRSNSTSLDSYWMPFTANRQFKANPRLLTSAEGMYYTSNDGRQVLDGTAGLWCVNAGHGRQQIASAVKHQLSTLDYAPSFQMGHPVAFEFAERLAEIAPGPEGGKLDRVFYTGSGSESVDTALKIAIAYQRAIGQGTRSRLIGRERGYHGVGFGGISVGGLVNNRRVFPQIPADHLRHTHDLARNSFVKGQPEHGAELADDLERLVALHGAETIAACIVEPVAGSTGVLVPPKGYLERLRAICDKHGILLIFDEVITGFGRMGSSFASNYFGVTPDIVTTAKGLTNGAIPMGAVFTSRKVHDALMHGPENQIELFHGYTYSGHPVACAAGIATLDIYRDEGLFTRAAELQDAWHDAIHSLKSAANVIDIRTIGFIAGIELQSREGAVGARAYDVFVDCFERGLLIRVTGDIIALSPPLIAEKSHFDDIVSILGDALNRAV

SEQ ID NO: 12338 - protein, 542 aa, Prochlorococcus marinus str. NATL2A
MSGSNPAVSINKKKVAPVVLAILDGWGYREEIEHNAVRQASTPVIDALWHAYPHTLIEASGADVGLPDEQMGNSEVGHLTIGAGRIIQQELVRISNTVKENKLIANPALNQFSQSLKKGGGTLHIMGLCSDGGVHSHIKHLCGLIEWAASKGLKNVSLHLFTDGRDTSAKSATKYINTIEAKIKATGVGEISSLCGRYWAMDRDNRWERTSKAYELLTDPRFAISKLSAAESINKSYQEGITDEFIEPVRLSSSFLKDGDGVVFFNFRPDRARQLVKALKLKDFDGFERKNKTDIDVLTFTQYESGLPVSVAFPPEPLNDLLGQVIADHGLNQYRTAETEKYPHVTYFLNGGIEKPLKGEVRHLVPSPRVATYDLQPEMSADELTESCIQAIDTGIYSLVVINFANPDMVGHSGIMKAAIKANEKVDSCIGKLLNSIGKLGGSLLITADHGNSEMMIGPDGQPWTAHTTNPVPVILIEGEKRKLSGYGNDIKLRESGGGLADLAPTLLHLLNLPKPKAMTGKTLIEPINLPKKPNLIPQPAY

SEQ ID NO: 12339 - protein, 149 aa, Glycine max
  misc_feature (26)..(26): Xaa can be any naturally occurring amino acid
  misc_feature (89)..(89): Xaa can be any naturally occurring amino acid
EGMLQPNISSTHSVICIFMSAENTSXKDCPEILEIKGRGRLDALEKFLPDLRQSRTRAMMAEHFVYNESNDQSTVRDEADSYILDDRVXFADPVPGAELYLRPPHKTTAEMLSNILSIEQIDPVNSIDIGLIGMIRWQKTSLTSPISPT

SEQ ID NO: 12340 - protein, 457 aa, Arabidopsis thaliana
MDSEKMDLFSKLPDEVISHILSSLPTKEAASTSVLAKKWRYLFAFVPSLDFNDSDFLHPQEGKREKDGILRSFMDFVDRVLALQGASPIKKFSLNVKTGVDPDRVDRWICNVLQRGVSHLALFMDFEEEYSLPYEISVSKTLVELKTGYGVDLYLWDDDMFLPMLKTLVLESVEFGRGQFQTLLPACPVLEELMLLNMEWKDRNVILSSSSLKNLKITSEDGCLGTLSFDTPNLVFLDYYDYVAEDYPIVNLKNLVEVGINLVLTADRINRARDNVWNLIHGIQNAEIFHISPVTFEVLSLSCEAMPVFKNLTTLNIRTVMQQGWQAMPLLLKNCPNLETLYLGGLLHTVTNKCGDVCDCIPRKKKGRSLMACPVNKIQIQGFRGTIREVHMIKHFLDFCPSLKEMEIIVETKEPTLFEIPKWLEIVEDTLMQYNEMSSCTINYRVLAPLYWRWTRK

SEQ ID NO: 12341 - protein, 526 aa, Debaryomyces hansenii CBS767
MSVQILGDQATEERAENARMSSFVGAIAVGDLVKSTLGPKGMDKLLQSSSNMDSAMITNDGATILKSIPLDNPAAKVLVNISKVQDDEVGDGTTSVTVLSAELLKEAEKLIEKKIHPQTIIEGYRIACTTALEALSKAAVNNGSDQELFKKDLINIAKTTLSSKILAQDKDHFSTLAVDAILRLNGSTNLNHIKVIKKVGGRLRDSFLDEGFILEKRFGINQPKKITNANILIANSSMDTDKVKIFGAKFKVDSTSKLADLEKAEKAKMKAKVEKIKKFNINCFINRQLIYDFPEQLFTDAKINSIEHADFDGVERLALVTGGDVVSTFDTPESVTLGHCDTIEEILIGEDVMTKFSGVAAGEACTIVLRGSTEQGLDEAERSLHDALSVLSQTTRETKTCLGGGCSEMIMSKAVEQAAANETGKKSLAIESFARALRQLPTILADNAGFDSSELVSKLRSAIYNGMTTSGLDLNKGTIADMRETGVIESYKLKRAVVSSAAEASEVLLRVDNIIRAKPRTADRNQ

SEQ ID NO: 12342 - protein, 478 aa, Neurospora crassa
MATTLFRLAGRNAKRHCMRQSTTIAHNLNSTRAFSASALRRYAEPSYEGQGTRLVPTGDDFAPNNDLYGLEALKADGAPRVPPQDHILARKVRHYTVNFGPQHPAAHGVLRLILELKGEEIVRADPHVGLLHRGTEKLCEYRTYLQALPYFDRLDYVSMMTNEQCFALAVEKLLNVEIPERAKWIRTMFAEITRILNHLMSVLSHAMDVGALTPFLWGFEEREKLMEFYERVSGARLHAAYVRPGGVHQDIPLGLLDDIYMWATQFGDRIDETEEMLTDNRIWIDRLRGIGVVSAADALNLSFTGVMLRGSGVPWDIRKSQPYDAYDQVEFDVPVGINGDCYDRYLCRMEEFRQSLRIIHQCLNKMPAGPVRVEDYKISPPPRSAMKENMEALIHHFLLYTKGYAVPPGDTYSAIEGPKGEMGVYVVSDGSERPYRVHIRAPGFAHLGGFDHLSRGHMLADAVAVIGTMDLVFGEVDR

SEQ ID NO: 12343 - protein, 923 aa, Pisum sativum
MELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 12344 - protein, 535 aa, Oryza sativa (japonica cultivar-group)
MDISLASLVLVLLAFVLPLLYLLLQLPGKKSGGGGGDGPRLPPSPAGCLPLLGHLHQLGPLPHVALRSMAAAHGPVLRLRLGRVPTVVVSSAAAAEEVLRARDAAFSSRPRSAMAERILYGRDIAFAPYGEYWRQARRVCVVHLLSAQRVSSFRRVREEEAAALADAVRAAGRGGGRAFDLSGLIVAYASAVVSRAAFGDESARGMYGGADGGRAVRKAFSDFSHLFGTKPVSDYLPWLGWVDTLRGRERKARRTFEALDGVLDKVIDDHRRRRDSGRRQTGDADAGHRDFVDVLLDVNEMDNEAGIHLDAIEIKAIIMDMFVAGSDATSKPMEWAMAELVSHPRHMRRLQDEIRAVVGGGRVTEDHVDKLPYLRAALKEALRLHAPLPLLVARETVADTEIMGYHVAARTRVVINGWAIGRDTAVWGETAEEFMPERFLAGGNGGGAAAADYKVQGFEMLPFGGGRRGCPGVTFGMATVEMAVASLLYHFDWEAAAADGKGGREGTPLLDMSETSGISMGLKHGLPLVAKPRFP

SEQ ID NO: 12345 - protein, 923 aa, Pisum sativum
MELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEEGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 12346 - protein, 455 aa, Arabidopsis thaliana
FSPPEIFVFFRLFAGGLEIMKGRISKIGSYAISSSIRDQHQQPCISCTTFNILAPIYKRLSHKDQSLRESDNRAYWLGRNHRIIDWLLYERSSIICLQEFWVGNEELVNLYEKRLGDAGYLSYKLGRTNNRGDGLLTAVHKDYFRVVNSRDLLFNDCGDRVAQLLHVELVPPYSQYDAHQEVLIVNTHLLFPHDSTLSIVRLQQVYKILQYVESYQKEVNLSPMPIILCGDWNGSKRGHVYKFLRSQGFVSSYDTAHRYTDSDAHKWVSHRNHRGNICAVDFIWLLNPNRYRKLLKTSWSEAVFGMFRYLLRRASLTAEDAFAFLKTDNDGDHITFMGFCETLRQLNLTGHCNGLTTKEIKDLWTQADIDGNGLLDYKEFQQRIWNQTWSEQRDAEDGEAKGNQEQTVGFSVKNAVLFPPEVEKGMWPENYSLSDHARLTVVFSPIRMPCSQLVS

SEQ ID NO: 12347 - protein, 296 aa, Methylophilus methylotrophus
MALGMLTGSLVAIVTPMFEDGRLDLDALKKLVDFHVEAGTDGIVIVGTTGESPTVDVDEHCLLIKTTIEHVAKRVPVIAGTGANSTAEAIELTAKAKALGADACLLVAPYYNKPSQEGLYQHFKAVAEAVDIPQILYNVPGRTGCDLSNDTVLRLAQIRNIVGIKDATGGIERGTDLLLRAPADFAIYSGDDATALALMLLGGKGVISVTANVAPKLMHEMCEHALNGNLAAAKAANAKLFALHQKLFVEANPIPVKWVLQQMGMIATGIRLPLVNLSSQYHEVLRNAMKQAEIAA

SEQ ID NO: 12348 - protein, 271 aa, Staphylococcus epidermidis RP62A
MKTLDSVNIPIRKDETHKGDYGKILLIGGSANMGGAIMLAARACVYSGSGLITVATHPNNHAALHSRCPEAMVIDINDTKMLTKMIEATDSILIGPGLGVDFKGNNAITFLLQNIQPHQNLIVDGDAITIFSKLKPQIPTCRVIFTPHQKEWERLSGIPIEEQTYERNLEAVERIGATVVLKQHGTEIYFCNDDVYKLPIGTPAMATGGMGDTLAGMITSFVGQFDNFKEAVTSATYMHSFIGEKLSDTMYVVPPSRLISEIPYVMKQLEG

SEQ ID NO: 12349 - protein, 133 aa, Mycoplasma mycoides subsp. mycoides SC str. PG1
MKIINTENAPKAIGPYSQAVKICNGTLYLSGQLGLDPKTMLLENNIELQTKRSLNNIYEILKQAGYDKTDVVKTLVLLKDINDFSLVNSIYEEFFEEHKPARSAFQAAALPKDALIEIEVIAYKKETNCCLDK

SEQ ID NO: 12350 - protein, 547 aa, Zea mays
MEIETEAPGSEKARSWRANAAAAAAAQAQQVSNTTKPDGGDQPMKEPAWKRFLAHVGPGFMVSLAYLDPGNLETDLQAGANHRYELLWVILIGLIFALVIQSLAANLGVVTGRHLAEICKSEYPKFVRICLWILAEVAVIAADIPEVIGTAFAFNLLFHIPVWVGVLITGSSTLLLLGLQRYGVRKLEFLISMLVFVMAACFFGELSFVKPPAVDVVKGLFIPRLKGDGATADAIALLGALVMPHNLFLHSALVLSRKTPSSVRGIKDACRFFLYESGFALFVALLINIAVISVSGTVCFSGNLSPEDADKCSDLSLDSSSFLLKNVLGRSSSIVYGVALLASGQSSTITGTYSGQYIMQGFLDIRMKKWLRNLMTRCIAIAPSLVVSIIGGSSGAGRLIIIASMILSFELPFALIPLLKFSSSSSKMGPHKNSIYIMVFSWLLGLMIIGINMYFLSTSFVGWLVHNSLPKYANVLVGLLVFPLMLVYVVAVIYLTFRKDTVVTFVADSAQLAVVDAEKANKAAAAGDDDDRPVPFRQDLADIPLPE

SEQ ID NO: 12351 - protein, 614 aa, Nicotiana tabacum
MFSLNGSSFTNNSLSGVSRCLTQSSRRGVSGPMVVVAAVNSNGKPGDRNVSVLVENSMKESAAAPVEKEIKSTVTGGVGDVYGEDSATEDQSITPWTLSVASGYSLLRNPHYNKGLAFSEKERDSHYLRGLLPPVVVNHDLQVKKMMNNLRQYEVPLQRYITMMDIQEMKGRVYYQLLMDKVEELLPIVYTPTVGEACQKYGSIFRRPQGLFISLKEKGKINEVLKNWPERKIQVIVVTDGERILGLGDLGCQGMGIPVGKLSLYTALGGIRPSACLPITIDVGTNNEDLLNDEFYIGLRQRRARGQEYAELFDEFMYAVKQNYGEKVLIQFEDFANHNAFDLLAKYGTSHLVFNDDIQGTASVVLAGLMAALQLVGGTLSEHTFLFLGAGEAGTGIAELIALEMSKQTGIPLEETRKKIWMLDSKGLIVNSRMESLQHFKRPWAHDHEPVKDLVNAVKSIKPTVLIGSSGAGRTFTKEVVQAMATFNEKPIIFALSNPTSQSECTAEEAYTWSEGRAIFASGSPFAPVEYNGKIYASGQANNAYIFPGFGLGLIISGAIRVHDDMLLAASEALAEQVSQENFEKGLIYPPFTNIRKISANIAAKVAAKAYELG

SEQ ID NO: 12352 - protein, 580 aa, Oryza sativa
  misc_feature (68)..(68): Xaa can be any naturally occurring amino acid
  misc_feature (81)..(81): Xaa can be any naturally occurring amino acid
  misc_feature (122)..(122): Xaa can be any naturally occurring amino acid
MASSASLQRFLPPSSHVAASRRRPPAVRTRPVQSLTVSAPSSSTPVADDAVSAERLEPRVEQREGRYXVLKEKYRAGLNPXEKVKLGKEPISLFMEGGIKELAKMPMEEIEADKLSKEDIDXGRFMMRLKLPNGVTTSEQTRYLASVIEAYGKDGCADVTTRQNWQIRGVTLPDVPAILDGLNAVGLTSLQSGMDNVRNPVGNPLAGIDPDEIVDTRSYTNLLSYITSNFQGNPTITNLPRKWNVCVIGSHDLYEHPHINDLAYMPAVKDGKFGFNLLVGGFISPKRWEEALPLDAWVPGDDIIPVCKAVLEAYCDLGTRGNRQKTRMMWLIDELGMEVFWSEVEKRMPNGVLERAAPEDLIDKKWQRRDYLGVHPQKQEGLSYVGLHVPVGRVQAADMFELARLADEYGSGELRLTVEQNIVIPNVKDEKVEALLAEPLLQKFSPQPSLLLKGLVACTGNQFCGQAIIETKQRALLVTSQVEKLVSVPRAVRMHWTGCPNSCGQVQVADIGFMGCLTKDSAGKIVEAADIFVGGRVGSDSHLAGVYKKSVPCDELAPIVADILVERFGAVRREREENEE

SEQ ID NO: 12353 - protein, 229 aa, Oryza sativa (japonica cultivar-group)
MPCIPASSPGIPHQHQHQHHRALAGVGMAVGCAAEAAVAAAGVAGTRCGAHDGEVPMEVARHHEHAEPGSGRCCSAVVQHVAAPAAAVWSVVRRFDQPQAYKRFVRSCALLAGDGGVGTLREVRVVSGLPAASSRERLEILDDESHVLSFRVVGGEHRLKNYLSVTTVHPSPSAPTAATVVVESYVVDVPPGNTPEDTRVFVDTIVKCNLQSLAKTAEKLAAGARAAGS

SEQ ID NO: 12354 - protein, 922 aa, Ashbya gossypii ATCC 10895
MSYTTERSSKARHWTTMKSDFKFSNLLGTVYRQGNVVFSEDGTLLFSPVGNRVSVFDLIGNKSFTFEYEHRRNIARIDVNAQGTLLLSVDVDGRAILVNIKTRNVIHHFNFKDKVNDVKFSTDGKLFALACGRFLQIWRTPGVSAERQFAPFVRYRVHAGHFADITSLTWSRDSRFIISTAKDMTARIYSVNAEEKDLASMTFAGHRDYVMGAFFSADQEKIYTVSKDGALFQWEYTKNPALAEEDDEDEELDLSKYSWRITKKNYFYAKNAKVKCAAFHADSNMLIVGFSNGEFRMYELPDFTFIQQLSMGQNAVNTVAVNRSGEWLAFGSSTLGQLLVYEWQSESYILKQQGHFDALNALAYSPDGARIVTAAEDGKIKIWDIVSGFCLATFEEHTSSVTSVQFAKNGQIMFSSSLDGTVKAWDLMRFRNFRTFTATERIQFSCLAADPTGEVVCAGSLDNYDIQVWSVQTGQLLDTLSGHEGPVSCLSFSRENSILASASWDKTIRVWSIFGRSQQVEPIEAYSDVLDISMRPDGKQVAVSTLNGQLSFFDVETSRQVGNIDCKRDIISGRHLEDRFTSKNSARSKYFTTIHYSFDGLSIVAGGNNNSICLYDIPNEVLIKRFIVSRNMTLNGTMEFLNSSKMTEAGSLDLIDQDAENSDLEDRIDVSLPGSRRGGDMSTRRVRPEIRVTAVRFSPSANAFAAASTEGLLVYSVDDSVLFDPFDLDLDITPQAVLDALANGDYLHATVMAFRLNEEYLINKVYEAIPPDHISLLCSNLPVVYVPRILKFIGDFAMDSQHLEFNLLWVKFLLAAHGHYMVAHKHQFASALRAVQRFLGRVAKDVAAAARSNTHSHTFLTSTHSSLPMSGFGADDQELNSEHESSDEDMEMLSDTEGTWLGFSDKEKPVPLTNDDSDEDLI

SEQ ID NO: 12355 - protein, 356 aa, Trichodesmium erythraeum IMS101
MGFFDFEVGQILQFLQQGNSLEKKELEILASQELIDKKRAHVFNITSANVREVIMERSLLFQSVISDYDKFPLRDYNTLAILWKLWLPLGIKLASKCQGLSRPFIQGILGGQGTGKTTLAKILVLVLDKLGYKTISFSIDDIYKTYAERQLLQRQDSRLIWRGPPGTHDVSLGIEVLDKLRQSKSENSDGLIAIPRFNKSLFNGAGDRVEPEIVSKVDIILFEGWFVGVRPVEDKVFDMAKLLPIITEADRKFARDMNKNLMQYLPLWERLDSLIILYPTDYRFSKKWRKEAEKQMIALGKSGMSDDEIERFVDYFWQALHPELFIKPLINNQELVDLVIEINSDHSWENIYQPKS

SEQ ID NO: 12356 - protein, 414 aa, Methylophilus methylotrophus
MTAFSIQQGLLHAENVALRDIAQTHQTPTYVYSRAALTTAFERFQAGLTGHDHLICFAVKANPSLAILNLFARMGAGFDIVSGGELARVLAAGGDPKKVVFSGVGKSHAEIKAALEAGILCFNVESVNELDRIQQVAASLGKKAPISLRVNPNVDAKTHPYISTGLKNNKFGVAFEDALGLYEKAAQLPNIEVHGVDCHIGSQITELSPFLDALDKVLGLVDALAAKGIHIQHIDVGGGVGITYSDETPPDFAAYTAAILKKLAGRNVKVLFEPGRALVGNAGVLLTKVEYLKPGETKNFAIVDAAMNDLMRPALYDAFHNITTIATSAAPAQIYEIVGPVCESGDFLGHDRTLAIEEGDYLAIHSAGAYGMSMASNYNTRARAAEVLVDGDQVHVIREREQIADLFKLERTLP

SEQ ID NO: 12357 - protein, 560 aa, Xanthomonas axonopodis pv. citri str. 306
MNQARPWLQSYPAGVAAEIDLEQFRTVAEVFATSVKRFADRPAYHSFGKTITYREADQLVEHFAAYLLGELQLKKGDRVALMMPNCLQYPIATFGVLRAGLTVVNVNPLYTPRELKHQLIDSGASALVVIDNFGTTVQQVIADTPVRQVITTGLGDMLGFPKAALLNFVVKYVKKLVPDYRINGAIRFREALALGRKHRVPTLQIEPDDIAFLQYTGGTTGVAKGAMLTHRNLVANMQQAHQWLAGTGKLEEGNEVVITALPPYHIFALTANGLVFMKIGGCNHLISNPRDMPGFVKELKKTRFTAFTGVNTLFNGLLNTPGFDQVDFSSLKMTLGGGMAVQRSVAERWKKVTGLTLVEAYGLTETSPAACINPMDLKDYNGSIGVPIPSTDACIKDDAGNALPLGEIGELCIKGPQVMKGDWKKPEETAKVMDAEGWLHTGDIARMDEQGFVYIVDRKKDMILVSGFNVYPNEIEDVIAALPGVLEVAAVGVPDEKSGEIVKVVIVKKDPALTAEDVKAHARANLTAYKQPRVIEFRKELPKTNVGKILRRELRDSARP

SEQ ID NO: 12358 - protein, 207 aa, Brassica napus
  misc_feature (137)..(137): Xaa can be any naturally occurring amino acid
MAAVTPLAKYKLVFLGDQSVGKTSIITRFMYDKFDTTYQATIGIDFLSKTMYMEDRTLRLQLWDTAGQERFRSLIPSYIRDSSVAVIVYDVANRQSFLNTSKWIEDVRTERGSDVIIVLVGNKTDLVDKRQVSIEEXDNKARDFGVIFIETSAKAGFTIKPLFRKISAALPGMDTLSSAKQGDMVDVNLKSSNHSSQAEQQSGGCSC

SEQ ID NO: 12359 - protein, 369 aa, Bacillus sp. UTB2301
MDIFTKAYEHEQIVFCNDPDSGLRAIIAIHNTTLGPALGGCRMLPYASTEEALEDVLRLSKGMTYKCAAADVDFGGGKSVIIGDPNKDRSPQLFRAFGQFVESLNGRFYTGTDMGTTPEDFVHAAKETNCIVGIPEEYGGSGDSSVPTALGVIYGIKASNKVAFGDEKLEGKTYSIQGLGKVGFKVATQLLENGANLYVTDINEKAIQDLVELSKQYDGTVKVVSSDEIYSVDADVFVPCALGAIINDDTIQQLKVKAIAGSANNQLLNEERHGQELYEKGILYAPDYIVNAGGLIQVADELYGPNKNRVLKKTEAIYSSLLEVYKYSESEKIPTYKAANLFVEKRIEERKKRNSFFTHHKRPKWDIKK

SEQ ID NO: 12360 - protein, 333 aa, Bacillus sp. UTB2301
MTVETHVKTNKLTLVQAVTDGLRTMLKEKKEVIVLGEDVGKNGGVFRATDGLQEEFGEDRVIDTPLSEAGIVGVSIGMAINGMLPVAEIQFLGFIYPAYEQIMTHASRIRMRTMSKFHVPLVIRAPYGAGVRAPEIHSDSVETLFTHMPGIKVVCPSTPYDAKGLLIAAIEDPDPVLFMESMKLYRSSREDVPEGKYTVEIGKARKVRDGKDVSIFAWGAMVPVATKAAEEMEKKGVTCDVIDLRTLYPLDKDAIAESVQKTGRVVIVHEAHATGGVSNDVMAVINDTAFLYLKAPIERVTGFDVPVPFFTLEEHYLPNTGRVVKAIEKVIHF

SEQ ID NO: 12361 - protein, 516 aa, Frankia sp. CcI3
MSDAPDLTNLVDLAAARFGGTVVAVNDEFFAFAERMLLPEPPIVRPGVFTERGQWTDGWETRRRRDLPGSDWAIIRLGSPGIAHAVTVDTTHFTGNAPGAVEVHGATLPGYPSAAEVAEESVAWVPLVPRTPIVPDAANVLPVADQGRTRITHLRLTIHPDGGVARLRVHGTVVPDPRMFDRVTSDLAAAYLGGVVVAASDMHYGDRHNLNASGEARAMGEGWETRRRRGDGHDWAVVRLATQGTIVRAEVDTRHFRGNAPRAVALWAADNPDLLDPDDVTAITEWYPMLPRTRVQPNTRHLFDLEVPIQATHVRVDAIPDGGLARLRLTGAPTPVGREALAMRWFDALSPDAAREELLACCESEDWAAAVAARRPFGTLAALLPAAEQEWWNLPASAWLEAFTAHPRIGERPAHTPAPPTTARATVVSLDAPRREQAAMDQATAEVRAAFEQGNAAYEERFGYIFLVRAAGRDAEEMLALLRARLDNDPADELRIAAGQQAEITALRIRRLITGA

SEQ ID NO: 12362 - protein, 473 aa, Synechococcus elongatus PCC 7942
MPETAQEVLQLIQEKGIQLVDLKFIDMPGIWQHLTLHVSQIDENSFVEGVPFDGSSIRGWKAINESDMTMVPDPTTAWIDPFMKEPTLSMICTIYEPRTNTPYERCPRAIAQKAVDCLKASGIGDTAYFGPEAEFFIFDDVRFDQAENKSYYYVDSIEGRWNSGREEEGGNLGYKPRYKEGYFPVAPTDTSQDMRSEMLLTMADCGVPIEKHHHEVATGGQCELGFRFGKLIEAADWLMTYKYVIKNVGRRYGKTITFMPKLLFNDNGSGMHTHQSIWNDGQPLFAGDQYAGLSQMALWYIGGILKHAPALLALTNPTTNSYKRLVPGFEAPVNLAYSQGNRSASVRIPLSGTNPKAKRLEFRCPDATSNPYLAFAAMLCAGIDGIKNQIDLGEPLDVDIYDLSPEELAKIPSTPGSLKDALKALEADHDFLTVGGVFTEDFIQNWIEYKLDNEVIPISLRPHPYEFALYYDC

SEQ ID NO: 12363 - protein, 583 aa, Zea mays
EELRRLLELLPRELSGRVETHPELPALVEVVMDLGRPPLARFPSGDFLLSQRPISFDDLRHATSQVGDFGADNRAGISRTLHRISAIRNRKGVIVGLTCRVGRAVPGSANLLQDLVKDGGSLLLIGPPGVGKTTVIREIARMLADDYKKRVMIVDTSNEIGGDGDIPHPGIGNARRLQVPNQDMQHKVLIEAVENHMPQAIVIDEIGTKLEAMAASTIAQRGIQLVATAHGVTIENLIMNPSLEMLVGGIQSVTLGDEEANRRGVQKTVLERKGPSTFTCAAEIVSKKELRVHRSLEATVDALLAGKLPNFEIRKLDSKGSMQEVSVQKEQSHLGIYDATEFGSDSLRNARRSLDSAFSLDSAEGHIVRSDGADSSFNLYAYGISESTALQAIHQLELDDSVTSTYNISEADAVIALHSKLKKNYQIQAVLKSQDIPVFLVKTNSLPQITRALRALVDDHMDEVIDYNDKEEARSSEETDALEEARLAIEQVVIPKGESVQLLPRPSSIISSQVGLVESFSLKWEVVGQEPKACVRILPHFAPKQVEAVARETPAEPADSDWESHDDSDHTQSGITRLPFLPD

SEQ ID NO: 12364 - protein, 136 aa, Frankia sp. CcI3
MVRWSARMVGWSRPDPGRGDGGRDRGGVVSLSTHVLDTATGRPAAGLPLRLERAVRTLDGTTTGWIAVTEAVTDDDGRVADLPATIPGPWRLVFDTASRSAFFPEVTIAFVIEDPAGHHHVPLLLAPFGYSTYRGS

SEQ ID NO: 12365 - protein, 306 aa, Arabidopsis thaliana
MPLNLGNDGDGSSRIILTEPRGSTAEVLLFGGQVISWKNERREELLYMSSKAQYKPPKAIRGGIPVCFPQFGNFGGLERHGFARNKFWSHDEDPSPLPPANKQSSVDLILKSTEDDLKTWPHSFELRIRISISPGKLTLIPRVRNIDSKAFSFMFALRNYLYVSDISEVRVEGLETLDYLDNLIGKERFTEQADAITFDGEVDRVYLNTPTKIAVIDHERKRTIELRKEGMPNAVVWNPWDKKAKTIADMGDEDYKTMLCVDSGVIEPLVLLKPREEWKGRQELSIVSSSYCSGQLDPRKVLYGDI

SEQ ID NO: 12366 - protein, 248 aa, Kluyveromyces lactis
MARTFFIGGNFKMNGSKASIKEIVDRLNGASIPSNVEVVIAPPAIYLDHAVALNKRKEVKISAQNAYSKASGAYTGENSVEQIKDVGAEWVILGHSERRTYFNETDEIVAEKTKFALDSGVKVILCIGETLEEKQQNITLQVVQRQLQAVLEKVQDWTNVVVAYEPVWAIGTGLAATAEDAQDIHHSIREFLAEKLSRDVADSVRILYGGSANGKNAVTFKDKADVDGFLVGGASLKPEFVDIINSRV

SEQ ID NO: 12367 - protein, 402 aa, Synechococcus sp. WH 7805
MAKRSLASLSGTDLSGKRVLVRVDFNVPLDDAGAITDDTRIRAALPTINDLIGKGAKVILSAHFGRPKGQVNDAMRLTPVAARLSELLGKPVAKTDSCIGPDAEAKVGAMANGDVVLLENVRFFAEEEKNEAGFAEKLAGLAEVYVNDAFGAAHRAHASTEGVTKYLKPAVAGFLMEKELQYLQGAVDEPKRPLAAIVGGSKVSSKIGVLEALIDKCDKVLIGGGMIFTFYKARGLSVGKSLVEEDKLELAKELEAKAKAKGVELLLPTDVVLADNFAPDANSQVADVTAIPDGWMGLDIGPDAVKVFQAALADCQTVIWNGPMGVFEFEKFANGTNAIATTLAELSGKGCCTIIGGGDSVAAVEKAGLAEKMSHISTGGGASLELLEGKVLPGVAALNDAA

SEQ ID NO: 12368 - protein, 508 aa, Candida glabrata
LCHRKTSIILSMNSVAYSSIRYLPLLLRYGRALPLLNNPHALEQEHHESESDLVYYGVVSMFLVVLGGVFAGLTLGLMGQDEIYLTVINTSGTQKEKQLSGKVLRLISRGKHWVLVTLLLSNVITNETLPIVLDRCLNGGWQAVISSTILIVVFGEIIPQSICVKYGLEVGAFFAPFVLVLMYLMYPVAYPIALLLDYILGEDHGTVYKKSGLKTLVTLHQTMGVERLTTDEVTIISAVLDLKDKKVKEIMTPIENVFTLSADKILDEKTIEEIFNSGFSRIPIHLPNEPMNFIGMLIVRILISYDPEDALPISSFPLATLPETSPNTSCLNILNYFQEGKSHMCIVSERPGSSNGSIGVVTLEDVIEELIGEEIVDESDVFVDIHQHIMREQPGPLSKRHVTSYLHHLYTTSSKDSCVPLLNSKLNNYSSINEHKPVNHSHPPNLPNGSQLQLAPSNLASNPLDIKKSFVTIKKLPPGELISPSNKDYSNEHLRLNEQQGEISRQNH

SEQ ID NO: 12369 - protein, 496 aa, Pseudomonas sp. VLB120
MNSSLSAIDGLRLPHQMLIGGQWVSAQSGKTLNVYNPATGDILTEVPDGDVEDVNAAVESAAATLRSDTWRPCLPVLASVFCCAWRISSEVHGDELARLETLNNGKLLIYSKLMEVGASAQWLRYMAGWATKLTGSTLDLSLPLPPEVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 12370 - protein, 248 aa, Kluyveromyces marxianus
MARTFFIGGNFKMNGTKASIKEIVERLNSASIPSNVEVVIAPPAAYLDHAVSLNKKAQVSVAAQNAYLKASGAFTGENSVEQIKDVGAEWVILGHSERRTYFHETDEFIADKTKFALDSGVKVILCIGETLEEKQKGITLEVVQRQLQAVLDKVQDWTNVVVAYEPVWAIGTGLAATSDDAQAIHHSIREFLAKKLSKDTAEKIRILYGGSANGKNAVTFKDKADVDGFLVGGASLKPEFVDIINSRV

SEQ ID NO: 12371 - protein, 129 aa, Triticum aestivum
MAMSWTRALKRGVIPRDAAQLVGIRGFAAQPKGKKGGKGGAADAKPVLSKEMKSTTVFGANILKEGSDPKIQPDSEYPDWLWHLIDKRPVLSELRRKDAKTLPYEDLKRFVKLDNRARIKENNALTAKN

SEQ ID NO: 12372 - protein, 393 aa, Listeria monocytogenes str. 1/2a F6854
MKISKRLQNLPDQFFSSLVEKVGKKVAEGHDVINLGQGNPDQPTPKHIVEAMKTASEKPLNHKYSLFRGKQELKQAAADFYAREYNVTIDPNTEVAILFGTKTGLVELPMCLMDPGDTMLLPDPGYPDYLSGVVLGEVQFEKMPLIAENDFLPDFTKIPEDIAEKTELMYLNYPNNPTGAVATADFFEETVAFAKNHNIVVAHDFAYGGIGFDGKKPISFLETNGAKEVGIELYTLSKTYNMAGWRVGFAVGNSEVIEAINLIQDHMYVSLFPGIQDAAIEALTGDQTCVRELTARYENRRDAFISACREIGWEAVAPAGSFFAWMPVPEDFTSSEFADYLLEEVSVAVADGSGFGEFGEGYVRVGLLMDEERLEEAVTRVSKLHLFDKVTQQ

SEQ ID NO: 12373 - protein, 575 aa, Oryza sativa (japonica cultivar-group)
MWQCSGRSEVELGSGSMKQHAGGSRRGSTADSGGSTRADPDGAWQLCFATSKSKVGALGDGRSRRRHTEPRPHKLCHARYPQPRAQRLVRPHPAMVVKRPCVFEARINDGVPTSLDSSAAGLGVVDPAAMTLGDYDGSTTVAVDLVNEALGDNGNSVGIVNLTNTVLSDDVSNPSTQSAETMGRSKREVAPPPPPSPSQASPGSFASGMMLPGSLGSGAWQGPAPPQPPHPLLYAYGAAASAFPMAQMKQGLDRSAIDLSDLQERGMDFHPPGGFLSYFQDPSILQNHRPFVPPNYYPAEQVAPCSKLRPGAQQPVNIDSGDEEAHTVRTEKRLTWSTEEDIRLVSAWLNNSNDSISGNFKKNDRYWGDVTAEYNSTTPKNRTRQEKQIKDRFHKIKKNVGRFCCVYKEVKSIYVSGQNDMQLREKAEAAYQADYKEGPFSFLHCWNILRDQPNPEDIKRPIGTKTAKAQRNGKGRRKRKAKVYLSDTDDEIDKLKEVQEMANKGRDELLETQRRVASDNLESKKLAHLAAMEHKEAVMLETYRSLMLQDTKDIPDDVRSEHLMALKCMREKLFP

SEQ ID NO: 12374 - protein, 479 aa, Rubrobacter xylanophilus DSM 9941
METGVKSLKNFIGGRFVEPASGELYDVVNPSTGEVFARAPMSGEEDVDRAFGAAAKAFEEWRESTPSERQRALLRIADRIEERAEELVRAECENTGKPYALTLEDEIPPMADQIRFFAGAARCLEGKSAGEYMRGMTSYIRREPVGVCAQVTPWNYPMMMAVWKFAPAVAAGNTVVLKPSDTTPVSTLLLAEIAAEFLPEGVFNVVCGDRDTGRLLVRHEVPQMVAITGSVRAGMEVAEAAAKDLKRVHLELGGKAPVIVFDDADPEAAAEAIAEAGYFNAGQDCTAATRVLAAPGVHDDFVAALTERARSTRTGPPDDEEAYYGPLNNENQLRRVSGIIERLPDHAEVVAGGGRVGERGYFYAPTVVSGLRQDDEASQTEIFGPVITVQPFSDEDEAVRWANGVRYGLASSVWTRDHGRAMRVSRRLDFGCVWINTHIPLVAEMPHGGFKHSGYGKDLSMYGLEDYTRIKHVMSNIEA

SEQ ID NO: 12375 - protein, 345 aa, Propionibacterium acnes KPA171202
MKALVKTRPEPGLELVEVPDPVAGPNDVIVKVMRTGICGTDVHIDKWDGWAAKTVHTPLVLGHEFCGEIVELGSEVNDLEVGQFVSGEGHYVCGRCRACLAGKRHLCRNTQGIGYAVNGAYCQYFVMPAGNVWVHHIPDLDPDVAAIFDPFGNAVHTALQFPCLAEDVLVSGAGPIGIMAALVAQFQGARNVVVTDLSDERLELAQQLGLKNAVNVSREGLETVWDRFDMKEGFDIGLEMSGSGTALTSMIDNMTHGGRIALLGTPSTDITLDFSKIIFNMITIQGVTGRQIFETWYTMASLIRSGLDISGIITDRYPITEFREAFDVAGSGHGGKVVMNWECLD

SEQ ID NO: 12376 - protein, 452 aa, Rubrobacter xylanophilus DSM 9941
MRLVVVGGVAAGTKAAARARRVNPRLEITVYQEEPEPSISECGLPYLLSGTVSGRRRLVARTPEEFARDGIRVLVRHRVEEVRPEEGRLLVRDLAAGSVFEDRYDRLVLATGARAVPLGVPGSGLEGVFNLRFLTDADRILDHIRRHRPRRALVVGGGYVGLEVAENLRLLGMEVVLAQRPRRVATAYDPEISRRIEEHLRERGVELRTGAEVEELRGDGRVREARISGEAVEAGLVVAGVGIEPEVDLARRAGARIGTTGAVWTDRHQRTSLPEVWAAGDCAQTRNRITGGPAWVPLGDTANQTGRVAGTNAALGEDAEEFPGVLGTGIFKVFDLAAGKTGLSEAEAAGAGLEAVAATIESRSRAGYYPGAGRVLLKLVAERGSGRLLGAQALGPGADKLTDVCATALWGGLSCSDLINVDLAYAPPYGPVLSPVIQAATVLQRRLSQPPK

SEQ ID NO: 12377 - protein, 628 aa, Aspergillus nidulans FGSC A4
MAPTTLSDLQPSATIDAKPTTVSIPSSRPEKPPPVQVLGKTKSGKTLKIRSYPQFDNLEDERLYRKQHLAAAFRVFADRGFDEGVAGHISVRDPILTNHFWINPLSAHFSLIKVSDLVLVDEDGNVVEGDEPVNLPAFAIHSEIHRARPDVNAACHAHSVAGKAFSCFGRELEMITQDSLRFYKSHAVYREFRGVVLDGEEGKRIAKALGDGKAAILQNHGLLTVGQSVDEAAFWFISLDKTCHAQLLADAAAAAGYKKIIIDDEEAAYSAPQVGGPEKGWLAFQPYYDEQKPAAIGVTATPPQPTISLANNVVQATLPSGESVTVNLNGATVTSWKSASGAEKLWLSEAAVLDGSKPIRGGIPVVFPVFGPPPSDHATSFLPQHGFARSSLWEFLGKSSSESSGANSGDDTVKLDFGLSSGLLSEDFKSKWPHEFGLVYSVTLSPEGLGTSLQVQNQGERSFEFQVLLHTYFAIDDISQIHVKNLQGKTYIDKVQNATTHTESNSSVQFTSETDRVYKDLDPSVPLVISLGDKELFSITREGLNDAVVWNPWIEKAKAMGDFSPDDGYKKMVCVEAGAVNGWQSLEAGESWEGGQFIKNVSERDEVDTVIVMRYSLRMTYVADGAFT

SEQ ID NO: 12378 - protein, 521 aa, Rubrobacter xylanophilus DSM 9941
MSKEMGLTPFRNEPYLDWSDEGNVGKLRAALEKVGGELGGSYPLIIGGKPVETEGEIVSENPAKPSQVVGRVGRATEREAGMALDAATRAFEFWRNTPPEARSRILLRAAAVMRRRRFEMIAWEIYEGGKPWAEADAQIAEAIDFLEYYAREMLRLKDGKPVAPFPGEENRYFYQPLGVGVIIAPWNFPTAILTGMSSAAIVTGNTIVMKPSEYTSVIGAKVAEIFEEAGLPAGVLNFCAGYGSEIGDYLVEDARTRFISFTGSMKTGLRINERAARTAPGQRWIKRVLAEMGGKDAIVVDETADLEAAAEGIAVSAYGYAGQKCSACSRAILQEDIHDEVLGRILERAKALRVGPPGSPEVFVGPLISRPQFEKVAGYIEVGKEEAERVLGEDPGDPEEGYFVSPTVFAGADPRSRIAQEEIFGPVLTVLKARDFDEALRIANDSPYGLTGGVYSRDRERLERARHEFRAGNLYFNRKITGALVGVQPFGGFDLSGTNAKAGGPDYLTLHMQAKSVAERF

SEQ ID NO: 12379 - protein, 473 aa, Rubrobacter xylanophilus DSM 9941
MSELLRKKDIPTLQREAAGDTGLKRTLGVWSLTFIGLGGIIGVGVFVLTGVVAANQAGPAVALSFVVAGIASAAAALCYAEFAGMIPVSGSAYTYGYAVLGEFFAWVIGWDLLIEYTLVVAVVAIGISGYINELLSGLGVGVPEWAASAPGGGDGGVVNLFAVLLCLFIAGLQIRGIRESANFNNAMVVLKLAIIAVIIALGAFFVDPANLTPFFPYGIGGVFTGAAVVFFAVFGYDTLTTAAEEATDPQRDLPRAVILSLAIALVLYVLMSLVVTGMVPYRQLDTPAPVAVAFQEAGLPWVARVISVAAIAGIISVLFAFMLGAARVWFAMSRDGLLPRWFCRLHPAYRTPYRPTAILGVATALVAGFFPITAVAELVNIGVLSAFIIVCASVWVLRHTRPDLPRAFRTPLVPLVPILGMAFSAVLIASLPPATWLRFVAWMAVGLVIYFLYSRRRSLLARGELGIERDLVE

SEQ ID NO: 12380 - protein, 552 aa, Aspergillus nidulans FGSC A4
MGVEETKKGLDVEATSAAPPPYVQDGHILSYEEEDFWTRNGLNFKSFQRRPAHVVELNRSMKTRHMHMIAIGGSIGLSLEYSSCWCADRSVYALGELAVMYPISGGFYTYSTRFIDPSWGFAMGWNYVFQWAIIVPLELTVAGLTIDYWQVDVSVAVWITVFLIAIIIVNIFGALGYAEEEFLSSCLKLGAIIVFMIIALVLVCGGGPSDGMYNEYWGARLWYDPGAFRNGFKGFCSVFVTAAFSFSGTELVGLAAAESKTPTKSLPGAIKQVFWRITLFYIVGLFFVGLLVRSDNERLLGSGLIDTKASPFVILAYDAGLKGYDHFMNVIILISVLSIGVSGVYGSSRTLTALAEQGYAPKFFAYVDRSGRPLWSVLITILFGVLGYVNVSSSGEEVFAWLQALSGLAALFTWGSICLAHIRFRRAWAYNGRSLDEIPFKAVGGIYGSYLGLFLIFIVLVAQFFVAVAPPGGGPDGGTYNDAKGFFKSYLALPVVLFFWICGYLWKRQGWLRTSQIDIDSGRREVDWDSINAERARVAAMPAWKRLLNIII

SEQ ID NO: 12381 - protein, 460 aa, Methylobacillus flagellatus KT
MNAQPEDNVNTDTISFASLNLAPELLKALDESGYTTPTPIQAQAIPVVLEGSDLMAGAQTGTGKTAAFTLPLLQKLLPLASSSASPARHPVRALILTPTRELAIQVEESVKTYAKHTPLRSLVVFGGVDIKSQTPTLMKGVEILVATPGRLLDHVEQRTVQLGQVQMLVLDEADRMLDMGFMPDLKRILALLPKQRQNLMFSATFSPEIKKLSEEFLTKPVLIEVARSNATSENVTQKILLVESEHKQHVLADLLRKEATQVIVFTKTKLSASRLARHLEREGIAAGAIHGDKSQLERIQALDAFKQGKITALVATDVAARGLDIDQLPMVVNYELPSAAEDYVHRIGRTGRAGASGIAISLVSSEEEKFLKEIEKLIKRELPKEQANAPQPVRRGQDTQRQKAPASIAPRQRHAGRNKEDEWFFKPYEPSTDAPAPKPMHSREKSKKEIPALLGGLNRK

SEQ ID NO: 12382 - protein, 190 aa, Oryza sativa (japonica cultivar-group)
MSLAPSIPSIKVKVGGVAAVAVSPPRHRACRSSFAVIRSSKAEGAPRRPAAPPLSPPPKTPTLSTPPTLSQPPTPVKPAAPSSSPPPSQDPEPKQAAAPVAVAAPAAAGAVTLEYQRKVAKDLQDYFKQKKLDEADQGPFFGFLGKNEISNGRWAMFGFAVGMLTEYATGSDFVQQVKILLSNFGIVDLD

SEQ ID NO: 12383 - protein, 691 aa, Salmonella typhimurium LT2
MTTNRAFEIRSGYSHTLGANYDGEGVNFAIFSAHAERVELCLYDPSGEHEIARLELPEYTDEIWHGYVPKLQPGALYGYRVYGPYDPENGHRFNPNKLLIDPYARELVGDIQWNDAHFAYQLLHDDKDLTFDDQDSAPFTPKCRVIDPDEANWEDRQRPSIPWSNAIIYETHVKGFTQLNSAIPEPLRGTFEGMGHKASVDYIKSLGITSVELLPVHWFPDDQHLLDKGLKNFWGYNSLGFFAPATRYYGPKGIQGFRDMVRAFHDAGIEVILDVVYNHTAEGNELGPTLSFKGIDNFSYYRTMPDQHRYYINDTGTGNTVNTSHPRVLQMVMDSLRYWAESMHVDGFRFDLGTILGREPEGFDQRGGFFDAVTQDPVLAKLKLIGEPWDIGPGGYQVGGFPPGWGEWNDKYRDTVREYWKGDNVTNDFAARLLGSGDLYDLRGRRPWSSVNFITAHDGFTLNDLVSYNDKHNEANGEDNNDGHNDNRSCNYGAEGPTDDEGINAIRERQKRNFLTTLLFSHGTPMLLAGDEFGRSQMGNNNGYCQDSEISWVHWDNLPETANALREFTRHLIQLRATQPLLRRESWRDGLEIRWFNAGGGAQQSEQWDEGSTIGVCISRPDLQPEAGIWHDALLLFNPFEGSVPFRIPMWGEGGWVLELTTADNAQQGMRITEEMDFDLAGRSIVLFRRP

SEQ ID NO: 12384 - protein, 450 aa, Agrobacterium tumefaciens str. C58
MTILPNSVEARDIAYQMHPNVNLRKFEKTGGLVIESGEGIYVTDSSGKRYIEAMAGLWSVALGFGEQRLVDAATKQMQKLPYYHTFSYKTHGPSVDLAELLIELSPVPMSKVHFTSSGSEANDLVAKMVWYRSNALGKKDKKKIIGRIKGYHGVTIASASITGLPRNHESFDLPLDRMLHTACPSYVHFGKDGESEAEFTARILGELEELILREGPETVAAFWGEPVMGAGGVLLPPEGYWEGVQAILKKYDILLVVDEVICGFGRTGKMFACETYDIKPDVLVVSKQISSSYMPLSAIIMNDSFYQPIADESDRIGSFGHGYTASGHPVATAVGLENLKIIQERDLVGNVARLEGKFLDHLKALADHPLIHSSRGIGLLGALEVKPWDGTKPGDTTLALAAAIESEGVITRPIGESICFCPPLIITAEQLDELFAGVKRGLDNALAARG

SEQ ID NO: 12385 - protein, 476 aa, Vibrio angustum S14
MHPNIHIPDAFIDLIKQTMPEHLDIDEFIACCKTPLRRSIRVNTLKISVEDFLARVANRGWTLTPVPWCDTGFWIEREDEDTVSLGNTAEHMAGLFYIQEASSMMPVTALLKDNDALDCVLDMASAPGSKTTQIASAMQNRGALVANELAASRIKVLHSNLQRCGVHNAALTHFDGCVFGTWAPESFDSILLDAPCSGEGAIRKDEDAMANWSLASIDEIAEVQRNLIVSAFQALKTGGVMVYSTCTLNQSENQAVCHFLKDKFGDAVEFEPLNTLFDGAEKSLTKDGFLHVYPQIFDSEGFFVARIRKLAPVETDSVKKRMGKFPFAQLKEKEQQEIAQQLKQDLDITLPGQHDVWLRDKEVWLFPSQLRTLIGEIRFQRIGIKLAEQHKKGYRWQHEAVMTLATGKESTAIELNVEQAKEWFMGRDIRLEIPAGKGEVIVTYRDYPIGIGKWVSNRIKNGLPRELVRDTNLFDI

SEQ ID NO: 12386 - protein, 519 aa, Ipomoea purpurea
MATLTLIFCTLVFAIFLYFLILRVKQRYPLPLPPGPKPWPVLGNLPHLGEKPHQSIAAMAERHGPLMHLRMGFVDVVVAASAAVAAQFLKVHDANFSNRPPNSGAEHIAYNYQDLVFAPYGPRWRMLRKITSVHLFSAKALDDFCHVRQEEVATLTRSLASAGKTPVKLGQLLNVCTTNALARVMLGRKVFNDGGSKSDPKAEEFKSMVEEMMVLAGSFNIGDFIPILGWFDLQGIVGKMKKLHARFDAFLNSILEEHKFVNNQHTTLSKDVDFLTTLIRLKDNGADTDSEEGKLTDTEIKALLLNLFTAGTDTSSSTVEWAFAELLRNPKILNQAQQELDSVVGQNRLVTESDLTHLPFLQAIVKETFRLHPSTPLSLPRMGAQGCEINGYFIPKGATLLVNVWAIARDPNVWTNPLEFKPHRFLPGGEKPNVDIKGNDFEVIPFGAGRRICSGMSLGIRMVHLLVATLVHAFDWDLMNGQSVETLNMEEAYGLTLQRAVPLMLHPKPRLQPHLYTLN

SEQ ID NO: 12387 - protein, 264 aa, Oryza sativa (japonica cultivar-group)
MDAAAAAGGEMSRQKATASAPPPPELDMVARAVQRLVARNDAVEALSGGGEAAAGLGAGMAAFEAARGAPAPRIGVAQYLERVHRYAGLEPECYVVAYAYVDMAAHRRPAAAVASRNVHRLLLACLLVASKVLDDFHHNNAFFARVGGVSNAEMNRLELELLAVLDFEVMLSHRVYELYREHLEKEARRDGGGGDMLAGASAAAAAKAGRMAAVSPSKLLERAAVNGAAQHDDWRSLGTAAAAEAANGVRRHRSSSSSRYSFDC

SEQ ID NO: 12388 - protein, 492 aa, Oryza sativa (japonica cultivar-group)
MPIQSLDKATAKEHLLLPPEFPQTPSFFRSPTVAWAPGGLLHSIGGHRLLNQKASGCTAWRDTRRRSAVGDPQSPELKVEAANTAVRAAVKRCAEVPISARPGKMMRIAIKSWSRFLPPYIPDDVIFDILLRLPSKSLIRFKSVCKAWHAIISNPCFISAHLECSKQKPSIFMVPGVYEKQNNGENTSFLMGLYQYQGGNIMEQIHVQDFPQGIGTWSRPIHCNGMLLISTMNHEMIVCNPSTREIVSLPKGSYNLHAGPRAGFGFDPHSNKYKVARFFYQRDDDTSELVCKFEVLTLGTNLWRQTEDPPYPISGLTPVHVKGAIYWMVNTPLCPDPPNAFLRFCLTNEKFSLLQYPPCNLKPTRFIEVEGELCCACFCSQVSALKIWTCNYAQNPEWTQRCTVQIPPDIVVNNPVARPPIVFLHGKKLLLTWNQVYQYDIQTCRMEKIASGVEDFTCYDPRNNKYWAYLEKEVTDMHLFNYAESLVPIREF

SEQ ID NO: 12389 - protein, 359 aa, Oryza sativa (indica cultivar-group)
MGSKSSKDTDDDHEPKQQEKKLPEHLEVQRTRVVCKADAPVNTEGFQYAGAYSAMGIDNSVSAEKFCKNFKVEISRLTEDDMEFDMIGIDASIANAFRRILIAELPTMAIEKVLMVDNTSVIADEVLSHRLGLIPLDADPRHFEYMSENDVPNERNTIVYKLHVSCKKGSPRLTAQACIVFPRMLIDIFYRIKFSHSFLCTVKSGDLEWLPEGSRLPLASPAQSRYKQKTYTSFSQSQKDILEKPLGVKFKDITIARLGPGQAIVLEVHGVKGMGKVHAKWSPVATAWYRMFPEVVFRKEIKGDNAEKLVKKCPVNVFDIEDLGNVTIESTGGLPPEALFTEAVRILEEKCERVISELS

SEQ ID NO: 12390 - protein, 356 aa, Oryza sativa (japonica cultivar-group)
MEIQQQKGVGNSKVVKVEKEESWDLFVNQASNEGHPVVAHFGASWCVTSLSMNYKFEELAQTHPEILFLYVDVDDVQSVSSKLGVKAMPTFFLIKDKEVVNKIVGANPDEVKKMVDASAESFGVTAPPDIVVVILTNLSISPSLSLLHVKPRTSAKPTASTTAKNARRVGVGAGSLSPLLSLSSLILFPSRALCCECGCGVASHALCELWVRERWPDELAGEEEEEEDDELSFAMCCYVGKATKIFLCLAAALIVVGLVLGFGLAHRTWGERKVQPDCRWPDCQLQPAYGGGGGGGDPLPATSGAGDTPPGVPLTEPAVAAFPGVASASSAAPPTASMPYLGPPSPFAVGLAPAHG

SEQ ID NO: 12391 - protein, 98 aa, Oryza sativa (japonica cultivar-group)
MESTSKVDDEQWLVYWILYSLITLMEMALHKVLYWIPLWYEAKVLFVAWLVLPQFRGASFIYDKFVREQLKKNRVKLHEHHGHGHGHADEHQSHVVRG

SEQ ID NO: 12392 - protein, 103 aa, Glycine max
  misc_feature (54)..(54): Xaa can be any naturally occurring amino acid
  misc_feature (64)..(64): Xaa can be any naturally occurring amino acid
MSGTGKGSKGPVKGGANPHRKVLMDNIQGITNHTNRRLATRGGVNRINGLIYEXTRGVLKILRXNVIHDSVTYTEHAHQETVTAMEHAYSPKKQGRTLYGFGG

SEQ ID NO: 12393 - protein, 375 aa, Rubrobacter xylanophilus DSM 9941
MAYDAIVVGLGGMGSAAAFHLARRGLGVLGLERFGAAHEMGSSHGRSRIIRQAYFEGPEYVPLLLRAYELWEELERESGRELLALTGALMVGGPEGELVAGSLRSAREHGLPHELLEARQVRERFPALRPSAGEVALYEERAGFLRPEECVRAHLELASGRGAELRFGEPAISWRACGERVEVRTAAARYEAGRLVISAGPWAPQLLAELGLPLRVERRVMFWLGPAEDPGRLPVLLWEPEDGELFYAVPDGWRGGVKAAFHHAGGAPCTPETLQREVREEEASSLRERLARHAPPLAGRLLDARACMYTLTPDGHFVISAHPRHPRVAIACGFSGHGFKFASVVGEILADLTAGGSTRHPIGLFSPERLTEPAR

SEQ ID NO: 12394 - protein, 83 aa, Medicago truncatula
MSQRIGTKLFVSRLSFYTTQQQLESLFSPFGVLTEATLITDQNTQRPKGFGFVSYKSEIEAEKARKALNGRVILTFSYLYIMP

SEQ ID NO: 12395 - protein, 338 aa, Propionibacterium acnes KPA171202
MSTTRPTTTRAVHLASRPHGAPTEDNFRIEEISLPELSDGQILVANDVMSVDPYMRGRMNDVKSYVPPFHIDRPLDGGAVGTVIESRSEDIPEGSHVSHQLGWREHAVLNAGDAHIIDTDIAPASAYLSVLGMTGLTAYAGLTRAAEMKAGDAVFVSGAAGAVGSMVGQLARLLGASRVIGSAGTDAKVARLRELGFDAAFNYHDGPSTELLGQAAPDGIDVYYDNVGGDHLEAAIDHLNIDGRVAMCGAISQYNSVEPPCAPRNLALAIGKRLTLRGFVIAKYAEEVRPEFQQRMAEWLPADEIHWDETFRDGLDAAPQAFIDMLDGANTGKMLVRL

SEQ ID NO: 12396 - protein, 471 aa, Dehalococcoides sp. CBDB1
MKFGTDGWRGIIAKDFTFENVSVCAQATAAYLKNTSPDNLSLVIGYDTRFASADFARLVAEVMAASGIKTYFGSCPTPTPVISHGVVNLKAAGAVIITASHNPAIWNGFKVKSADGASAPTYMITAIETEIAKLGDNPSVSRLDFDTAVSRGLIECIDLAPAYFEQISKLVDIEKLREAGFNIAIDSMYGAGIGYFKHLLEGGCNRLNEINAEPNPNFPDVLQPEPIAPNLNKLMRLVKDIRSDIGLATDGDSDRLGVVDEMGNFLNQLQVFSLLALYILEVKGLRGPLVKTITNSSMIDKLGKLYNVPVFETKVGFKYVSPVMIEQNALIGGEESGGYGFAGHVPERDAILAGAYFLDFMITTGKSPAKMLEYLYSKVGPHYYNRVDYTFDEARREEIMNHLANQKPESLAETKVSSTDRLDGFRYKLEDGSWLLIRFSGTEPLLRIYAESPSQDKTASLLENGRKLSGI

SEQ ID NO: 12397 - protein, 871 aa, Arabidopsis thaliana
MAEINGSMQLVGKHKSLPQTTLGGGSASEAPNKQVRPWLQQLSPASNGILHIPTKILSQETLHSLMHGKKATQTESAPQKPAKPVVNKKQHVPPPQRSVKAMEEVNESVRSKMRESLASALALVKKDDDSPKGKENIGTVETPVITQENTQSFQPASPASISVPVGEGTMSEMPTSVESSVQKDSEIPVDIMMEDVIKFNVLKSQYDEVFPRDNVPFTDIIFPNDDLLHGNELSWDLEVSDLGETKDYGTGGEKSFQDPKLLASKIEMELYKLFGGVNKKYRERGRSLLFNLKDKNNPELRERVMSEEISAERLCSMTAEELASKELSQWRQAKAEEMAKMVVLQDTDIDVRSLVRKTHKGEFQVEIEPVDRGTVDVSGGIMSRSKRRPRAKSHSVKTALKDEAAKADNEKSRSTPPSTEEIDPMQGLGIDDELKDVEFLPPIVSLDEFMESLDSEPPFESPHGNSEMQVSPSEKSDSEAGSDSKSPKGSPKELSDKSLPEAKPEKIDEVTPEFDANVKVDDDISRVEKAAALSDDKGERAWDGILQLSMSSVVPVAGIFKSGEKAETSEWPAMVEVKGRVRLSGFGKFIQELPKSRTRALMVMYLAYKDGISESQRGSLIEVIDSYVADQRVGYAEPASGVELYLCPTRGETLDLLNKVISQEQLDEVKSLDIGLVGVVVWRRAVVPKPGSGSKRQHSFSSSIGSKTSVLPVNKKQRVHVTEKPLVVASMRNHHHGYVKHDTAADDDVPPGFGPVASRDEDDLPEFNFNSSVVPVSSPQPLPAQSKSLDQVRKLIHKYGKSASTYDDDDDEDDIPEWQPHVPSHQLPPPPPPPLGFRPEVFRPPQDGWYDNQNGGSGQHYERNQSRNRGF

SEQ ID NO: 12398 - protein, 248 aa, Mycoplasma mycoides subsp. mycoides SC str. PG1
MKKKVIFGNWKMNGTNESLTDFLNQVDNKIDSSKIIAGLAVPYVMLQTGLKLAKNVKIAAQNVHYKDKGAYTGEISTTMLKEVGVEYVIIGHSERREMFNETDLDVNKKAKVLLENNITPIICCGETLQTKESGKTIEFVNNQINIMFEGIKKEDAIKAIIAYEPIWAIGTGKTATSSDAEEVCKQIRNNLSKIYDKNTAEQIIIQYGGSVKPSNIQEYLKMPNIDGALVGGASLLASDYLGLVNYNE

SEQ ID NO: 12399 - protein, 471 aa, Nicotiana tabacum
MNVMRRLKSIASGRSSVSDPGGDSSIKRVKVEQEVDQRLVGETQMEERCTTTFPKEDMPSTSKGTTTGSTSTMDTRPENSEFDELPKEMHEMKIKDEKTDSHEDNLKDMEPAVVSGNGTETGQIIVTTVSGRNGQQKQTLSYMAERVVGTGSFGTVFQAKCLETGESVAIKKVLQDRRYKNRELQIMRTFDHPNVVKLRHCFYSTTEKNEVYLNLVLEYVSETVYRVSRHYSRINQHMPIIYVQLYTYQICRALNYMHGVLGVCHRDIKPQNLLVNPHTHQLKLCDFGSAKMLVPGEPNISYICSRYYRAPELIFGATEYTTAIDTWSAGCVMAELLLGQPLFPGESGVDQLVEIIKILGTPTREEIRCMNPNYTEFKFPQIKAHPWHKIFHKRMPPEAVDLVSRLLQYSPTLRCTALEACAHPFFDALREPNACLPNGRPLPPLFNFTAQELSGAPADLRKRLIPEHMRK

SEQ ID NO: 12400 - protein, 531 aa, Mycoplasma mycoides subsp. mycoides SC str. PG1
MKVKRPVLLAILDGWGISEPDKGNAVDNANMVFVEYLKKTYPWLKAHASGKWVGLPENQMGNSEVGHIHLGAGRINLESLAKLNHETKTNNIAKNDEIVKTFEYVKKNNSALHLMGLFSNGGVHSHFDHMIAIYKAAIDYGITNIKFDLITDGRDTKPKLAYDFIKDLLELIKQNNNIGIISSISGRYYAMDRDKRFDRSRIAYNAIVNRNNVRSFTNILDYIQQEYMINHDDEMIIPAFNQDDLNGNLKANDAIIMTNFRPDRAIQISSILTNKNYIAWQNEAFSDAEFIGDKIRFVSMMKYSDSVTSPHIAYPPKPLTNTLGQYLSQLGLKQLRIAETEKIAHVTFFFDGGNDYFKNGLAKNDEITLANAYIDLIPSAKVATYDLKPQMSAVEITDKLLEEIKKDEFDFIVLNFANCDMVGHTGNNKATEIACKTLDEQLKRIHEEFVLRHNGIMVITADHGNAEIMIDKDGQVNKKHTTSLVPIIITDLNIKLKQNDPEIAKVAPTILDLMNIEIPKEMELESMIDHN

SEQ ID NO: 12401 - protein, 470 aa, Petunia x hybrida
MNVMRRLKSITSGRSSISDPGGDSSIKRVKVEQEIERVVGDTQMDDRCTTTAPKEDMASTSKDTTTASTSTMDTRPENSEVDELPKELHEMKIKDERTDSHEDNLKDMEPAVVSGNGAETGQIIVTTVSGRNGQQKQTLSYMAERVVGTGSFGVVFQAKCLETGESVAIKKVLQDRRYKNRELQIMRTLDHPNVVKLRHCFYSTTEKNEVYLNLVLEYVSETVYRVSRHYSRMNQHMPIIYVQLYTYQICRALNYMHSVLHVCHRDIKPQNLLVNPHTHQLKLCDFGSAKMLVPGEPNISYICSRYYRAPELIFGATEYTTAIDMWSAGCVMAELLLGQPLFPGESGVDQLVEIIKILGTPTREEIRCMNPNYTEFKFPQIKAHPWHKIFQKKMPPEAVDLVSRLLQYSPTLRCTALEACAHPFFDALREPNACLPNGRPLPHLFNFTAQELSGAPADLRKRLMPEHMRK

SEQ ID NO: 12402 - protein, 565 aa, Salmonella typhimurium LT2
METTTKKARSLYIPYAGPVLLEFPLLNKGSAFSVEERRNFNLSGLLPEVVESIEEQAERAWLQYQGFKTEIDKHIYLRNIQDTNETLFYRLVQNHLEEMMPVIYTPTVGAACERFSEIYRRARGVFISYPNRHNMDDILQNVPNHNIKVIVVTDGERILGLGDQGIGGMGIPIGKLSLYTACGGISPAYTLPVVLDVGTNNQQLLNDPLYMGWRHPRITDDEYYAFVDEFIQAVKQRWPDILLQFEDFAQKNAMPLLTRYRDEICSFNDDIQGTAAVTVGTLIAASRAAGSQLSEQKIVFLGAGSAGCGIAEQIIAQTQREGLSEDAARQNVFMVDRFGLLTDRMPNLLPFQAKLVQKCDNLQHWDTENDVLSLLDVVRNVKPDILIGVSGQTGLFTEEIIREMHKHCPRPIVMPLSNPTSRVEATPQDIIAWTEGNALVATGSPFSPVIWKDKVYPIAQCNNAYIFPGIGLGVIASGASRITDEMLMSASETLAKHSPLVNNGEGLVLPALKDIQVVSRAIAFAVGKMAQQQGVAVKTSAEALQQAIDDNFWKPEYRDYRRTSI

SEQ ID NO: 12403 - protein, 761 aa, Frankia sp. CcI3
MPVPAAPLAEAATHCPYCALQCGMMLRATPESAAKEGTGKDDGPEPAGGRSPGPVTVLAREFPTNRGRMCQKGWTSAELLTAADRLTTPLMRPRRDAPLEPVSWERALDRITEGIIRLQREHGPDAVGVFGGGGLTNEKAYALGKFARVALRSSAIDYNGRFCMSSAAAAGIRSFGLDRGLPFPLEDIAHAGAVIMVGSNAAETMPPFMQYLTRQRENGGALVVVDPRLTATARAAALHLQITPGTDLALANGLAYIALTEGYANRDFLAARTTGLAELRAVLASYWPERVERITGVPVADQYAAVDLLAQAERAMVLSARGAEQHSKGTDTVTALINLALVLGLPGTPGSGYGCLTGQGNGQGGREHGQKADQLPGYRKIIDPVAREHIGRIWGVDPTTIPGPGRSAYEMLDALGTPQGPRALLILGSNIAVSAPRAGRITSRLAALDLLVVADFVLSETAAMADIVLPTAQWAEEEGTMTNLEGRVLRRERLRPPPAGVRTDLEIIAALAARLGHAERFPGEPRAVFDELRRASAGGIADYAGISYERITASDGVFWPCPDETHPGTPRMFLDRFATPDGRARLVPVEHRPVAEDIDPEYPYYLTTGRVLAHYQSGAQTRRIGPLVDAAPEPFVEIHPDLAERLGIAEGAPVRVTSRRGTCEVPARLTDTLRFDTVFLPFHWAGAGRANSLTNDALDPTSRMPEFKVCAVAVEPIDDPDDNPDDDRHATGSVPTATVGAAEPVRAMLTGRSQPSGRHQG

SEQ ID NO: 12404 - protein, 493 aa, Trichodesmium erythraeum IMS101
MNNQISSNPDQNLEIAIIGAGISGLCMAINLRKAGITTFKIFEKSDNVGGTWHDNTYPSCGCDTPSILYSFSFEPKSDWTRHFPKQPEILEYLEHCSKKYDIRKHITFNTEISSAFFDSEKNIWRIYSASGEEFSANILVSGCGQLNKPKIPHLDGLETFSGTQFHCARWNHEHDLKDETVAVIGTGASAIQFIPIIAEQVKKLIVFQRSAPWIAPKPDFKFTNFIHWLGKSFPFILRFYRWLLYLVLEYFVVYLTIKQNTIVGKLVSTFLNFQREKIIKDENLKSILKPNYEVGCKRILISNDYYPALQLPNVEVVAQDIKGINQNQIITKEGREYPVDTLIFATGFDTKLLSSIKIVGLNNQLLQDKWQDGAEAYKGIMIPEFPNLFMLYGPNTNTGTQSIIFMVECQVNYIISCIKMMQNKSQKYLDVKPDINSEYNQKLQVAASQTVWNSGCSSWYKTKTGKIVNNWPFSTVRYWLTTSQADPKDFNFS

SEQ ID NO: 12405 - protein, 388 aa, Aspergillus oryzae
MSKMWEVDPETKAKLLQISKTNGNDKCCDCGAPSPQWASPKFGIFICLNCAGTHRGLGVHISFVRSITMDAFKIAEIQRMELGGNEPWKSFFDDHIVTQSEGRTFEDSTIKERYEGEVGEEWKERLSAKVEGREYVPGQKPPQPKRNPTVEAASSRSSTPLGRASPASHDGFGGMDGGRKERNEAYFAKLGSENATRSDSVPPSQGGKFTGFGGGVPVSSGPSRNTSGGNIPGFDDFQKDPMAALTKGFGWFTSTVGKGAKTVNDSYIQPTAKSIAESDFAAQARQHAAQFGQTVQVGARGAAGQFQRFVEGPDENSAGRRRAEPERKDFWDDFSSLAQEDNHRRNASRSSAIGTAAMKPSPTSNTSAATGNASSTAAKEKDDWDNDW

SEQ ID NO: 12406 - protein, 638 aa, Trichodesmium erythraeum IMS101
MIETKRAIVVGAGSSGLIAAKELLDTGLDLTILEKEASLGGVWHKYCWKTSTLTSSKWMTEYGCYPAPKEYADFMKPEEMMEYLSSFTKHYGLEDKVHFGVQVKAIARSTDGKYDVITDGETYSGYDYVVISTGLHGEPVIRDVPGIEKFTGTIMHGFKYKDPEAFRDKKVVCMGLGESGIGISSEISSVAAKTVVAAGNFNFAPRVYPYSNKPFDQIQFWPMGQYIKDYQELLSAQMSWITRLPEPLRTAYANMHPWLRDLPKEWLPTAYVPHYWAGKYWPKPNNNFGDMSGNLTRPSTAPDDIIYLVHSGKITAKGKVERFDETGVYFPDGTREEVDMVVANTGFKPGAALIEFPDNWQYRHQELYKGCLHPDMPNLAFVGFVRPTIGSIPAMAEMQSRFVAQVFSGGYKLPEKEKLKKLIKKEADAHARKNPKMTERWPHIYFFDQWMEEMAELLGTQPKIWQHLSSWKQLQGFLFGAPMPIRFRQYGSGVVAGAKERYADRINQLYGTRPQSYIIPYLTISLFFPYILSLIISAVCYWGANLSPLISIGSGLLFYTLYMTVDLFRFVVGFLPITLPSLMALEQSLPWRNCDNDSMMFLMSFPEKDRMNYANPRVFENDGLPKSELLDREIAVKN

SEQ ID NO: 12407 - protein, 249 aa, Paracoccidioides brasiliensis
MPRKFFVGGNFKMNGTAKSITHIITNLNSAKLDPSTEIVIAPPAIYLVLARQLANGQVAVSAQNVFDKPNGAFTGELSVEQLRDEKITWTLAGHSERRVLLREDDEFVARKTKAAINGGLNVILCIGESLEEREAGKTIDVVTRQLDAVAEEVSPAEWNKVVIAYEPIWAIGTGKVATTEQAQEVHASIRKWLNEKISPEAAENTRVIYGGSVTESNCRDLAAQPDVDGFLVGGASLKPAFVDIINARL

SEQ ID NO: 12408 - protein, 1113 aa, Candida glabrata CBS 138
MTITAQENSISAFTLKDKYNPQLVQGVNKVLIVGSGGLSIGQAGEFDYSGSQAIKALKESKIETILINPNIATNQTSHSLADKIYYLPVTPEYITYIIEKDRPDAILLTFGGQTALNCGIHLDETGILAKFNVKVLGTPIKTLITSEDRDLFASALKEIDIPIAESIACENIDDVLSAASTIGYPVIIRSAYALGGLGSGFANNPEELKELASQSLSLAPQVLVEKSLRGWKEVEYEVVRDRENNCITVCNMENFDPLGVHTGDSIVFAPSQTLSDEEFHMLRSAAIKIIRHLGVVGECNVQYALSPNSLDYRVIEVNARLSRSSALASKATGYPLAYTAAKIALGYTLPELPNPITKTTVANFEPSLDYIVAKIPKWDLSKFQYVNRSIGSAMKSVGEVMAIGRNYEEAFQKALRQVDPSIIGFQGSDEFGDQLDDVLANPTDRRIFAVGQALIFENYSVDKVHDLSKIDKWFLYKCMNIVNIYKELMKLVDISQLLENSLLLRAKKLGFSDKQIAITLTKYAGISSKELDIRTLRKAHNITPYVKRIDTLAAEFPAQTNYLYTTYNATKHDITFDDHGMLVLGSGVYRIGSSVEFDWCAVNTAKALREQNYKTIMINYNPETVSTDFDEVDRLYFEELSYERVLDIYELEQSEGCIVSMGGQLPQNIALSLYEYGCKILGTSPKDIDNAENRHKFSSILDSINVGQPEWKELTSVEEAKTFANKVSYPVLIRPSYVLSGAAMSVVNNEHELEDKLTLASDVSPDHPVVMSKFIQGAQEIDVDAVACNGELLVHAISEHVEDAGVHSGDATLILPPQHLSENVKSQLKTIAKKVAKAWNITGPFNMQVIKAGENDLKVIECNIRASRSFPFVSKVLGVNFIEVAVKSYLGGEHVPEPVDLMAKHYDYVATKAPQFSFTRLAGADPYLGVEMASTGEVASFGRNELESYWTAIQSTMNFQVPLPPCGILLGGDLSNDKLGNVAKVIAPLGYNLYCTHKESQIYFKKFNVDTAIIEFPKNDKKRLGELFQKYKIKTVVNLAAKRADNTDDEDYIMRRNAIDFGIPLFNEPNTSALFAKALSAKLSEKITTLTSKDIAIPTEVQSWDEFVGFKVM

SEQ ID NO: 12409 - protein, 273 aa, Triticum aestivum
  misc_feature (61)..(61): Xaa can be any naturally occurring amino acid
  misc_feature (69)..(69): Xaa can be any naturally occurring amino acid
VNLKPGRRRKGRGPTQDSPELSNQTPRCGPSTRAVAKGRNGSPTTPRAARCEGQQFSRGTXNFQGFAGXGNGSSGGGCVDGKIRLYSRSSMRMAKTVFPGLGSPITHVDVTYDGKWILGTTDTYLVLICTIFKDKDGKEKTGFSGRMGSRIAAPRLLKLSPLDSILAGNDNKFHGGQFSWVTENGKQEKHLVATVGKFSLIWNFQKVKDSNHHCYRDQEGLKSCYCYKVVLKEESIVDSRFMHENFAGSDSPEAPLVVATPMKVSSFSIASKR

SEQ ID NO: 12410 - protein, 327 aa, Nostoc punctiforme PCC 73102
MAETLFFNALREAIDEEMARDSSVFVLGEDVGHYGGSYKVTKDLYQKYGELRILDTPIAENSFTGMAVGAAMTGLRPIIEGMNMGFLLLAFNQISNNAGMLRYTSGGNFKIPMVIRGPGGVGRQLGAEHSQRLETYFQAVPGLKIVACSTPRNAKGLLKSAIRDDNPVLFFEHVLLYNLKEDLPEEEYLLPLDKAEVVRQGKDVTIITYSRMRHHVLQAVKTLEKQGYDPEVIDLISLKPLDFDTIGASVRKTHKVIVVEESMRTAGIGAEVIASINDRLFDELDAPVLRLSSQDIPTPYNGNLERLTIIQPEQIVEAVEKMVALRV

SEQ ID NO: 12411 - protein, 342 aa, Medicago truncatula
LQKAPPMISRKTFEYICSLVKDDIAKKSSHFSFSNGKPVSLTDQVAVALRRLGSGDSFVTIGDSFGLSHSTVSQVTWRFVESMEERGLHHLQWPSTQEEMNSIKSKFEKIQGFPNCCGAVDVTHITMLLPATEQSSDVWLDHKNNHSMVLQAIVDPDMKFRDIVTGWPGKMEDWSIFESSNFNKLCDNGERLNGKKLKLSKGSEIREYIIGDSGYPQLPYLVVPYEEKEILESEPKAKFNKLHLETRMVAQRALTRLKEMWKIIRGKMWRPDKHRLPRIILVCCILHNIVIDMQDEVNDELLCFYRNNHDSGYHQLVYEGFDEKGVALRESLSHYLTGRLHT

SEQ ID NO: 12412 - protein, 473 aa, Trichodesmium erythraeum IMS101
MVKTAQDVLNWIKSQDIQVIDLKFIDLPGIWQHLTVHQSQIDESSFTDGVAFDGSSIRGWKSINESDMMMVLDPTTAWIEPFMAEPTLSITCSIKEPRTGEWYSRCPRVIAQKAVDFLKTQGIGDTVYFGPEAEFFVFEDARFDQTENKAYYYVDSIEGRWNSGREEDGGNKAYKPDYKGGYFPVPPTDTMQDLRTEMLLTMAKCGVPIEKHHHEVATGGQNELGFRFGKLVEAADNLMIYKYVIKNVGRKYGKTITFMPKPIFNDNGSGMHVHQSIWKDGEPLFWGDGYANLSKMALHYIGGILKHAPAILGFSNPSTNSYKRLVPGFEAPVNLAYSQGNRSASVRIPLTGTNPKAKRLEFRCPDATCNPYLAFAAMLCAGIDGILNEIDPGPSLDVDIYDLSPEELSKIPSTPGSLEGALEALEKDHEFLTAGGVFTEDLIQTWIDYKMENEVKPMRLRPHPYEFSMYYDC

SEQ ID NO: 12413 - protein, 121 aa, Glycine max
  misc_feature (74)..(74): Xaa can be any naturally occurring amino acid
  misc_feature (92)..(92): Xaa can be any naturally occurring amino acid
HAYVSSEFGSSSALIAAGGSDPVLRIWDPRKPGTSAPVFQFASHTSWVSACKWHDQSWFHLLSASYDGKVMLWXLRLGWLLSVIESHSDKVXLSADWWKSDSVISGGADSKLCISSEIPVQ

SEQ ID NO: 12414 - protein, 399 aa, Oryza sativa (indica cultivar-group)
MEPSRRLLLSDYDGAIVSPLPSPPPSSATPFRPGVAVVVGILTSVFSITFLLLLYAKHCKRSAAESSGPYGSGGAFGSSGGGGAGERRNSGVDRAVVESLPVFRFGALRGQKAGLECAVCLGRFEPTEALRLLPKCRHGFHVECVDTWLDAHSTCPLCRSRVDPEDVLLLPEPPKPSTTGPPDPPETKVAAAAAAAATAKDKEASLAPAAPAPSPAFRGFFSGRHSTGSVRAPGRVGPASRRSADLVGGDGGAVVGCFEAAKVRKDRVLLMEPAAAVAEPDPEAYDRRFGHRILVSTAGGCEDETAPAAKQRWSEVRPSDLMFVRSEMLVTEAGRYSCSAAVHSGNGRSVISARSLSELAGVSRLPPIRAGGEPRAGARRWPGSSWWARGPPALNGPST

SEQ ID NO: 12415 - protein, 359 aa, Prochlorococcus marinus str. NATL2A
MTKLPKLSSNSSLLGLSSEDLEEFARQEGEKSFRGRQIHEWIYQRGAKSLDSISVLPKKWRDSLVRKGIQIGRLDEINRVVAEDETLKLLMGTFDGEIVETVGIPTDKRLTVCVSSQIGCPMGCKFCATGKGGLNRSLDVNEIVDQVISVRETMNRRPTHVVFMGMGEPLLNIRNVLDSIECLTSDIGIGQRKITVSTVGIPNTLSDLAKLAQDRLGRVKFTLAVSLHAPNQTLRELIIPSASSYPINSLLKDCKKYIELTGRRVSFEYILLGGLNDKDIHAEQLANLMRGFQSHVNLIAYNPIAEENFKRPSQSRVNAFRELLENRGVAVSVRASRGRDKDAACGQLRRQTIDKIKIN

SEQ ID NO: 12416 - protein, 735 aa, Coprinopsis cinerea okayama7#130
MAARKLQSEIDRTLKKVAEGVELFESIYEKMQASTNQTQKEKQEMDLKTQIKKLQRQRDQIKTWVASNDIKDKTILLENRRLIETQMEKFKACEKEMKTKAFSKEGLIQAAKLDPKEQEKEDAMQWLQQQVEELQMQVESTEAEVESLQSTGKKKNKAGANALGRLEELEHLNERRKWHISRLELVLRLLNNGSLTAEKVNSLKEDVQYFVSNNSDDDFEEDDGIYEELNLDEAEGEFGLVADDGDSSESEDASEPDVPPPKSSKKQQQQHDDDNTSHSKQHDSPILKKAGVSLAMRKHSVDTKPPPNINLSQQPMSSVLKSGLSQPAPRPTPPTLPPIRYAAAAAAAVNSHPPSSASAHPPSTAPVTPALAPAHASSASPAVPPSVAAVSQDQQSASSPSLTQQSAASPALSSAVSASQAPEGSSRSGQPSPALSKAIPTSGTKQALASPQRDTVNRKESVSVASPQVPKQAPASQPQATSNEATQPPAASAAPATPAQQPPTTGPSPLPQQLGTPVLSPGVKVAEQQQVLQQQQQPPAQSFPSQPIGGQRPPSAAQVAPTSARPASAFPGSLSDLVVSFESVKQKAALRMNNMEQVHKMLEGGLINVPQPQDTDKPKYYTPRNPFPTPSYYPQTPHAALGTPAIFSQLDVETLFYIFYYLPGTYQQYLAAKELKRQSWRFHVKYLTWFQRHSEPQAITEEYEQGVYVYFDWEGSWCQRKKSDFRFEYRYLSED

SEQ ID NO: 12417 - protein, 248 aa, Zygosaccharomyces bailii
MARTFFVGGNFKLNGTKSSIKEIVERLNNAKLDPKVEVVLCPPAPYLDYTVSLVKKSQVSVGAQNAYLKASGAFTGENSVDQIKDVGAKWVILGHSERRQYFREDDQLIAEKTAFALSQGVGVILCIGETLDQKKAGTTLQVVERQLQAVIDKVKDWSNVVIAYEPVWAIGTGLAATPEDAQEIHHSIREFLAKKLGEKTAQETRILYGGSANGKNAVTFKDKPDVDGFLVGGASLKPEFVDIINSRS

SEQ ID NO: 12418 - protein, 251 aa, Aspergillus oryzae
MPRQFFVGGNFKMNGTAESITAIIKNLNEAKLDETTEVVVSPPALYLTLAQQVADEKKKVAVSSQNVFDKPNGAFTGEISVSQLQDAKIPWTIIGHSERRVILKETDEFIARKVKAAIDGGISVIFCIGETLEEREADKTIEVVTKQLNAAAKELTKEQWSKVVIAYEPVWAIGTGKVATTQQAQEVHAAIRKWLADAISPEASENTRIIYGGSVSEKNCRELAQERDVDGFLVGGASLKPAFVDIINARL

SEQ ID NO: 12419 - protein, 447 aa, Methylobacillus flagellatus KT
MKYQSAHDFLAVVAQKNPGQPEFLQAVTEVVESLWPFISANPRYAEHGILDRLVEPERAILFRVSWVDDKGEVQVNRGYRIQHNGAIGPYKGGLRFHPSVNLSILKFLAFEQTFKNALTTLPMGGGKGGADFDPKGKSNGEVMRFCQAFISELFRHVGSDTDVPAGDIGVGAREIGFMTGMIKKLTNRADCVLTGKGLSYGGSLIRPEATGYGTVYFAEEMLRHSGRTIAGMRVAVSGSGNVAQYAIEKALALGAKVITASDSSGTVIDEAGFTAEKLQILMQVKNVEYGRIKDYAERVGALYVPGGSPWSVKAEVALPCATQNELTKADAATLIANGVLCVAEGANMPCTAEAMKLFDEHHILYAPGKATNAGGVATSGLEMTQNAMRLSWTREEVDARLFDIMKGIHDACVQYGTREDGSVNYVDGANIAGFVKVAEAMLAQGVV

SEQ ID NO: 12420 - protein, 497 aa, Salmonella typhimurium LT2
MKTQTTHAAEQHAAKRRWLNAHEEGYHKAMGNRQVQMIAIGGAIGTGLFLGAGARLQMAGPALALVYLICGIFSFFILRALGELVLHRPSSGSFVSYAREFLGEKAAYVAGWMYFINWAMTGIVDITAVALYMHYWGAFGDVPQWVFALGALTIVGTMNMIGVKWFAEMEFWFALIKVLAIVIFLVVGTIFLGTGQPLEGNATGFHLITDNGGFFPHGLLPALVLIQGVVFAFASIELVGTAAGECKDPQKMVPKAINSVIWRIGLFYVGSVVLLVLLLPWNAYQAGQSPFVTFFSKLGVPYIGSIMNIVVLTAALSSLNSGLYCTGRILRSMSMGGSAPKFMAKMSRQHVPYAGILATLVVYVVGVFLNYLVPSRVFEIVLNFASLGIIASWAFIMVCQMRLRQAIKEGKAADVSFKLPGAPFTSWLTLLFLLSVLVLMAFDYPNGTYTIASLPLIAILLVAGWFGVRRRVAEIHRTAPVTADSTESVVLKEEAAT

SEQ ID NO: 12421 - protein, 236 aa, Prochlorococcus marinus str. NATL2A
MDLQNQMKKAVAQAAVDQIQNGMILGLGSGSTAALMIEALAIKIKSGEIKDVVGVTTSFQGEVLASELGIPLKSLSSVSEIDLAIDGADEVNPKFQLIKGGGACHVQEKLVAALAKKFIVVVDSTKLVEKLNLDFKLPVEVLPSAWKQVQKTLINLGGEGNLRMAQKKAGPIVTDQGNLILDLTFRNGIDKPELLESQINNIPGVLENGLFVNLTDEVLVGKVESDVVGVESLKKI

SEQ ID NO: 12422 - protein, 1076 aa, Candida glabrata CBS 138
MADRISVTPAQQFRKEHKSVQYQLRQIIGRGSYGVVYKATNKKTAQEVAIKEVNYQDDDELVDIMSEIDLLKNLNHINIVKYHGFIQKQHNLYIILEYCAKGSLKNLISRNRPMSEHEAKPYVRQTLNGLNYLHEQGVIHRDIKAANILLDSENVVKLADFGVSTKVNNTAMTLAGSLNWMAPEIIGNRGASTLSDIWSLGATVVELLTGNPPFHNLIDMNIYYAIENDSYFPPSSLSSGAKDFLQQCFAKNMYKRPTAVQLLQHNWLENDNSKDSTMDKQVIPSVEKLNLYQEKFEDSDLCWDDDFEEKDLNLSSPSKKDLVKTKIPSDEFIPDVFNISEVNQGNQGNQGNQGNQGNQGNQGNQGNDPIKNEQARSNNNIVIQSQLERSSTPFTMDRNKGNADFLQNSSLDEDNLLQIVKSGKSIENVDYFFQKCSIDMLALTLIELTMNKKDMIREHLAPSNHELNLYKFFEYDEKKNKSKLKRKFIQLGGLPSLFHYEKLLSIFFVDDFVDDLIRAGIIPYVRDYKNGSLVLSIINKHMELMSIQSWCKWCNFNLPIDIILENLIARKAQSILLKISTYGSKEFKLEILKNIVNYNYNSSNQKILLDSQVMYVIFKSVFYILRSLHLNSGTSNNSAMLLNFHSHHISTTGSNTGNTPSLSSSPTKSPVSSWKTQSPPLSPTRTLSGKSQGYPSGVSNPPNALSSNNNGFIVPENVFLWMEEFLRSKYFCSLMDIHVWKYFNRAFYYTTYNNKPRLLKLLADDCYTRFCIRVADTVSDKNGRQVMGQASLVLMRMSNELLSSLHNNQILSGNKKISISPSLITIATKFLGKREFIYEGIEIVLNCIQFISHQNEDTGNVNTFNRRGNQRNRNGERLMVLHSDKLLFSEENVLVDMNDIVDCFFIFPENDSNFGNYVVKFMKLCMVQQLEYVCQRIVLKEQFYERIVAFFGFYCNSLLIQIDLLKLVKTLFTRALHSNNERSNILDSLKTLLAFLSENWDPLKGNNKGQVGYNSVLIKQLCSDIAALLSYRPNTKRSNGLDHLGVSQFALDKNITSSGPVVDRGRLPVPRPEFNT

SEQ ID NO: 12423 - protein, 136 aa, Craterostigma plantagineum
MARTKQTARKSTGGKAPRKQLATKAARKSAPSSGGVKKPHRYRPGTVALREIRRYQKSTELLIRKLPFQRLVREIAQDFKTDLRFQSAAVGALQEAAEAYLVGLFEDTNLCAIHAKRVTIMPKDIQLARRIRGERA

SEQ ID NO: 12424 - protein, 447 aa, Oryza sativa (japonica cultivar-group)
MGQLKRRRFNLKPILYPKPLSKGFELKLPDSGPSAQYIETCLTRIEYFSFRNSVLIYQTNRELSVAKRLEKFKTTIFTQMSMLAIKHGAINLGQGFPNFDGPDFVKEAAIQAINAGKNQYARGYGVPELNSAIAERFLKDSGLQVDPEKEVTVTSGCTEAIAATILGLINPGDEVILFAPFYDSYEATLSMAGANVKAITLRPPDFSVPLEELKAAVSKNTRAIMINTPHNPTGKMFTREELEFIATLCKENDVLLFADEVYDKLAFEADHISMASIPGMYERTVTMNSLGKTFSLTGWKIGWAIAPPHLTWGVRQAHSFLTFATCTPMQAAAAAALRAPDSYYEELRRDYGAKKALLVNGLKDAGFIVYPSSGTYFVMVDHTPFGFDNDIEFCEYLIREVGVVAIPPSVFYLNPEDGKNLVRFTFCKDDETLRAAVERMKTKLRKK

SEQ ID NO: 12425 - protein, 319 aa, Medicago truncatula
MHPSSLNIPPQYMLGSSSIPFNSLTENNAEVPPQSWSQLLFTGLPGEEERLGFNHFQPKNSENWDVQIMNPSSRVPFMDIIKHEVSQGENFYGQQGHHHEEFHANSGSLGSSWSHMVPVSSPSSHITSLSSDNILDFTYNKVDHSKNQLPDQISECNSSTTGVNKKARVQPSSSQPPLKVRKEKLGDRITALHQLVSPFGKTDTASVLLEAIGYIRFLQSQIEALSTPYLDTAASKNMMRNQHSVHVERNSVFPEDPGQLLDDTGLKRKGAPIPNQNAEGNKAKDLRSRGLCLVPVSCTQHVGSENGADYWAPAFGSGF

SEQ ID NO: 12426 - protein, 389 aa, Kineococcus radiotolerans SRS30216
MRALVWNGVNDLAVETVADPTVLNPHDVVLKVSLTTTCGSDLHFIDGYLPGMQPGDVFGHEFMGVVVEVGPEVRSTAVGDRVVVPSFIACGTCAYCKREMYSLCDTTNPNGALQQPLLGYPSGGIYGYTHPFGGYAGSHAEYVRVPFGDVNCFPVPEGVDDVSALFTSDAVPTGFMGADFCDITPGDTVAVFGAGAVGLMAAASARLLGAERVIVVDRLASRLTLARDRIGAETIDYSEVDSVQEVLRESTGGRGPDAVIEAVGMEGHGTGLQNVVDRAKQAVRLETDRATPLREAVLACRKGGVVSILGVYGLTDSFPTGVVLNKGLTIKAAQQHGQRYVPRLLAHLAAGELDTSFLATHRMSLEDSVEGYRIFKEKEDDCLRAVFQP

SEQ ID NO: 12427 - protein, 503 aa, Oryza sativa (indica cultivar-group)
MGAPLKLTWASLGSLFATAVLVRTAVRDFLPPEAHGLLRALLSRAAAALVPPCDAIIVHETDANGVPNELYEAAQLYLGARCLAMAPAMHLHKTHGAAAAVASLPDSHATLDAFRGVRVLWTSQLDGNASSSFGGSSSSSRGFVHHPFPIGGRQRCLRLEFRRRDRDVVRDAYIPFVLEEAAALRAKMRERKLYTNNSGFYGGGGGGMDDHQMLWKAHKFSHPSTFDSLAIDPALRDDIRADLLRFVRSREHYARAGRAWKRGYLLHGPPGTGKTSLVAAIANLLEFDIYDLELTTVTSNYDLRRLLASTRPKSVIVVEDVDCSLGLFDRTRAPAPPSSQDDDADADEQRNRAMLQHALTLLPPAVEAAMQRETISLSGVLNFVDGLWSSCVGERLVVFTTNHMDRLDPALLRPGRMDRKVELGYCKAPALRVLAKNYLGDDDADDHDEIMGEAGRLLEEVQVTPADVAEVFMGCDGDDGAHDALQKFVDELNARKEKMNGPK

SEQ ID NO: 12428 - protein, 620 aa, Candida albicans
MSEQAQPQASADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYMPAPEVISGKLYAGPEVDVWSAGVILYVMLCGRLPFDDEFIPALFKKISNGVYTLPNYLSAGAKHLLTRMLVVNPLNRITIHEIMEDDWFKQDMPDYLLPPDLSKNKNSKIDVDEDVIRALSVTMGYDRDCKIVNVIEKANKQVAAGNSSSQQSKSSNEILDAYLLMKENHALVKDLKKSKSENIESFLSQSPPPSPFPNRGSTSSAPGVQQSLTYQTLATVPDLSTLPNSTIAILPTSLPSIHRAYMAETKQNGDPSQQHAPPPTKKSKTRWHFGIRSRSYPLDVMGEIYRALKNLGAEWAKPTEEELWTIRVRWKYDTSAQFECGSAPNLMKMQIQLFQLEPNNYLVSFKFSGWESAHGNAGTDSPQSHRQQDLDEVGSFSAYPFLHLATRLIMELAVNSQSG

SEQ ID NO: 12429 - protein, 400 aa, Dehalococcoides sp. CBDB1
MKAVILAAGEGSRMRPLTFTRPKVMLPIAGKPILEHLLMEVSAAGIKEFVLVVGYRDEQVRSYFADGAKWGVKISYCQQTRQLGTAHALKQLENQLEGNFLVMNGDILAESADISALAAGSETTLSVLEVSDPSSLGVLETDGDRVRCIHEKSANPPANLANAGLYLFTPRIFKAISDTPLSPRGEYEITSSIQLLIDNGTEVGYRRLVYWQDVSYPWDLLDVNASMLKNLAPCVYGTVEENVVIKGTVEIGEGSLVRSGAYIEGPVLIGKNCDIGPNCYIRPSTSIGDNCRVGASVEIKNSIIMDNTKIPHLNYVGDSVIGQNCNLGAGTKLANLRFDGADIIAGGVNTRRRKLGAVLGDGVETGINVSLNPGVLIGSGSRIGPGAVVSGLVEPNSYIG

SEQ ID NO: 12430 - protein, 188 aa, Triticum aestivum
MLAIASPPSNARAMAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDSTHVLSEVEEVNKEYPDAYVRVIGFDNMRQVQCVSFIAFRPPGCEESGKA

SEQ ID NO: 12431 - protein, 293 aa, Triticum aestivum
  misc_feature (47)..(47): Xaa can be any naturally occurring amino acid
HYRTSLYKKAGWYRSGIPGISSTHASGLNSLSTDLQMFAHKTLRIPXPGGGHPPPPFQQNGSRECDDRECTPRRLHDDLLDSVLRTPRHKVSPAMSLLQGYYGLTPPPKRNPTQERTEIAVYGKCKSISLVDEPWSAETPNPNTFMFEHRKPRSQTIGSLVNGESEENGDGERPVRRRPKADGELLPKEENGSALLSRAGKGLALRPKSGTRPDMNKSHQNLIAMSEPSFDGGLQTVKKSSSTPEFQEPESNSSSSSIWSASKWSLKPDAFALPLFDSIPKPIAAWKNKAARD

SEQ ID NO: 12432 - protein, 434 aa, Dehalococcoides sp. CBDB1
MEPRIQVFPKNTEVKNNHLIIGGVDVAGLCAKYGTPLYIFDELTIRQNCRDFKREFSRRYADSSISYASKAFLHPALLKILAEEGMSLDVVSGGELSVANNAGFPMDMVYLHGNNKSAEELRLALRLHVGRIVVDSFDEIKLLSKLADESGHIPDILLRITPGVDAHTHQHITTGKLDSKFGFPLFQAAEAVGLAMAQASLNLVGFHFHIGSQIFETQPFLDAIDLVLDFAAQVQERYGFDIEELDIGGGYGVQYEVDKPAPPISAYAEAIGAKVVSKCRSLKLTPPSLNIEPGRAIIAQAGVALYTVGVIKDIPGIRLYASVDGGMGDNIRPALYEAKYEAVVANNVQSAEKEKVTIAGKFCESGDILIRDIELPSLRTGDILAVPCCGAYCLPMSSNYNGYHRPAVVMLKNGEDRLIRRRETVEDLSRLDSV

SEQ ID NO: 12433 - protein, 113 aa, Arabidopsis thaliana
IKGLKYPEDPDKKAYALRYIGSMVADIHRTLLYGGVFIYPADAKSPDGKLRLLYEAAPMAFLIHHAGGKSTTGKEDILDVMPTGIHQRVPVYMGSPEDVADFEAVHAKINNTV

SEQ ID NO: 12434 - protein, 356 aa, Salmonella typhimurium LT2
MMDYARHEENRMKQQTNRNRRWVLASRPHGAPQMDNFRLEEDDVATPGEGQVLLRTVFLSLDPYMRGRMSDEPSYAPPVEPGCVMVGGTVSRVVASNHPDYRPDEWVLSYNGWQDYDISDGEGLVKLGDNPQHPSWSLGILGMPGFTAYMGLLDIGQPKEGETLVVAAATGPVGATVGQIGKLKGCRVVGIAGGAEKCRHATDVLGFDLCLDHHADNFPQQLAQACPQGIDIYYENVGGKVFDAVLPLLNTSARIPLCGLVSGYNATALPDGPDRLPLLMATLLKKRIRLQGFIINQDYGHRIHEFQQEMGRWIKEGKIHYREQITDGLENAPEAFMGLLAGKNFGKVVIRLADDA

SEQ ID NO: 12435 - protein, 507 aa, Oryza sativa (japonica cultivar-group)
MGSTGDCGNGKAAAGGGGLVVPEIKFTKLFINGEFVDAASGKTFKTRDPRTGDVLAHIAEADKADVDLAVKAAREAFEHGKWPRMSGYERSRVMNKLADLVEQHADELAALDGADAGKLLTLGKIIDMPAAAQMMRYYAGAADKIHGESLRVAGKYQGYTLREPIGVVGVIIPWNFPTMMFFLKVSPALAAGCTIVVKPAEQTPLSALYYAHLAKLAGVPDGVINVVPGFGPTAGAALSSHMDVDSVAFTGSAEIGRAIMESAARSNLKNVSLELGGKSPMIVFDDADVDMAVSLSSLAVFFNKGEICVAGSRVYVQEGIYDEFVKKAVEAAKNWKVGDPFDAATNMGPQVDKVQFERVLKYIEIGKNEGATLLTGGKPTGDKGYYIEPTIFVDVKEEMTIAQEEIFGPVMSLMKFKTVEEAIEKANCTKYGLAAGIVTKNLNIANMVSRSVRAGTVWVNCYFAFDPDAPFGGYKMSGFGRDQGMVAMDKYLQVKTVITAVPDSPWY

SEQ ID NO: 12436 - protein, 376 aa, Solanum tuberosum
HIITAVIGSGVLSLAWATAQLGWVAGPTVLLLFFFVTYYTSALLSDCYRTGDPVTGKRNYTYMDAVRANLGGFQVKICGVIQYANLFGVAIGYTIAASISMVAVNRSNCFHKQGHRAACNVSSTPYMIIFGVMEIIFSQIPDFDQISWLSIVAAVMSFTYSTIGLGLGVAQVAETGKIEGSLTGISIGTEVTEMQKIWRSFQALGAIAFAYSYSLILIEIQDTLKSPPAEAKTMKRATLISVAVTTVFYMLCGCFGYAAFGDQSPGNLLTGFGFYNPYWLLDIANVAIVVHLVGAYQVYCQPLFAFVEKTATEWYPDSKIITKEIDVPIPGFKPFKLNLFRLVWRTIFVIITTVISMLMPFFNDVVGILGAFGFWP

SEQ ID NO: 12437 - protein, 740 aa, Nostoc punctiforme PCC 73102
MLPKPKKYWTPQHWASWKPFGIGEQYPNNYWEVFRAIWLSRDKLPYAWNILDKGVCDGCALGTTGMKDWTLDGIHLCNVRLRLLRMNTMPAFDPVLLEDVSQLQKQKSAQLRDLGRLPFPMMRQRGEKGFRRISWDEALGIISDRIRATTPDRLSFYITSRGTVNETYYATQKAVRAMGSNNIDNAARICHSPSTAGLKAALGAGATTCSYKDWIGTDLLIFIGSNVANNQPVTVKYLHYAKKAGTKIVVINTYREPGMERYWVPSIVESAVFGTKFAEDFFLINMGGDIAFLNGTIKHIIANNWVDQSFIDIHTVGFAELKTSLESQSWEELERLSGTCREQMYAFAKMVKEANKAVFVWSMGITQHECGEDNVRSIINLALTKGFVGREGCGLMPIRGHSGVQGGAEMGCYATVFPGGKPITPENAAQLSQHWGFDVPASKGLIAPEMINAAYQAELDVLFSVGGNFLEVLPEPDYVEAALKKIPLRVHTDIVLSSQMLVEPADIVVLLPATTRYEIPGGVTETNTERRVIFSPEIPGPRIGEARPEWEVFLELARRVQPDLADKLAFADTSAIRQEIAQVVPQYAGIQHLQQPGDQFQYGGSHLCFGWNFPTSDGKAHFGVLLPRQRELPEGYFLVATRRGKQFNSMVQERKDAITGAVREAVLINAADAALLDLKDGDKVILKNELGELFCEVYIAPIQSGNLQVHWPEGNVLLDKSKRSLEGAPDYNAIARLEKI

SEQ ID NO: 12438 - protein, 635 aa, Candida glabrata CBS 138
MNSVAYSSIRYLPLLLRYGRALPLLNNPHALEQEHHESESDLVYYGVVSMFLVVLGGVFAGLTLGLMGQDEIYLTVINTSGTQKEKQLSGKVLRLISRGKHWVLVTLLLSNVITNETLPIVLDRCLNGGWQAVISSTILIVVFGEIIPQSICVKYGLEVGAFFAPFVLVLMYLMYPVAYPIALLLDYILGEDHGTVYKKSGLKTLVTLHQTMGVERLTTDEVTIISAVLDLKDKKVKEIMTPIENVFTLSADKILDEKTIEEIFNSGFSRIPIHLPNEPMNFIGMLIVRILISYDPEDALPISSFPLATLPETSPNTSCLNILNYFQEGKSHMCIVSERPGSSNGSIGVVTLEDVIEELIGEEIVDESDVFVDIHQHIMREQPGPLSKRHVTSYLHHLYTTSSKDSCVPLLNSKLNNYSSINEHKPVNHSHPPNLPNGSQLQLAPSNLASNPLDIKKSFVTIKKLPPGELISPSNKDYSNEHLRLNEQQGENRRLSQGEQQLLQEHANLSHKAIDYTQSSGKPIRITSSTTTHDPNENGTEDSAKNVLISSSYQSTANGIVESVITVKGVAKTIIEDDQSVYHDNHEIQHDISKMNSSTDLLLADHDEKSRSSTPVSDNGKKKKKSKKKKRRSKK

SEQ ID NO: 12439 - protein, 327 aa, Oryza sativa
  misc_feature (138)..(138): Xaa can be any naturally occurring amino acid
  misc_feature (259)..(259): Xaa can be any naturally occurring amino acid
MSALYLARGASKVVRRITSETSVELKILTEKWQLLLAGLVFQYIHGLAARGVHYLHRAVANLQDLGFMILPELGKDRGYISETLFTFIFLSFVLWTFHPFILQTKRFYTVLIWRRVLAFLCVSVSIYVDLLHVIQCYXRISDAYCISQASPFLRIVTFYSTQLPGPNYHCREGSALARLPHPQNVAEVLLINFPRGVIYGCGDLIFSSHMIFTIVFVVTYQKYGNIRFIKMLAWCIAIAQSLLIIASRKHYSVDVVVAXLTELPDRSAGSTSVLPVSIKEKDSKLKEDKTRMLNGNSVDSADWRPWTQMNGKHIENGNHLDTETTKT

SEQ ID NO: 12440 - protein, 279 aa, Arabidopsis thaliana
MNVERDQHISPPCLLTKKIPIVDLSDPSDELVAHAVVKASEEWGIFQLVNHGIPAELMRRLQEVGRQFFELPASEKESVTRPADSQDIEGFFSKDPKKLKAWDDHLIHNIWPPSSINYRYWPNNPSDYREVTKEYTRNVTNLTEKIVGYLSKGLGLRPIGAPAHTDFCGLALLVSNEVPGLQVFKDDHWFDVEYINSAVIVLIGDQIMRMSNGKYKNVLHRSIMDAKKTRMSWPILVEPKRGLVVGPLPELTGDENPPKFESLTFEDYVYRKIIKVLRD

SEQ ID NO: 12441 - protein, 144 aa, Triticum aestivum
  misc_feature (9)..(9): Xaa can be any naturally occurring amino acid
MLHWRMLLXWEGTIHLTWSSLTNVVAIFKSGEKPSTNEWPRSLEIKKRVSLGVFEKLLGLLRESRKRTIMVTELRWKEGSIESGRHHLLKTIESYTANERVGLVKPTEEVELFLCPYQGKAAQILADNLLKELWCGQDPISHLW

SEQ ID NO: 12442 - protein, 359 aa, Zea mays
  misc_feature (294)..(294): Xaa can be any naturally occurring amino acid
MSSKDAVLNAFLSCFMHVGLALVLLVYLPAASVLRLLVRPLLANKQAEDLRGKVVLVTGASSGIGEHLVYEYARNGACVALVARTEVALRAVAKAARDLGAPDVLVVPADVTKVDDAKRAVDETLAHFGKLNHLVANAGIWSSCFFEEITNITAFHNVMDLNFWGAVYPTYFALPYLKASRGNIVVTASVAGRVPTARMSFYNASKGAVIRFYETLRAELGSHVRVTILMPGYVVSNLTKGRGLQKDGRVGVDEEARDINVGPMPVGKTESLAEVVVASVRRGDYYVTWPGWYXPFHMVMCAAPELLDWFSRAFYVSSKSGGQDGGGAALSKKILEAVGGKKFLYPQTIRCQQTTMGGS

SEQ ID NO: 12443 - protein, 86 aa, Spinacia oleracea
HNSYLTGNQLTSDCSDVPIKHALQKSVRVIELDIWPNSSKDNVDVLHGGTMTSPVELIKCLKSIKEHAFSASEYPVVITLEDHQTP

SEQ ID NO: 12444 - protein, 1276 aa, Aspergillus nidulans FGSC A4
MASPAVLRPATPASNSSDVLTPPVSQGSPATSVTEVEEQTIYTIDDLVRVRAWGDKADEPIVAYPVEGTVYKYYTPRELHNLVEAASVHYARVISQRRTSDDPVQVVGLLGPSDFEYLITLLAISRLGHTVLLLSTRIAEDAYVSLLKNTKASLLIAYPAFNGVAKKATQRTGTVLQPVLRREDYVNSTLKLPKAELDGLVENKHITWIIHSSGSTGHPKPIYQTHSGALKNYANNFGLRGFITLPLYHAHGISCLFRAVHSEKLIYMYNAELPLTGFYLHTTLQEHPDIEVLYAVPYGLKLLSESEESMKLLARLELVMFGGSSCPKPIGDKLAQNGVRLVSHYGTTETGQLMTSFRDRSDTDWDYVRPGPSLLPFIRWEEQMPGIYELCILEGWPSKVASNRPDGAYATKDLFEKHPTKENAWRYYARLDDTLVLENGEKANPLVIEGVARNHPNVGEAIAFGSNRSRLGLFLIRAEGRTDETDEQIIDSVFPAIEQCNAESPAYAYISRDMIRVLPADTVYRKTDKGTVIRSAFYRDFAEQISHVYDQEDSSGSQVFEGDELITFLRNSLLEISSSIEPSALQDSTDVFSLGVDSIQSLRLRSAILKTLNLGGQKLSQNFVFENPSIQAMADELTRLRLGRGPQQQIPIEDRMEYLIEKYSRGFKEHVPVPRDDNGEHIVVTGATGSLGAHIVAQLIRAERVRKVYCLVRASSLLSALQRVRQSLHARFLLSSLTPDEERKIVALPADLSNSVRLGLPEDVYEEIISSVTAVMHCAWSVNFNWTLESFEQPCIAATRNLVDLCLDTQGPTPANFSFCSSVSTVARTPGNWVPEALPESLSYAQSMGYAQSKLVTEHVVNRACRQTGLAARVLRVGQIVADTEHGIWNATEAIPMIFQTAETVKALPLLDDILSWTPVDTMASSIIEATLSSTAAEVMNITNPTLNHWTRDLLPLLKQAGLTFEALAKHEWLARLRSNLDPKRNPPIKLLDFFAKKYGNDSPARVLLYDTKKSQSAAPSLRNAPGLTQDFVTRFVHQFRRQVWSSTAAQSSPKNVIFLTGACGSGKSTAGLHLSTKFRITTIEGDDMHSRVSRAKMASGIPLSDSDRWEWLSHIRGAVMDRLLQPSTSAGIVVTCSALKRSYRDELRKLMYLLEDPVNVTFIHLFVGKENKTELQERLILRSKVEAHYMASTMVDSQLEALESPEEERDVVVVDAAGMKDVVLREVEEISNIEHTWDKEIAGCWEFRGCPFMRIYTGEPPKYGRRSKATSSDNP

SEQ ID NO: 12445 - protein, 481 aa, Salmonella typhimurium LT2
MTIWENAMQYQLLINGVLVDGEGERQSVYNPATGEVILEIAEASPAQVDAAVQAADNAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAVLAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 12446 - protein, 348 aa, Agrobacterium tumefaciens str. C58
MQTRVARLYSREDIRVETQDVAPPGPGEVLLAMAAGGICGSDLHYYQDGGFGPVRVREPIICGHEASGHIAALGAGVSGLAIGQLVAVNPSQPCGHCQFCLKGQPIHCLDMRFMGSAMRLPHEQGMFRDRLVVPAKQCATFSDATSPAEAACTEPLAVCLHAVAQAGDLAGAKVLVTGAGPIGLLTIAAARQAGAGIIVATDLTDAALERAPAMGADRTINVAKDADALLPYQDNKGYFDVIFDCSAAGPALRSAFACVRPRGTIVQVGVTGDVTIPLNALVGKEIVWRGSQRFHDEFAIAAGLISSRKIDVRPIISHSFPLGDAKAAFEQAGDRSAACKVQLTFSAD

SEQ ID NO: 12447 - protein, 262 aa, Triticum aestivum
  misc_feature (179)..(179): Xaa can be any naturally occurring amino acid
  misc_feature (181)..(181): Xaa can be any naturally occurring amino acid
  misc_feature (189)..(189): Xaa can be any naturally occurring amino acid
  misc_feature (199)..(200): Xaa can be any naturally occurring amino acid
  misc_feature (205)..(205): Xaa can be any naturally occurring amino acid
  misc_feature (212)..(212): Xaa can be any naturally occurring amino acid
  misc_feature (219)..(219): Xaa can be any naturally occurring amino acid
  misc_feature (223)..(223): Xaa can be any naturally occurring amino acid
  misc_feature (229)..(229): Xaa can be any naturally occurring amino acid
  misc_feature (235)..(235): Xaa can be any naturally occurring amino acid
  misc_feature (239)..(240): Xaa can be any naturally occurring amino acid
  misc_feature (244)..(244): Xaa can be any naturally occurring amino acid
MPATMPLTISPPRLLHRHHGRATLQQQRPTARLALLPRRAARLRCAPDEVAATAAEPEQQGEEEEFVLLASNRSDFNEVIMVIDSPSNRYLVLDPSRNVHSILPKKSAWTNSYWDEFVSLPPVVPRGPVALLGLGAGTAAHMMLEVWPWIQLIGWEIDPTIIELSRDYFGMSNLEKTTXLXGSLSVRIXDALSPSTTVXXGLPGXVVELISXMGKVLPXLQEXRKLWVXIAKKPXPKWXXQGKXGGGPPSPCVRFPLNKTRA

SEQ ID NO: 12448 - protein, 261 aa, Nostoc punctiforme PCC 73102
MTASSPTILALDFDGVICDGLIEYFEVAWRTYCEIWSPANDTPGDDLALRFYRLRPVIETGWEMPVLIKALVDGIPDEKIFHEWLSIAPQLLLNDKLQAREIAAKLDNQRDEWITTDLDGWLSLHRFYPGVVEKIKLTLDSGVKLYIVTTKEGRFVQQLLQQEGVNLPTAAIFGKEVKRPKYEILRELKQQAENKPVSLWFVEDRLKTLQLVQQQTDLEDVKLFLADWGYNTQAEREAAQNDLQIQVLSLSQFARDFSAWL

SEQ ID NO: 12449 - protein, 469 aa, Geobacter sulfurreducens PCA
MKKAIVAGGGISGLATAYLLKTRAAEEGLELDVTLVEREERLGGKIWSIKEEGYLCEWGPNGFLDSKPQTLDLCRELGASDLLLRSNDNARKRFIYTGGALNRLPENGPMFLKSGLISWPGKLRLAMEPFIPKKAGDEDETLAAFGRRRLGDEALRKLIAPMVSGIFAGNPETMSLRSCFPRIAELEDEYGSLVRAMIRLAKKKKQEVAQGKAVASAAGPGGVLTSFRDGIQALTDILAERLGPDTIVSGQEVLEVSRGGSLPWRVRTGSIDMDADLVILATPAYATASIIQGVDSDMAGILRQIPYATMTVVCFGYDRERIAHDLNGFGYLIPKEEGMNTLGTLWDSSIFENRAPEGQVLLRSMMGGACFPEYVNLTDEEVTGRVKNDLATIMGITAPPSFVRIFRHHQAIPQYTVGHSTRVAALEQRAASLPGLFLTGNSYRGIGLNDCVAAANRTAGEAIAQLTSR

SEQ ID NO: 12450 - protein, 427 aa, Cytophaga hutchinsonii ATCC 33406
MSLIEEIVARQIFDSRGNPTIEVDVITENGLIGRAAVPSGASTGKHEAVELRDNDKSIYMGKSVLKAVANVNDIIAPELIGSHVFEQNLIDRLMIDLDGTANKGKLGANAILGVSLALAKAAAQEAGLPLYRYVGGVSANTLPVPMMNIINGGSHADNSIDFQEFMIMPTGAKSFTEAMRMGSEIFHNLAKVLKSKGMSTNVGDEGGFAPNIASNEDALITVIQAIEAAGYRPGEDVMIAFDAASSEFYDSETKLYHFKKSTGDKLTSSQMASYWADLVKRYPIVSIEDGMDEDDWSGWAELTKLVGDKVQLVGDDLFVTNVSRLQQGIDQGIANSILVKVNQIGSLTETISAVNLAKRNSYTSVMSHRSGETEDNTIADLAVALNCGQIKTGSCSRSDRMAKYNQLLRIEEELGEAAYFPGKNMRK

SEQ ID NO: 12451 - protein, 130 aa, Methanosarcina mazei Go1
MVLLDPLANALSTIKNAEAIGKSSCIVRPASKNIGNVLKVMQDLGYIGDFEFIDDGKAGIYSVTLVGRINKCGAIKPRYSVGTGSFERWEKQFLPAKNFGALILTTSSGVMSQYEARDKKIGGQLLAYVY

SEQ ID NO: 12452 - protein, 333 aa, Kineococcus radiotolerans SRS30216
MTWIDAPAHRPRTPAPVPRHLAGISVARARARALVERPGPFDDDAVLVRDTTVRGAAGPLPARTYRPRAGGRGVVLFLHGGGWALGDLDTDDAVCRRIAADAGTAVLGLGYRLAPEHPHPAALEDASAVLRALADRGAGGVGGPGEPLAVAGAEAGAQLAAVLALRSRAGSVPPLAHQVLLCPVLDSDLTRPSHREHGHGPELTVEDLAWFWRMHVPDRAARRRPDVSPLRVPDPTGLAPATLVVAGADPLRDEGLAHAGRLTAAGVDAHRVLAGDARHGFATRPGSPDADAALRAVTDRLRPALAPAARTAAGARVIDLRAPVRVAGARSAP

SEQ ID NO: 12453 - protein, 320 aa, Oryza sativa (indica cultivar-group)
MAAGATLSVLLLVAGVVLMLVLHVVVVFWALRRGVFLRGAFRVEERRDQRAAGLTPDEIAVLPCHERKEDGGGGGGGECAVCLEAFQAGDWCRVLPRCEHGFHARCVDSWLCQSRVCPICRAEVEVSGYAGKPAAAVAEASQATTLEIVTERLGGTERLEVSNVCEVHPLDSVDRMKGDNSNVFLVAGLSLVVVVHVLVLLWALWWGYGRSRLALARARVVGQHDVARGGLSAEQVGELPCHVVKEGAGECAVCLEAFRAGDRRRVLPRCEHGFHAQCVDSWLRVSRLCPICRAEVAASRGKEGDAPVAEAASLEIVAER

SEQ ID NO: 12454 - protein, 381 aa, Candidatus Protochlamydia amoebophila UWE25
MKIKEFNWGPTLFLTIYQTLLLLSLPFYFYFTPPSLGMIGISIILLYLTGLSITAGYHRFYSHRSYRTNSFVEMLLLFFGSMAGQGSALRWSFDHRLHHAHVDTDCDPYSIKKGFWYAHCLWILEKPKKIEAKVVPDLIKNRLVQFQHKYDFLCMLISNGIAFLVVGWFLDDYMGAFFLACWTRLFLLHHFTWFINSLAHTWGDRPFCQEQSAVNNYILALLTFGEGYHNYHHTFCNDYRNGIRWFHFDPTKWLIWTLSKCGLTKELKRMDSYTIQKRMVLERKRLLLGRVCNLWYVKKDELEKLVRELAEKLVVEFAEFNQLRVNYRLARKEGREPDQLKVFKQKLSILKKNLKSNWRLWKQLSRHILKLKPFESFPCPI

SEQ ID NO: 12455 - protein, 583 aa, Oryza sativa (indica cultivar-group)
MAARRAASSLLSRGLIARPSAASSTGDSAILGAGSARGFLPGALHRFSAAPAAAATAAATEEPIQPPVDVKYTKLLINGNFVDAASGKTFATVDPRTGDVIARVAEGDAEDVNRAVAAARRAFDEGPWPRMTAYERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFRFATLEFPRIPSDRDRLSTGIYTNTLRAMCSTVEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 12456 - protein, 181 aa, Triticum aestivum
FVISSMKEVAHLAYDGHNALLQKNYAELARLMNRNFDLRRKMFGDDALGELNIKMVEVARSVGAASKFTGSGGAVVALCPDGDAQVELLKTACQEAGFVVEQIEVAPSGTDKGGAGKLIKSSVAKRISYIQIYALRPGISCLKLTQLIWDGVIDKSIASMQFAVTTGVHFFLICSSHHRIT

SEQ ID NO: 12457 - protein, 423 aa, Vibrio parahaemolyticus RIMD 2210633
MTNQQLHQRRSQVIAQGMGALYPLYVEKAENAYVWDIEGNKYIDFAAGIAVTNTGHSHKRISEAVKAQLDNFSHTCAMVTPYASFVELAEKLTELAPGETKKKAIFLTTGAEAVENAVKVARAHTGRSGVIAFKGGFHGRTNMTMGLTGKVAPYKAGFGPFPNEIYHAPYPNAFHGISVEQSLQAIDDLFACDIEPSRVAAIIFEPVQGEGGFYKAPDAFAQGLRQLCDKHGIMLIADEIQTGFARTGKMFATEYLGIEPDLMTMAKGIAGGFPISAVVGKADVMDSALPGGLGGTYAGSPLGCVAGLEVLKIIEEEDLCAKAMGIGEVVNARMTKLQQSVPAIGEIRTTGAMMAIEFTDPESGKPLQEMTKAVISKAQENGLILLSCGVKANVIRLLPPLTIEPEVLSEGLDKLEKVILEVA

SEQ ID NO: 12458 - protein, 481 aa, Vibrio parahaemolyticus RIMD 2210633
MSKGMTMQQIQNQSLVSFMVANPQQGIAVTNPATGELLGYAPVSTENDILNSIERAHVAQKEWSALPAKTRAGMLNRWFQLLLENKADLGRLMTLEQGKPLAEAQGEVLYGASFIEWFAEEAKRTYGETIPAPSADKRLVTIKQPIGVACAITPWNFPIAMITRKAAPALAAGCSFVVKPSESTPLSAFAVAELAYQAGIPRDVLQVVLGENSRQVGAIFTSHPLIRKLSFTGSTQVGRVLMQQSAADIKRTSMELGGNAPFIVFDDADIDAAVAGAMASKFRNAGQTCVCANRFYVHSKVYDEFVAKFDAAVQQLKVGNGLEEGVNIGPVISESAKQGIQALIDGAIEQGAKPVSALKELDGLFMQPVVLKGVTHDMKIVSEEIFGPVAPVIRFDSDEQLIEMANDTIYGLASYFYSQNIHRVWKIAEALEYGMVGINEGMISTEVAPFGGVKQSGIGREGAKQGIDEYMDVKYLCFGGN

SEQ ID NO: 12459 - protein, 901 aa, Oryza sativa (indica cultivar-group)
MPPREDPNGDASSASPSDPVPPPPQQPQPQPAKGKGKKKDEKKDDDLSEEDQALKEQLELYVVRAQDPDPGVQKLALESMRQEIRSATSSMTSVPKPLKFLRPHYGTLKAYFETMPESDLKKYMADILSVLALTMSAEGERESLNYRMIGSEGDIGSWGHEYVRNLAGEIAQEFQKRQDDGMPTDSLKELVEQIVSFHMKHNAEPEAVDLLMEVEKLDLLVKHVDSTNYKRTCLYLTSSSKYLPAPDDMSALKIAFEIYMKFGDFANALRIALLLYDKSLELKPIFTATDDFQLKKQFAFIIARHGLSIEIDDDIAADENEKEALQDIISNIKLSEGYLTLARDIEVMEPKSPEDIYKVHLIDGRGATSSSLDSARQNLAATFVNAFVNAGFGQDKLMTTPSDSSSSGSSGNWLFKNKEHGKASAAASLGMILLWDSDSGLAQLDKYLHSNDIHVVAGALLGIGIVSCGVKSDCDPAFALISEYFSRDESIIRIGAILGLGIAYAGSQKEEVRENLTAFLTDSQVPLEVLVFSAISLGLVFVGSCNEEVAQTIICILMERSEPELAEPIMRLLPVALGLLYLGKQESVEATAEVSKTFDEKIRNYCDVTLMSLAYAGTGNVLKVQKLLGICSEHLEKGETHQGPAVLGISLIAMAEELGAEMAVRSLERLLQYGEQNIRRAVPLALGLLCISNPKVNVMDTMSRLSHDADAEVSMAAIISLGLIGAGTNNARIAGMLRNLSSYYYKEAGHLFCVRIAQGLVHLGKGLLTLSPYHSDRFLLSPIALAGLVTVLHACLDMKSIILGKYHYMLYILTLAMQPRMLLTVDEDLKPLSVPVRVGQAVDVVGQAGRPKTITGFQTHSTPVLLAAGERAELATEKYLPLTPVLEGFVILRKNPEYHED

SEQ ID NO: 12460 - protein, 839 aa, Gibberella zeae PH-1
MSSPAGKQIEVPVEDGDAVLMHEISLGPNDDMPKESLMDRLAKLLEEHEHDQNFPDDVLQRARSYLENRNGEQQDEELAHDIYAKFQAQRDLMLNNSIYPEVRAVVENTDDPTLPVGTFRAFFLGTIFVLLGTSIEQFFSLRMPAISLSTYMVQLLSMPLGMLLAKILPTKKFRIFSWEFSLNPGPFSQKEHVLIAIMANVSFGGGAVGAYVVSIIQVLKLDTFYGEKVLSNSIPWQIITLLSTQFLGYGCAGLARRFLVYPSSMLWPRSLANIALTKALYKDNGNREQAANGWTMTRYRFFLICFASMFVYFWIPNFLFKALGLFNWPTWISPRNVTLALIAGSTCGLGFNPLPTLDWNIATYLGDPIVTPFFTLMNYASGMAIIGVIVAPLLYFNNVWDAAYFPINSNLVYDNSGSRYNVSHILLPNFTLNETAYHEYSVPLVTSTQVTKYAAAFMIYVATPVHMYLWHRKDIMNGIRASWERKSRNDEFDDVHNRLMAAYPECPHWWYLVILVTSFTLACISVSMWPTGMPIWGVVLAVLFTVLLQVPIGMLFAVTNLELSTGILAMIIGGHALEGRPIPNMIFNMFSYMSTHQSLNFSCDLKLAHYAKIPPRWAFAAQVYATFLAGFIGLAVNHWVLRNVEDVCQLHQKDRFTCPRTHTYFMSTVIWGVVGPRRLFGTQGPYRALTYTIPIGVVVPIVAYFIAKRWPNSFWRNVNAPILFAGPMGWAPFNWSYMQGTVVLAFVFNFFIKRRYTAWWEKYAYVLTSSLSAAIGISGAIMYFAVQHTGVVLDWWGNRIHEQGVDRHGLVGADGKIVRCSRLQVPEKGYFDIGFDWKV

SEQ ID NO: 12461 - protein, 261 aa, Rubrobacter xylanophilus DSM 9941
MGKAPAELLRGLREDPGASAILTDIDGTLAPIAPTPDAARVPEEVRELLERLSRRYLLVAGISGRKTEEARKLIGLGGVVYFGNHGFEKLEGDRVEIIPEALPYLERVRELERRAREELGPLGAFVEEKGITASVHYRNVPGEVGERCVELVRREGERLGLRVTVGRGVVEARPPVRADKGTAVRALVEEYRPRRALFMGDDTTDLDAFRELERLRGEGLLEEALRVGVASEEGPREIVAEADLVVEGVEGVAEVLRELAR

SEQ ID NO: 12462 - protein, 264 aa, Solanum tuberosum
MAELREKWCLKGTTALVTGGSKGIGYAIVEELANFGARVYTCSRNENELQECLDIWRKKGLKVEGSVCDLLSRTEREKLMKTIEDVFDGKLNILVNNAGVAIHKEAKDFTKEDYNIIMGTNFEAAYHLSQIAYPLLKASQNGNVIFVSSIAGFSALPSLSLYSASKGAINQMTKNLACEWAKDNIRVNSVAPAVILTPQIETAIKKNPQQKEEIDSIVVKTPLGRAGKPEEVSAVIAFLCFPAASYITGQIIWADGGFTANGAF

SEQ ID NO: 12463 - protein, 1070 aa, Listeria innocua Clip11262
MPKRDDIKTILVIGSGPIVIGQAAEFDYAGTQACLSLKEEGYRVVLVNSNPATIMTDAEMADKVYIEPITLDFVSRIIRKERPDAILPTLGGQTGLNMAMELSAAGILDECNVEVLGTDLTAIKKAEDREAFRDLMNELGEPVPESDIIHNLDEAYTFVERIGYPVIVRPAYTLGGSGGGICHNEQELIETVTSGLKLSPVTQCLLEKSIAGFKEVEYEVMRDANNNAMVVCNMENIDPVGIHTGDSIVVAPSQTLSDREYQLLRDVSLKIIRALEIEGGCNVQLALDPDSYNYYVIEVNPRVSRSSALASKATGYPIAKLAAKIAVGLTLDEVRNPVTGTTYAHFEPTLDYVVAKIPRFAFDKFEQADRRLGTQMKATGEVMAIGRSWEEALLKAVRSLEIGADHLLLEEAENADAETLERKICFPEDDRLFFLAAALRRGQTIEQLHAKTKIDLFFLYKLSKTIELENRLKENPQNEEILAEAKRAGFSDAFIATCWNIDEQAIYDLRKAQNLFPVYKMVDTCAAEFESTTPYFYSTYEDENESIRSSKESVIVLGSGPIRIGQGVEFDYATVHSVWAIQQAGYEAIIINNNPETVSTDFSISDKLYFEPLTLEDVMHVIEIEQPLGVVVQFGGQTAINLADGLAKRGVKILGTSLEDTDRAENRDAFEKALEILQIPQPAGKTATSVEAAIKVATDIGYPVLVRPSYVLGGRAMEIVESEEALKHYMTNAVKVNPKHPVLVDRYVSGQEVEVDAISDGENVLIPGIMEHIERAGVHSGDSIAVYPAQRLSEQVKNTIVDYTTRLATGLNIIGMLNIQYVVDGEEVFVIEVNPRSSRTAPFLSKITEIPMANVATRVILGENLIDLGYTPGLAPEKQEIFVKVPVFSFAKLRSVDTSLGPEMKSTGEVMGKDVTLEKALYKGFVASGTTMHDYGTVLLTVADRDKEEAVELAKRFNRIGFTIMATKGTASTLEEAEIPVSQVKKIGENQETLIDYIRNGQVTLVVNTLTTGKRPERDGFQIRRESVENGIPVCTSLDTAEAILRVLESRSFELESMNASEVKQPKARV

SEQ ID NO: 12464 - protein, 779 aa, Magnaporthe grisea 70-15
MGWKDKIFRGTGAGTSGSSGNASASKKKEKEEPPPELTPLEKLLQNAGAVREDGSDKFFGLENSALEDHVSELHIDIIIPSYCNSIVQALYYSEIFRESVVNYPPFSPSDTPNGKRAKISVQIRPPPKKEAEDEPQGKKKTSTKDVLKQRQMINSGQGGPGLQPTRPEDKPDSPEYKKKQAMLKGPVLELAQENSASYGMDESTFTGLKDLFLALIESQSRTGVLSPQRFLEIFKRDNEMFRNSMHQDAHEFYGLVLNDVISTVEANAKRLQEQEQAAAKDGLAKSVEDALSPTNALVKAPAGYRSPGTGWVHDIFEGLLTSETRCLTCETASQRDETFLDLSIDLDEHSSVTSCLRKFSAEEMLCERNKFHCDHCGGLQEAEKRMKIKRLPKVLALHLKRFKYTEDYSRLQKLFHRVVYPYHLRMFNTTPDAEDPDRVYELYAVVVHIGGNAYHGHYVSVIKTADRGWLLFDDEMVEPVDKHFVRNFFGDRPGMACAYVLFYQETTLEKAMEEEDYEGIEEIRLATQTADLASDKPSGAESLPPLEKPLTTPIPPVADHDAMAALDHALTAPNGTTPAVPQTPANPSVPAVPAEAPFSHPLVAAPPKPAAEIKPSSKEDKAREKQLQKEKKAAEKEQVKREEKERKERESRQREARKSEQEDLRRAMEASKQTAAEEEQKQKADNALSSKEAPTSPALGGGIGNLMKRGSLSRASLGFLNREKEKEKDKSSGNGVANGSSSDHAANGSAASPHPESPASLKKKFSFALGRKKSTHVLS

SEQ ID NO: 12465 - protein, 103 aa, Glycine max
  misc_feature (68)..(68): Xaa can be any naturally occurring amino acid
  misc_feature (81)..(81): Xaa can be any naturally occurring amino acid
MASSMISWPGVTTVKRADAGMVASFTGLKSMAGFPTSNTNNDITFIAINGGRRRCTQASPPIGNKKFXTLSYLTDLDNAQXAKEVLFLLTKGLIPCFKFELEH

SEQ ID NO: 12466 - protein, 130 aa, Brassica napus
  misc_feature (9)..(9): Xaa can be any naturally occurring amino acid
MEQTFIMIXPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALW

SEQ ID NO: 12467 - protein, 524 aa, Oryza sativa (indica cultivar-group)
MAKKRESCTPDARGTPWKGRLRSHHPALPTSPSLLPSSSAKNQKKKREQEAQSFKRRAAPKKAKDTGKCGSRSQDAAEKPLLPAPPRRSPRLAGNPPALVDGVCKESMVRGKQSAIVPFRRSLRLCHNQNSQNAFSMDQNHESSSRRSQKNTVVKLSMRMVSHKDSQKIFCQDSQGIPPRIRVPDLSCKKTQKEELNSNCCEKLARKRKRGTEERMSSSKRQSHKDPKSLSLKCQERMIHQWILVIHDSLRVNSVAICLQFSLLTETAIRQTSNKRVPGKSAEECLSRVHADLSTPTPIAPRPRTSKMKFSPLGHFTLSDPKHPNVLEPSFRRRTAKQKSLAAQKTVRHLLKKQCLTDQTQEADHFSIFETSPTVLPVEFSFEDSPGTPNSSGKKLLARLETVKNVGINPAEPSPAVLKPIKNVILHEKYVDRLSRREGTTRPRKKAAGSKALDSVKTQQAGGVKAARNALITEATDFISHFKKMQANPLAHVVEDDEDDEIDVLSVILAIIELIRSCLLYIKF

SEQ ID NO: 12468 - protein, 205 aa, Prochlorococcus marinus str. NATL2A
MESKLRVGIAGPVGSGKTAIIQRLCENLKDRLEIAVVTNDIYTQEDAKFLTNSKALAPERIKGVETGGCPHTAIREDCSINRIAVEELEHKFTTLDLVFVESGGDNLAASFSPELVDVCIYIIDVAAGDKIPRKGGPGITRSDLLVINKIDLAEMVGASLKIMERDTLLMRKNLPWCFTNTKTGEGIKIIEGFLCNQIPSVHKMV

SEQ ID NO: 12469 - protein, 394 aa, Synechococcus sp. WH 7805
MTQLETRTEPMVVNFGPHHPSMHGVLRLVVTLDGEDVVDCEPVIGYLHRGMEKIAENRTNVMFVPYVSRMDYAAGMFYEAVVVNAPEKLANIPVPKRASYIRVLMLELNRIANHLLWLGPFLADVGAQTPFFYIFREREMIYDLWEAATGQRLINNNYFRIGGVAADLPWGWLEKCRDFCDWFGPKIDEYEKLITNNPIFRRRIEGLGVIGKDEAINWSLSGPMLRASGVPWDLRKVDHYECYDDFDWDVAWEKEGDCFARYRVRIEEMRQSLKILRQACDMIPGGPTENVEARRMAEGKDSEFAGFDYQYVAKKVAPTFKIPNGELYTRLESGKGEIGIFIQGNNDVTPWRFKIRAADSNNLQILPHILKGHKVADIMAILGSIDVIMGSVDR

SEQ ID NO: 12470 - protein, 369 aa, Vibrio parahaemolyticus RIMD 2210633
MKTQKQWIELKNNLNIENRAYINGEYSAALTGQTIPVVNPATDEIFTEIARCQSEDVDLAVSCARQAFQSGQWSESSPAHRKAVLKQFADLIDQHQEELALLETLDTGKPISHSFSTDIPGAANSLRWYAEAIDKVYGEVAPTEKDVHAFVSHQPIGVVAAVVPWNFPLWLACWKLGPALAAGNSVLLKPSEKSSLTAIFLGQLASQVGLPTGVFQVVTGFGHEAGDALAKHQDVDCIAFTGSTRIAGQLMVSSGESNLKRVFAEAGGKNANIVFEDCDDLDRAAAETAAGCFYNQGEVCVAATRLLVHESIKDQFIEKVIQASKAFTPKDPMNPSSSMGALIDQDHKSKVLEYISLGESEGAIRALWR

SEQ ID NO: 12471 - protein, 125 aa, Brassica napus
MVVATTIALYASPPSTVCSTPHQITASCDLDLNPRSSSSSSSSSSSTTIGGLSLLFKSSTPSSSSASHPSLGDELASIHHDRTEDHRTTLSSSFSYSPTKFIGSSYLKRDHHQSPVSVLHGSNLI

SEQ ID NO: 12472 - protein, 468 aa, Bradyrhizobium japonicum USDA 110
MEAARVFDSKPNSAEARDIAFHLHSQTNPQRHAEIGPLIMARGEGVHVYDASGKRYLEAMAGLWCTSLGFSETRLKAAAATAYDKFGFYHSFNHKTPDNTIELAEKLVEISPIPDAQAYFATSGSEATETMVKLAWVYHAVRGKPGKRKIIARDRGFHGSTIVAASMCGLPRMHREFGLPLDGFLHTHCPDAYRGTRPGESEAAFVDRLAADLEALIMAEGPDTIAAFIGEPINAGGGIVVPPKGYFAAIEAVLRRHDILVLGDEVVCGFGRTGNWFGCETVGMKPDMVALAKGITSSYFPMSAVLLGRPIRDALSEMNKGGELFGHGFTNSGHPVGAAIALETLNIYHEMDVVPHVRRMGSRLRAGLEQIARDSRIVGQVRGEGLMIGVELVAAPATRQAFDPALKVGAMFDALAIENGLIIRAMGDTIGFCPPLIIDEAGVDEALDLFGRTLFSAEAKLAEKRPSA

SEQ ID NO: 12473 - protein, 199 aa, Colwellia psychrerythraea 34H
MTKIQHLFDNNKQWAERITKEDPNFFKALSEQQSPKYLWIGCSDSRVPANALLNMDPGEVFVHRNIANQVIHTDLNCLSVIQYAVDVLKVQHIIVCGHYGCGGISAALDNKSHGLIDNWLRHIEDVYRFHKEEMDKLTDETERINLLCELNVMEQVANICNTTTLVNAWKNNQDTTVHGVVYNLHDGILKDLNVSATGK

SEQ ID NO: 12474 - protein, 152 aa, Oryza sativa (japonica cultivar-group)
MMVMAMMRRVVMVVAVLCAVATMAMAQEASNVRATYHYYRPAENNWDLGAPAVSAYCATWDADKPLEWRQKYGWTAFCGPVGPTGQDACGKCLSVTNTATGDQITARIVDQCANGGLDLDWDTVFSKIDSDGQGYQNGHLIVDYQFVDCGDN

SEQ ID NO: 12475 - protein, 613 aa, Bradyrhizobium japonicum USDA 110
MTPPPASAWTRSKPPLLRFLDTCLNEFSAETSGAVADYIPELGNADPAYFGISLATLDGHVYEVGDSRVPFTIQSMSKPFVFALALDLLGAGRVESAIGVEPSGDPFNSIRLNSDNHPFNPMVNAGAIACTGLIYDSKGAEAFEQIRLALSRFAGRDLAVDEAVYSSESQTGDRNRAIGYLLKTNAVISDNVAAVLDVYFRQCAVLVTARDIAVMAATLANRGINPVTGEQVMSAYAISRTLSVMTSSGMYDYAGEWIYRIGIPAKSGVGGGILAALPARLGLGSYSPKLDKHGNSVRGIKVCEALSSHYDLHMLNRSDDARNAVIADYDIGKSPSRRVRRAQEREILAAHEQEVRIIELVGTLSLSAVDYVSRRLAGRPRPQFVIFDLHRVTSTTRAGARLVAEAFEELAALNVTVVLSGVRRASKEWNTLREWTAELKNVRDFYLLDTAIEWAEDQIVYRYGGSIDFHETTELAEQPLLEGLSADELAELGAICTIRTYQSGAKILTTGDPADALFFLRSGAVHVTLPDGVRLATLTAGMAFGEMALLEQTRSADVFADMAATAFEAPLKDFERFREQHPRASERIMRNLAQLLADRLIVANAKVDILTST

SEQ ID NO: 12476 - protein, 321 aa, Nicotiana tabacum
EKEREGFPLTSLGEINILLSIHHPSIVDVKEVVVGSSLDSIFMVMEYMEHDLKALMETMKQPFSQSEVKCLMLQLLQGIKYLHDNWVIHRDLKTSNLLLNNRGELKICDFGLARQYGSPLKPYTHLVVTLWYRAPELLLGAKQYSTAIDMWSLGCIMAEMLSKEALFNGKTEVDQIDKIFKILGTPNETIWPGFSKLPGVKVNFVKYQLPALGDFWFNSLRKKFPATSFTGLPVLSDAGFDLLNKLLTYDPEKRITADAALNHEWFREVPLPKSKEFMPTFPAQHAQDRRVRRVMKSPDPLEEQRRKEPKQGMLGTGGLFG

SEQ ID NO: 12477 - protein, 155 aa, Glycine max
NPTPSIILFSSQNPTIPYPLSVSAHSESFPKTTKAFATFQNAAKTSGPAAAAVGGKLIRTELLSSAWTGFFAGCLHTLSGPDHLAALAPLSIGRTQMESAAVGALWGCGHDAGQVIFGLIFLLLKDRLHIEIIQTWGTPCGLAFTLASNWVLLGN

SEQ ID NO: 12478 - protein, 345 aa, Oryza sativa (indica cultivar-group)
MRTFQGHNPNTMKVHSRKSQPSKKKPREFYDTVEVHIIDDDSDGDANIHKDYSMEDTSKHLVMYNPEITYDKQGEVEVTEPIDNYTSLNQRYMKPRHGYNTVLPSIGAYTVQCTHCFKWRIIPTKEKYEEIRENICQDVFVCERAREWNRVISCVDPEDISQDGSRVWAIDKASISQTPPGWDREVRIRGEGCSKFADVYYTSPTGKKLRSLVEVGRYLAENPHYIRQGVNLTQFSFAIPKPLQEDYVRKHTYAATPELPELLETAQVDPLCWAAPPTRRELLGELGASTSRSVDVSQSEVSYPVDLHQPEESAPLPPRTKKKTMKRGRVSATDLVHPKISLEDA

SEQ ID NO: 12479 - protein, 404 aa, Coprinopsis cinerea okayama7#130
MDQPTARKLLSELAKREDLENRICADCGNPNPQWASLGFVRSISMDTWQEDQLKRMQNGGNKLFKDFMASYPGGPKSDASPHEKYHSWAASQYKEKLDAALAGRDWSPSPAPPGFGANSRSASPAPSAAGLRKSRASARSGLGATRSSSQTPSIGGSGSSTPNLPADQKAQNESYFASLGKANESRPEHLPPSQGGKYTGFGSTPEPAAHPSYALSSANAPTLNDLQENPVAALSKGWSLFTAAVAGATKVVAENVIQPGVEKVTDPNFQATVRGYMTEAQKKAAMVGSSANEWSKHSFGVDVADTVSGVARAVKGGPSREGYGQLSLTSPNEFQETSGLYDPSHDDDFFSSYDKPQTQPTTSLNTGAVGSTSISRSSSSTGSVGKAKKVAAKKDDDWDEWKDF

SEQ ID NO: 12480 - protein, 501 aa, Aspergillus nidulans FGSC A4
MATAVSLTAPNGHKYEQPIGLFINNEFVASKSGEKFATVNPSDEEEITQVYAAGEEDIDIAVKAARKALKDPSWKLLTATDRGNLMLKLADLIDQNKETLAVIETWDNGKPYQVSLNDDLSEVVNTIRYCAGWADKIHGQTISTTPAKFAYTLRQPIGVVGQIIPWNFPLAMAAWKLGPALACGNTVVLKPAEQTPLSILYLAKFIKEAGFPPGVVNIVNGLGRVAGSALVTHPGVDKVAFTGSTMTGKEIMKMAAGTMKNVTLETGGKSPLLVFDDADLEQAAKWAHIGIMYNQGQVCTATSRILVHEKVHDEFIRLFREAVATTSKVGDPFSDDTFQGPQVTKAQYERVLSYIESGKQEGATLVDGGVPYKNVKDGKGFFIAPTIFTNVKDNMRIYREEVFGPFVAIARFSTEEEAIDRANDTTYGLGAAVFTKDIERAHRVASEIEAGMVWINSSNDSDFRVPFGGVKQSGIGRELGEAGLEAYTQIKAVHVNMGTKL

SEQ ID NO: 12481 - protein, 398 aa, Methylobacillus flagellatus KT
MELSQRVQSIKESPTLAVTARAAKLKAEGRDIIGLGAGEPDFDTPQHIKDAAKQAIDQGFTKYTPVAGIPGLKKAIVAKFKKENGFDYTEKEVIVGVGGKQCIFNLALAVLNPGDEVIVPAPYWVSYADIALVAGAKPVIIECGIEQGFKLTAAQLEAAITPQTKLFMINSPSNPTGAVYSLEELKALGAVLKKHPHILVATDDMYEHVNLTGDKFYNILNAAPELKERCIVLNGVSKAYSMTGWRIGYAAGPAKIIKAMEILQSQSTSNPTSISQVAAQAALEGPQECITPMLDAFRERHEFVVKRFNEIKGLKCIKAGGAFYAFPDAREAIHNLFAAGKIKQATDMALSEYLLEQEGVAVVPGSAFGAEGYFRISFATSMDNLKKALERIERALAN

SEQ ID NO: 12482 - protein, 185 aa, Triticum aestivum
  misc_feature (164)..(164): Xaa can be any naturally occurring amino acid
PATLPPPTPWPPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRXQVQCVSFIAFRPPGCEESGKA

SEQ ID NO: 12483 - protein, 245 aa, Coprinopsis cinerea okayama7#130
MSLARTYLVSGIVPRLNTNATSSAVRSIIATRRLLSSSPCSHAQHAGGNKLPSGLESRLEERLAAIQELQREGFRGPEDYSKGPSALDKAVHIFFFTEIIRGMWVVLEQFFRPPYTIMYPFEKGPLSPRFRGEHALRRYPSGEERCIACKLCEAICPAQAITIESEARQDGSRKTTKYDIDMTKCIYCGFCAEACPVDAIVETQNQEFSTETREELLYNKEKLLANGDRAEAEIAANLHADHLYR

SEQ ID NO: 12484 - protein, 193 aa, Glycine max
MMELITGAGKKAYTLVMGRPNPAKLANFPECDVFLYVSCAQTALLDSKEYLAPVITPFEAMIAFNRGSQWTGAYVMEFRDLINLPQMGVGNQEEEEARFSFLKGGYVEDFENQGKNVEEERETLALVNATEKALQLRNNSNVLMKGSARSGAEFLANRSYQGLNMSSENTSPEPYLIGRRGRASGYEDEKNKQ

SEQ ID NO: 12485 - protein, 531 aa, Methylobacillus flagellatus KT
MRDMFTKDGRRFEKFSLEAEGLLLDYSKHRITDETLPLLFKLARDSKVEEWRDRMFAGEKINFTENRAVLHTALRNRSNTPVYVDGKDVMPDVNRVLAQMRKFSTSIRSGEWKGYSGKRITDVVNIGIGGSDLGPVMVCGALKPYAQAGLNAHFVSNIDGTHLAQTLERCDPETTLFIVASKTFTTQETMTNARSARSWFLQAAKDEAHVAKHFVAISTNADEVGKFGIDAANMFEFWDWVGGRYSLWSAIGLSIAIYIGMDHFEELLQGGYEIDRHFKNAPLEQNIPVIMALLGIWYNNFFGADSLAILPYDQGLARFPAYLQQADMESNGKFVARDGRIVQCTTGPIIWGEAGTNGQHAFYQLIHQGNRLIPCDFMMPLQSHYSMGKNGNEHHLILLANCFAQTSALMQGKTLDEAKAELVAQGLTGEALETLLPHKVFEGNRPSTTILFDKLTPKTLGKLIAIYEHKIFVQGIIWNINSFDQWGVEYGKQIAKKILPQLSEDQASTEYDSSTNGLMNYFKSRTQSSGT

SEQ ID NO: 12486 - protein, 541 aa, Lactobacillus acidophilus NCFM
MTNAYNILNDPFLNKGTAFTKSERESLGLIGALPAKVQTIDEQATRIYDQDQLHEKGIDQRKFLMELFNTNRTLFYYVIEQHIEELMPIIYDPVIAPAIEEYSEIFMKPQGAAFLSIDNPGEIEASLTNAAGGRKIKLIVVTDGEGILGIGDWGSNGVNISVGKLMVYTAAAGIDPREVLPIVLDVGTDNQTLIDDPLYLGEKHARVTGDKYYDFVDKFVKIARKVFPDVYIHFEDFGRDNATKILNKYRKEIPVFNGDVQGTGIVCLAGVLGVLNISKQKFSDQIFLTFGAGTAGMGIANMMYREMLVEGMDPEEAKKHFYLVDKQGLLFSDTPGITPEQRPFVRERSEFVNADELTNLEAVIKTVHPTVMIGTSTTPGAFTEKAIKEMATHTERPIIFPISNPTKLIEASAEDLIKWTDGRALVATGVPSDPVKYNGVTYHIGQANNALIYPGLGLGVLASKAKLVTDEMLSAAAHSLGGIVDPNEKGASVLPPISKIRIFSDKEAISVAQTAIDQKLATPNITDAKAATENIKWIPKY

SEQ ID NO: 12487 - protein, 452 aa, Nostoc punctiforme PCC 73102
MQQLKSAEEIPGSYGLPILGETLEIFRDSELYLWRRFQQYGSVFKTSVLGRKRAYLIGPSANRLVLVEQAENMSSRIGWYFLESTFGNNILLQDGEEHRLTRRLMYPAFHGKAIATYFDTIQNIVQDFLKDWGERGTISLNSSFRQLTLMIATRLFLGSQNKSEVEQTSQWFTQLLDSSMAIFKWNVPFTLYGRGQNARGKLVAFLREAIAQRIEQGNLEESKDVLGLLLAAVDEDGNKLSETQVINEALLLLFAGHETTASLLTWVIFELGNHPEWRERLRQEQLAVVGNNPLSLSHLKQFPQLTNVLKEAERLYPPVYAYNRGVLKDIEYGGYRIPAGWFVTISPMLTHRLPELYTEPDRFDPDRFAPPREEDKKHPLALMGFGYGSHSCLGMEFAQMEMKIVLSTLLRHYDWTVKPDYSAIAPVRQPSKVKDILQAYIEPLLIKHPLDS

SEQ ID NO: 12488 - protein, 502 aa, Oryza sativa
  misc_feature (45)..(45): Xaa can be any naturally occurring amino acid
  misc_feature (60)..(60): Xaa can be any naturally occurring amino acid
  misc_feature (68)..(68): Xaa can be any naturally occurring amino acid
  misc_feature (78)..(78): Xaa can be any naturally occurring amino acid
  misc_feature (88)..(88): Xaa can be any naturally occurring amino acid
  misc_feature (96)..(96): Xaa can be any naturally occurring amino acid
  misc_feature (130)..(130): Xaa can be any naturally occurring amino acid
MDAYVSLDPLERRDGTIISTRFLNRTVAVDAAARRITVESGVVLXDLIRAAAAAGLALPXHSPYWYGXTVGGLLATGXAHGSSLWGKXAAVHEYVXQGIRIVTPAPASQGFAVVRELHLEHDQFDMKFIXVILQVTFELQPQFKRSVRFVTRDDSDFAEKVAVWGGAHEFGDMAWLPRQGKVIYREDDRVDVATPGNGLNDYLGFRAQPTLGLITARAAEERLERNGTDIARCLAARLPPSLFELQAYGFTNDGVFFTGWPVVGFQHRIQASGTCISSPEDGLLSSCTWDPRIRGPFLYNSGFSIALPRAAAFVADMMRLRDLNPRAFCDIDAKLGILMRYVKASSAYLGKPEDCVDFDVTYYRSYDDGEPRPHSDVFDELEQMALRKYGAVPHWGKNRNFAFDGAAAKYPNSGEFIKVKERYDPDGIFSSEWSDQVLGISGSPNIVDKRCAIEGLCVCSDDSHCAPELGYFCRPGKLFKEARVCSKDKSAAAGDDDLLDEL

SEQ ID NO: 12489 - protein, 373 aa, Geobacter sulfurreducens PCA
MAADKRDYYEVLGVHKNASDTEIKKAFRKLAIQYHPDKNPDDKEAEEKFKEITEAYEVLSDPQKRAQYDQFGHAGVGAGGFSGGGFGGFGAGTPFGDIFGDIFGDIFGGRPRGSRGRRGDDLQYNMELSFEEAAFGAEKEIQVPYGKRCGDCGGSGAKPGTEPKVCPTCRGAGQVRFQQGFFSVSKTCNHCNGEGRVVENPCTSCRGSGMIRDTKTLSVKVPAGVETGTRLKLSGEGGQGIKGGGNGDLYVAIAVREHPIFTREDNDVLCEIPVSFVQAALGCEIEVPTLDGKVSMKIPEGTQSGRIFRLRGKGVPQLQGYGRGDQLVIIKVETPSNLNKRQRELLEEFARISGEDVHPMKKSFFDKVMDFIS

SEQ ID NO: 12490 - protein, 675 aa, Nostoc punctiforme PCC 73102
MTVATQSAKELSVEELAINSIRFLAIDAVEKAKSGHPGLPMGAAPMAFVLWDRFLKFNPKNPKWFNRDRFVLSAGHGSMLQYALLYLTGYDSVTIEDIKQFRQWGSKTPGHPENFETPGVEVTTGPLGQGIANGVGLAIAEAHLAAKFNKPDTKIVDHYTYVIVGDGCNMEGISGEACSFAGHLGLGKLIALYDDNHISIDGSTDVAFTEDVSKRFEAYGWHVQHVEDGNTDLAAIAKAIEAAKAVTDKPSFIKVTTIIGYGSPNKANTAGVHGAALGADEIALTRKNLGWEYEPFDVPQEALNHTRKAVERGASYEAEWNKTFADYKAKYAQEAAEFERYLSGKLPDGWDNVLPTYTPEDKGLPTRKHSETCLNKLAAVLPELIGGSADLTHSNLTEIKGKGDFQKGHYENPNIHFGVREHAMGAICNGIALHTSGLIPYGATFLIFTDYMRAAIRLSALSQAGVIWVMTHDSIGQGEDGPTHQPIETLASLRAIPNLLVFRPADGNETSGAYKIAIEKAKQNAPSLLAFTRQNVPNLAGTSVEGVAKGGYTVVDSEGTPDIILIGTGSELSLAVSAAEKLKAEGKKVRVVSLPSWELFEAQDAAYKESILPKAVTKRLSVEAAASFGWHKYVGTEGDTVSIDRFGASAPGNVCLEKFGFSVDNVLAKAKQLLG

SEQ ID NO: 12491 - protein, 426 aa, Cenarchaeum symbiosum
MALVENDPFENSRKQVHDACDLLDITDKGMREYLVMPNRVLRFKIPVMMDDGNLRIFTGFRSQHNNDKGPYKGGIRYFNPKGGVEYMEREVMALSSWMTWKCAILDLPLGGGKGAVYVNPKEEKISAGEKERITRRFAYMLSEVIGPEKDIPAPDVYTTGKEMIQIMDTFGKLNGNRYTPGVITGKPVPVGGSLARNVATGLGSAYCTREAAKTLKIPLKGAKVVLQGFGNASTYAGIYLEKMGCKVIGASDSKGSVLVPAGFKMDKMMEHKSKKGTVVGYPGSKKVTAAELLTAKCDILVPGALENQIDAKIAAKLQCKIITEAANGPTFPEADPIIFKKKILLIPDILANSGGVCISYLEWVQNNQGYYWSFDDVAGKMETTIVRGFKASYEFAKKHKVDMRKASMAIAVDRVVKAFEHRGLWP

SEQ ID NO: 12492 - protein, 323 aa, Arabidopsis thaliana
MPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNAAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNKLVGCKEMGEEVLKSVDSKVPV

SEQ ID NO: 12493 - protein, 486 aa, Nocardioides sp. KP7
MINAKLIINGREETSDRTIDVVSPADTRVVLGSVPDATSEQVDEAVQAAATAFPEWSSRPLEERQGALFAAAGAIHDMIEEYAPLLSRENGKILEESHIDLEFASGICGYTAGISAEALADQRIHDAGGTTLIRRRPIGPVAAVTPWNFPVVLSFMKLAPALVAGNTVVLKPSENSPLVLTEVIRALQEHFPPGVLNMVTGGDATGEALVAHPLIRKIGFTGGIDTGRKVMAVAAQDIKRVTLELGGNDPAVVLDDVDLSPETMRRIAKGAFSATGQVCFGLKSIYVPTRIHDRFVEAFHAAVDEIVVGPGDDPRSTMGPLNNAQQKGSVEKILEEARGAGAVVTTLGRKLDTAAWEHGHFMMPSVVTDADPRLAIVEQEQFGPTVPVVRYTELDEVIRLTNRSQFGLAASIWSADEDRAFELGRRLDTGSVFINSHSFSSLDPRAPFGGTKNSGLGREFSPASLDAYTELQTISRRTGPPGPPLS

SEQ ID NO: 12494 - protein, 696 aa, Mycobacterium smegmatis str. MC2 155
MTTAEEITALTQPNHPDDWTDLDTLSVDTARVLAADAVQKVGNGHPGTAMSLAPLAYTLFQRQMRHDPSDTHWLGRDRFILSCGHSSLTLYIQLYLGGFGLELSDIESLRTWGSKTPGHPEFRHTKGVEITTGPLGQGLASAVGMAMAARYERGLFDPDAAPGTSPFDHYIYVVASDGDMEEGVTSEASSLAGTQQLGNLIVIWDDNKISIEHNTDIAFSEDVVARYRAYGWHVQEVQGGENVVGIEQALEEARKVTDKPSFIALRTIIGYPAPNKMNTGGVHGSALGADEVAATKKILGFDPEKNFEVRDEVIAHTRELVARGKKAHDEWQVSFDEWAEREPERKELLDRLLAGKLPEGWDADLPHWDLDAKPVATRAASGAVLSAVGPKLPELWGGSADLAGSNNTTIKGANSFGPPSISTEDWNATWYGRTLHFGVREHAMGAILSGIVLHGPTRAYGGTFLQFSDYMRPAVRLASLMDIDPIYVWTHDSIGLGEDGPTHQPIEHLAALRAIPNLSVVRPGDPNETAYAWKSVLERGSSSGPVGMILTRQPIPVLEGTDPEGVARGGYVLGGTPEKNPDVVIIGTGSELQLAVGAQKILADKGITASVVSMPCVEWFESQPEEYRDSVLPPAVSARVAVEAAVAQSWYKLVGDTGEIVSIEHYGESADDKTLFREFGFTPEAVAAAAERSLEN

SEQ ID NO: 12495 - protein, 609 aa, Aspergillus nidulans FGSC A4
MTNPAQPFDSRRSTIYNRQPEELHIPAGNSTSGGHPRQPMSHEYPTSPDTHLPSINIHSSSSQSNQYGGASGGVTGGTLPGSLQPGNSANRPPTVSMNTAPSTIPTLPHLSTQIQQQPQPQPQSTTPRSNAANSHGHSRSSPAGYRPHGSSPNAAFQPPTPQGAKYSPLGLADIRPSGDLLGDHATNAGAAASKSVENQVPTNSNYITPWPIYAVDWCKWPISGNPGSFGGKIALGSYLEDHHNYIQILDTHLAYPDPDTPDASAGELKLEYVKSAEATHSYPVTRILWEPPSSQKQSTDLLATSGDHLRLWSLPNSQPQHSSNSITRPSGQRDMPAAKLSPLALLSNSKSPEHTAPITSLDWNTISPSLIITSSIDTTCTIWDIPTLTAKTQLIAHDKEVYDVRFCANSVDVFVSCGADGSVRMFDLRSLEHSTIIYEPTEKNEKLMSPGNGSPSAPTTTWPPPLLRISASPHDAHLLATFSQDSNIVRVLDVRQPGQALLELKGHSAPLNTVEWSPNRRGVLASGADDCLVLLWDLINQHNTTPVPPGVHNPGAPSTTTERGPAAAWQCDYEISNISWSPQGGTTSAGHPRDWLGVCGGRGVWGVAL

SEQ ID NO: 12496 - protein, 372 aa, Salmonella typhimurium LT2
MKSRAAVAFGPGQPLKIVEIDVAPPKKGEVLVKITHTGVCHTDAFTLSGDDPEGVFPAVLGHEGGGVVVEVGEGVTSLKPGDHVIPLYTAECGECKFCKSGKTNLCQAVRATQGKGLMPDGTTRFSYNGEPVYHYMGTSTFSEYTVCAEISLAKVNPQAPLDKVCLLGCGVTTGIGAVHNTAKVKAGDTVAVFGLGGIGLAVIQGAVQAKAGRILAVDTNPEKFTLAGEMGATDFINPNDYDKPIQDVIVELTDGGVDFSFECIGNVNVMRAALECCHKGWGESIIIGVAGAGQEIKTRPFQLVTGRVWRGSAFGGVKGRTQLPGMVEDAMNGKIRLDPFITHRLPLEQINDAFELMHQGKSIRTVIHFGDN

SEQ ID NO: 12497 - protein, 637 aa, Coprinopsis cinerea okayama7#130
MLASPLLPAPPTFGPQPASDDYRPAKDIEAFNNLLPPPVEFVEGSSSGAYAVPEGKYKPINVPSSPKAPRHEKSPELTNGTPATPKPVSKPDAQPKTPKSPTKSLYPTGIDTSWPPNCNIGSGLHNTGNTCFLNSALQCLLHTPPLLRVLSHHKQESCKVDRGFCMACALRQVAAKSFSSRSPFAPSQITGRLQTIAKHMRKGRQEDTHEFLRYAIDALQKSCLAGYPPKIDQKLAETTWVHKIFGGRLRSRVTCRDCGYNSDTFDRILDLSLDILKSDTIKDALRKFVAIDYLKGADKYKCEKCKKPVTAEKRFTIHDAPLVLTVHLKRFSPLGRKIGHPVTYDDHLSLQPFMSEGSFGPTYSLYGVICHAGGGPHSGHYYAFVKSRDGKWWEMNDEMVSPINGPPLSKKSAYVLFYMRAKGQGLEGAVKSQINGVLKEQRSKPRLSESMKAPKPKDRDADDEDKGEKLDRPFIGPLLPSPSINGDSKKLNPVDPQAASLKSKIEKARSSMSTLEQYKSDDEDSDKEDFGEKVEDKGEETKGEPPSSPPKDVEMRPSSPHPPPPSSSPPHGASVTNGIPPTSFYGPTPPKKRKTPDNAHEGSSQKRQLLSSDFKKDRHRNPFNGITYKKRKPPRGL

SEQ ID NO: 12498 - protein, 411 aa, Erwinia chrysanthemi
MVNLPQHVHDVIVLLQQQHTDPLAAFVYDLTALRQHVSEVMAALPPGVELYYAIKANSEKPILDAIAPLVHGFEISSGGEIARVAGCGTRKPFVFSGPGKLDSDFDLALEQGVEAVHVESRHEIARLQQRARQHGVVQPVFIRVNPELASSLTSKLAMAGTPTPFGMDEADLADAVRDVDNASHLQLKGFHVHAMSHQMVVARHQQLLDLYLTRWPQWKALSAHPQHITHLNVGGGIGVPYLTPERFDWPALCDYLRTRLAQQPDAPIVRFEPGRFISAYCGYYAIEVLDKKRSHGKHFLVCRGGTHQFRLPVAQGHDHPVIHLPLTSAPTTGETRDWTVVGQLCTPKNVLSRDQRLTDVNIGDLLVLPLAGAYGYNISHADFLCHPRPGQYFTTEDGMTTDAAGVVSRVE

SEQ ID NO: 12499 - protein, 404 aa, Arabidopsis thaliana
MEMESCKLFIGGISWETSEDRLRDYFHSFGEVLEAVIMKDRATGRARGFGFVVFADPNVAERVVLLKHIIDGKIVEAKKAVPRDDHVVFNKSNSSLQGSPGPSNSKKIFVGGLASSVTEAEFKKYFAQFGMITDVVVMYDHRTQRPRGFGFISYDSEEAVDKVLQKTFHELNGKMVEVKLAVPKDMALNTMRNQMNVNSFGTSRISSLLNEYTQGFSPSPISGYGVKPEVRYSPAVGNRGGFSPFGHGYGIELNFEPNQTQNYGSGSSGGFGRPFSPGYAASLGRFGSQMESGGASVGNGSVLNAAPKNHLWGNGGLGYMSNSPISRSSFSGNSGMSSLGSIGDNWGTVARARSSYHDSLYSDSMWLSLPAKAEEGLGMGPLDFMSRGPAGYINRQPNGGMNNE

SEQ ID NO: 12500 - protein, 705 aa, Pseudomonas syringae pv. tomato str. DC3000
MTQPAATILIVDDDVHVRDLLEVLLQNQGYETLTAESGEQALAMVDARAPDLILLDIMMPGMDGYEVASVLKAGKGTANIPIIMLSALDEQGARLSGLEAGAEEYLSKPVESAELWLRVRNLLRLKAFGDYLKSHSMILEDQLQQRTIDLERFRTVMDASEDAIFLINRNTMSLIEFNRRACQLLGYTAEELAHKTPAELGETSMENLEVVYDQIIAGKGPSEPLETQIRDKSGRDVEVEIHRQAYRTGEDWVIVGIVRDITQRKESDQRLLTMAHYDTLTGLPNRDLFFTSLQMGLTQAAVSRWKLATLTVNLDGFKNINETWGHVLGDQVLLEVSHRLSECINASDTLGRVDGDQFALILMIRVGQPDTRQTLERIRKALRVPFMVEGQSIVMTASIGIALYPEDGEDARELVRHAYTAMNSAKKIGPDTYRFYTAQMNADVSARLDLEAALRDAVEKQAFEIVYQPKLSLVTGRICGLEALLRWPRPGQQGVSPAVFVPVLESLGLIGEVGNWVVDRVCAQIAHWQRTGLGLFQVAVNVSGQQISNSSLVADIRQALTNHRVAPQWLEVELTESSLMENTSHTIATLETLKANGVSISIDDFGTGYSSLAYLRRFPIDKLKIDIAFIREVTSNPQDAAIARAIIELAHSLGLKVIAEGVETPEQLAFLRDNQCDQIQGYLISKPLPLAELETFLSTPERQFG

SEQ ID NO: 12501 - protein, 396 aa, Synechococcus sp. WH 7805
MSRSESAEIRHERTGLVFRPGLEGVPATQSSICDIDGQAGKLSYRGYAVDDLSSHCSFLETTYLLIWGELPSPQQLRDFEQEVQMHRRVSFRVRDMMKCFPSDGHPMDALQSSAASLGLFYSRRAIDDPQYIYDAVVRLIAKIPTMVAAFQLIRKGQDPIQPRDDLAYSANFLYMLMEREPDPLASRIFDRCLILHAEHSLNASTFSARVTASTLTDPYAVVASAVGTLAGPLHGGANEDVLAMLDEIGTADRAADYLDAAMASKRKVMGFGHREYRVKDPRAVILQVLAEELFARFGHDEMYDVARALEAAAECRLGPKGIFPNVDFYSGLVYRKLGIPRDLFTPVFAIARVAGWLAHWREQLGANRIFRPSQIYTGQSMRQWSPLEDRLPSAST

SEQ ID NO: 12502 - protein, 596 aa, Oryza sativa (japonica cultivar-group)
MAMVLPETAAEGKALTDAWDYKGRPAGRAATGGWGCAAMILGAELFERMTTLGIAVNLVPYMTGTMHLGNAAAANTVTNFIGTSFMLCLLGGFVADTYLGRYLTIAIFEAVQATGVMILTISTAAPGLRPPACGDPKGASAECVAADGTQLGVLYLGLYLTALGTGGLKSSVSGFGSDQFDESDVDGERKKMMRFFNWFYFFVSLGALLAVTVLVYVQDNVGRRWGYGICAAGILAGLAVFLSGTRRYRFKKLVGSPLTQVAAVTAAAWSKRSLPLPSDPDMLYDVDDAAAAGHDVKGKQRMPHSKECRFLDHAAIIDRSAAESPATASKWRLCTRTDVEEVKQVVRMLPIWATTIMFWTIHAQMTTFAVAQAELMDRRLAGGFLIPAGSLTVFLIASILLTVPFYDRLVVPVARRATANPHGLTPLQRVFVGLSLSIAGMAVAAAVERHRATASASAAAAAPTVFLLMPQFLLVGAGEAFTYMGQLDFFLRECPKGMKTMSTGLFLSTCAIGFFFSTLLVTIVHKVTGHGARGGGWLADNLDDGRLDYFYWLLAVISAINLVLFTVAARGYVYKEKRLADAGIELADEETIAVGH

SEQ ID NO: 12503 - protein, 340 aa, Oryza sativa (japonica cultivar-group)
MDTDGRLRRALAAFGGGADVWDLVDAALASAARDRPAELRARRDGIVERLYATAAGGRCGNCDAPRSAEPEAAAAAAASPASPDEDADVDGLDDDEGGGMESKILAIRDFLEDPDQSEDELVSLLQSLADMDITYKALQETDIGRHVNGLRKHPSGEVRQLVKLLVRKWKEIVDDWVRLHNSGGDGGSSVLTDGDSPDKIQGRSYQNAQVSDFKYSPSPQRHNGLSSERSSNNNGVESMIEKRRTSPAPTYHNNKQNNSIGYSTTSSSAPVRTVREQKDNLMDLEKLDSARKRLQENYQEAQNAKKQRTIQVMDIHDIPKPKNRNAFIRKGGGGLPGKHR

SEQ ID NO: 12504 - protein, 218 aa, Synechococcus sp. WH 7805
MFGFLKQVGDYTRDAVDAARNLTQGLAVTFDHMKRRPVTVQYPYEKLIPSERYRGRIHYEFDKCIACEVCVRVCPINLPVVDWVMNKETKKKELRNYSIDFGVCIFCGNCVEYCPTNCLSMTEEYELAAFDRHSLNFDNVALGRLPTSVTTDPAVQPLRELAYLPAGEVHPHGVDPARPRAGQRPDQVLASLKRDAAGTTGNEGESATSTNNSKESAE

SEQ ID NO: 12505 - protein, 166 aa, Oxypappus scaber
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPISIIDDYTIRTIFNLPEIKT

SEQ ID NO: 12506 - protein, 123 aa, Vibrio parahaemolyticus RIMD 2210633
MVERVTYESLPQIAGPYVHATKHNKTLYISGLTAYGTDAQVLSLTEQTKEILDQISTVLKAEGCAKNNLVKLTIFVRDISKLASIRELLFHFYDGHLPACSLVEVSKLIHPDLQIEIEAVVAL

SEQ ID NO: 12507 - protein, 491 aa, Schizosaccharomyces pombe
MTVVRADKKHRRRGSIYMVTPYMDHDLSGLLENPSVKFTEPQIKCYMKQLFAGTKYLHDQLILHRDLKAANLLIDNHGILKIADFGLARVITEESYANKNPGLPPPNRREYTGCVVTRWYRSPELLLGERRYTTAIDMWSVGCIMAEMYKGRPILQGSSDLDQLDKIFRLCGSPTQATMPNWEKLPGCEGVRSFPSHPRTLETAFFTFGKEMTSLCGAILTLNPDERLSASMALEHEYFTTPPYPANPSELQSYSASHEYDKRRKREQRDANSHAFEQTANGKRQFRFMTRGPSDPWYGIRRPNYNSQPQYQRGSYNREGGNMDRSRNVNYQPKRQQNFKPLTSDLPQKNSEFSETNAMNQTSNHSHADGQRYYRPEQDRSQRLRNPSDYGRQGRQSSQSQQPAWNVSSRYQNNSKVQTTSRASENADTNKTQHNIKYIDSYVPEYSIARQSANQKTNEQHPSSTSLHQQSTSDLKSPSFHENSNVDDTPK

SEQ ID NO: 12508 - protein, 136 aa, Brassica napus
PTRPSSCLSEESSWSNFTGSLNKPHKGNDPRWNAILAVRTRDGVLGMSHFKLLKRLGCGDIGSVYLAELSGTRCHFAVKVMDKASLENRKKLNRAHTEREILQLLDHPFLPTLYTHFETDTFSCLVMEYCPGGDLH

SEQ ID NO: 12509 - protein, 241 aa, Rubrobacter xylanophilus DSM 9941
MQSLNGKVFAITGASRGIGAATALALAREGCRLGLGGRDEAALEGVARGVADAGGEAVAVRCDVRRYEDCERLASETVGRFGGLDGLVANAGVGAYGGLLDLSPEQIDEMLDTNARGTVYSVRAALPALLEGGGDLVIVASVAGLKGLPNESVYCASKHAQVGFAEALDHELRLRGVRVTAMCPGGVATEFAFGAGRTPDMPALREMMSPDQVAEAIVFALRQDPQLRTLRLVVRPMSEPV

SEQ ID NO: 12510 - protein, 358 aa, Glycine max
MSSFKSKYQDELIANATYIGTPGKGILAADESTGTIGKRLASINVENVETNRRILRELLFTAPGCLECLSGVILFEETLYQKSAAGVPFVDILKKGGVLPGIKVDKGTVELAGTNGETTTQGLDDLAQRCKKYYEAGARFAKWRAVLKIGPNEPSPLSIHENANGLACYAAICQENGLVPIVEPEILSDGPHDIAKCADVTERVLAACYKALNDHHVLLEGTLLKPNMVTPGSEAARVTAEVIAEHTVRALQRTVPPAVPAIVFLSGGQSEEEATVNLNAMNQLKGKKPWSLTFSYGRALQQSTLKAWGGKDENIPKAQSALLVRCKANSEATLGTYKGDATLGEGASESLHVKDYKY

SEQ ID NO: 12511 - protein, 370 aa, Rickettsia prowazekii str. Madrid E
MSQDYYQVLGVSKTASQADIKKAYLKLAKQYHPDTTNANDAEKKFKEINAAYDVLKDEQKRAAYDRFGHDAFQSQQARGGGNNGSFHPDINDIFGDFFSDFMGSGRRKQTSSKIRGSDLKYDLTIKLEEAFHGIEKNISFSSEVKCDTCHGTGSEKGETITTCDACGGVGATRIQQGFFTLEQTCHKCQGNGQIIKNPCKKCHGMGRYHKQRNLSINIPAGVENGTRIRHTGEGEAGIRGGNNGDLYVDIAIKPHDIYKVDGANLHCKLPISFVHAALGGEIEVPVIEGGKVKLTIPAGTQNGDQLRLRSKGMSKVRSTIRGDMLTHIHVEVPKNLSKKQRELLEEFKKESINEKENDSSFFNKMKSMWS

SEQ ID NO: 12512 - protein, 98 aa, Borrelia burgdorferi
MNTQAILVLDFGSQYSQLIARRIREIGVYTKVIPYYTPLKEIKNMNISGIILSGSPASVYSKEAPTLNMEIFNLKIPILGICYGMQIIVKLFGGLVSK

SEQ ID NO: 12513 - protein, 879 aa, Listeria innocua Clip11262
MRKFVYQFSEGSKEMKNLLGGKGANLAEMTKIGLPVPPGFIISTDACNDYTTSNKHLSEDIFEEVKIHLTELEKQTGKIFGFAENPLLVSVRSGAPFSMPGMMDTVLNLGLNDQAAEGLANLTGDARSAFDSYRRFIQMFGDVVFEIPSYQFEQALARIKKDNNYLLDTELTAANLSELIEIYKLIFSQATGRDFPQDPLEQLRLAIIAVFDSWMNPRAVIYRRLHDIDASFGTAVNIQAMVFGNTGETSGTGITFTRNPSTGEKQVFGEFLLNAQGEDVVAGIRTPEPISALEQRMPLVYNELLKTCELLENHYLDMQDIEFTIEKGKLYVLQTRSGKRTAKAAIQTAVDFVHEGKITREEAIMRVETKQLHQLLHPAFHESALKAGQVIATGLPASPGAATGQIFFEAKEAVAASERGISVILVRNETSPEDIEGMARSSAILTAHGGMTSHAAVVARGMGKCCIAGCAELTINEKEKTIILTTGEQLHEGDFLSLDGSTGNVYLGQIALTEASIGGHFDELMAWADAEKKLKIRVNADTPTDFKKALLFGAEGVGLCRTEHMFFDEKRIPYVRQMILAESLKERESVLTSLKEMQKTDFSELFRIANGRAVNIRLLDPPLHEFLPKTNREIEQLARDMNRTVPQITKRIEELAEANPMLGHRGCRLAITFPEIYRMQAEAIMESAVIVHDEGIDVHPEIMIPLIATKSELSYIKNEIKQAIHAIFEKERVVLPFDIGTMIEIPRACVTADEIAEEAQFFSFGTNDLTQLTYGFSRDDATKFLADYYEKDILPKDPFVTIDKTGVGALVEMAVTRGRMTHANLKMGVCGEHGGDPESIHFFHQLGLSYVSCSPYRVPIARLAAAQAALSENKLVSTI

SEQ ID NO: 12514 - protein, 321 aa, Legionella pneumophila str. Paris
MDLSKRIEPKTWSFVEKIQNAGGKPIYDIPVAEGRAIFDQLQALPNEKPDVDVEDKTLPVGPGGKVDIRIVRPKGAKESLPVIMFFHGAGWVFGDYQTHGRLVREIAVGTHAAVVFVKYTLAPEAQYPTQIEESYAAMKYIAEHGKQFNLDTSRFVAAGDSVGGNMTSVMALLAKERGGPKIDYQVLIYPVTDANFDNASYKEFAEGPWLTKKAMEWFWDKYLPNKEKRKEITASPLQASLEQLKGLPPALVITGECDVLRDEGEAYAHKLNAAGVTVTAVRHLGTIHDFLMLNDLSETPACRNAVETIIGHLTHIFGKKK

SEQ ID NO: 12515 - protein, 161 aa, Coprinopsis cinerea okayama7#130
MSILPIRTRIRGPAPIGDPSQADIIDETLDLFRANSLFRNFEIKGPADRTLIILILFVSDCLAKIGSARTPPSQIEASKLLNTLSVDHFPIPGDANFALNSHYAPPSSRQEADYLRQYLTQVRQELSARLVEKLYADGTGKPSKWWMAFQKRRFMNRSLGT

SEQ ID NO: 12516 - protein, 286 aa, Nicotiana tabacum
MKSRGRFGWWSVRLPSVFLLCLFFFLLGFFGSALFSHQDVPSVRPRPRFLESVYQEDFDPLPIGETGEHSLISIPFQVLSWFPRALYFPNFASIEQCQSIIKMAKANMEPSSLALRTGETEETTKGIRTSSGTFISASEDKTGILDLIEEKIAKATMIPKTHGEAFNVLRYEIGQRYQSHYDAFDPAQYGPQKSQRAASFLLYLSDVEEGGETVFPYENGQNMDASYDFSKCIGLKVKPRRGDGLLFYSLFPNGTIDLTSLHGSCPVIRGEKWVATKWIRNQDQDD

SEQ ID NO: 12517 - protein, 382 aa, Coprinopsis cinerea okayama7#130
MAEPKTFRIAVLPGDGIGPEVVREAVRVLELASERSSDFKLELKSYPFGGCAIDEVGEPLPEATLKACQEADAILMGSIGGPKWGVDAKVRPEQGLLALRKTLGLYANIRPANIASDSLLDYSPLRPEVAKGTDLIVVRELIGGAYFGKRKEQGVDPDPEAAWDTMIYSVPEVQRITRVAAQIALAANPPLEIHSIDKANVLASSRLWRKVVTETLTNEYPQLKFDHQLVDSAAMVIVANPRKLNGVILTENLFGDILSDQSSVIPGSLGLLPSASLAGAPSSPSSADFKPTSGLYEPIHGSAPDIAGKGIANPIGTILSAAMLLRYSLGLEKPAAAIEAAVRKVLDNPEIGGLGLRTADLKGNVGTAELGDRIVEVLKTLL

SEQ ID NO: 12518 - protein, 416 aa, Exiguobacterium sibiricum 255-15
MEIKVPELAESITEGTVASWLKQPGDQVEKGEAIVELETDKVNIEVPSDEAGILSEVMAAEGDTVRVGETIAIITAGGEAAQQAATTPAPEQKEAPVAQEAKKEQPAPVAATEATSVADRPIASPAARKMAREKGIDLAQVATQDPLGRIRVQDVATFEVAPREQAKAPQAPAPQATPSAAPGKPEERIKMSRRRKTIANRLVEVQQTAAMLTTFNEIDMSAVMSLRKRRQEKFVKDNEVKLGFMSFFTKAAVAALKKMPYLNAEIQGDEIVLKKFYDIGIAVSAPDGLVVPVVRDADKKNFGEIEKDIINLAVKARDNKLGLSDLTGGTFTITNGGTFGSLMSTPILNGPQVAILGMHAINLRPVAIDAERMENRPMMYVALSYDHRIVDGKEAVTFLKHIKDLLEDPESLIFEA

SEQ ID NO: 12519 - protein, 333 aa, Pseudomonas syringae pv. tomato str. DC3000
MTLRIAINGFGRIGRNVLRALYTQGYRQDLQVVAINDLGDSEMNAHLLRFDTVHGPFSGTVECDKESLTVNGDRISVSAIRNPAELPWKAQDIDVVFECTGLFTSRDKAAAHLTAGARKVIISAPASGADATIVYGVNHDTLRQSHQIISSASCTTNCLAPVAQVLHRELGIESGLMTTIHAYTNDQNLIDVYHTDPYRARSATQSMIPSKTGAAEAVGLVLPELAGKLTGMAVRVPVINVSLVDLTVTLKRETTAEEVNALMKEASQHSKVLGYNTLPLVSHDFNHNPLSSIFDANHTKVSGKLLKVLSWYDNEWAFSNRMLDNCLALHNAE

SEQ ID NO: 12520 - protein, 521 aa, Medicago truncatula
MAGGGFATSGGGEFEAKITPIVIISCIMAATGGLMFGYDVGVSGGVTSMHPFLKKFFPAVYRKTVLEAGLDSNYCKYDNQGLQLFTSSLYLAALTSTFFASYTTRTMGRRLTMLIAGFFFIAGVAFNAAAQNLAMLIVGRILLGCGVGFANQAVPVFLSEIAPSRIRGALNILFQLNVTIGILFANLVNYGTNKISGGWGWRLSLGLAGIPALLLTVGAIVVVDTPNSLIERGRLEEGKAVLKKIRGTDNIEPEFLELCEASRVAKEVKHPFRNLLKRKNRPQLIISIALQIFQQFTGINAIMFYAPVLFNTVGFKNDASLYSAVITGAVNVLSTIVSIYFVDKLGRRMLLLEAGVQMFLSQIVIAIILGIKVTDHSDDLSKGYAIFVVILVCTFVSAFAWSWGPLGWLIPSETFPLETRSAGQSVTVCVNMLFTFVIAQAFLSMLCHFKFGIFLFFSGWVLIMSIFVLFLVPETKNIPIEEMTERVWKQHWFWKRFMEDDNEKVSNADYPKIKNNPNSQL

SEQ ID NO: 12521 - protein, 321 aa, Pseudomonas syringae pv. tomato str. DC3000
MKLALVGDIGGTNARFAIWEDDTLHSVRVFPTIDYAGPEKAIEVYLQDLELQRGDIGYVCLAVAGPVDGDLFQFTNSHWQLSREAFCADLKVDHLLLINDFTAMALGMTRLKDDEYLTVCHGVGKPDRPRVVVGPGTGLGIGTLIKLEDSRWMALPGEGGHADLPIGTAREALLWTRLMAEHEHVSAEVVLSGAGLLLLYQVSCALDGMDAELKSPAAITSAALAGDPVAAAVLEQFCVFLGRVVGNNVLTLGSLGGVYIVGGVVPRFTEFFMNSGFKRAMGEKGVMSGYFKNLPVWLVTAEYPGLMGSGVALQQAFGSQI

SEQ ID NO: 12522 - protein, 262 aa, Lactobacillus acidophilus NCFM
MVYSELKNRVAVVTGGSKGIGTAISERFGKEGMKVVINYHSDEKGAQEAADAVKKNGGDAVIVQADIGSEEGAQKLIDAAVNNFGGLDIWVNNAGMENQVATKDMSLEDWNRVINVNLTGVFLGTKMALRYFTDHNKKGNIINMSSVHEQIPWPTFAHYAASKGGVKLFTETVAMEYAKQNIRVNAIGPGAINTPINAKKFADPEQKATTTSMIPMGRIGDPEEVAAAAAWLASDESSYVTGITMFVDGGMTLYPSFQGGRG

SEQ ID NO: 12523 - protein, 460 aa, Candida glabrata CBS 138
MSSQVNEPEFQQAYHEVVSSLKDSSLFEKHPKYAKVLPVVSVPERIIQFRVTWENDNHEQEVATGYRVQFNSAKGPYKGGLRFHPSVNLSILKFLGFEQIFKNALTGLDMGGAKGGLCVDLKGRSDNEIRRICYAFMRELHRHIGADTDVPAGDIGVGGREIGYLFGAYRHYTNSWEGVLTGKGLNWGGSLIRPEATGYGLVYYTQSMIDYATKGKESFSGKRVAISGSGNVAQFAALKVIELGGIVVSLSDSKGCIISETGITTEQIASIAEAKIKFKSLEQIVGEYSAFAENKVEYVAGARPWTLVGKVDIALPCATQNEVSGDEAKALVAAGVKFVAEGSNMGCTPEAIDVFESSRATASAPGEAVWYAMGKNSNLGGVLTSGLEMAQNSQRMSWTSEEVDQELKKGMVNCFNDCIEAAEKYSNESNKNALPSLVKGGNIASFIKVADAMFDQGDVF

SEQ ID NO: 12524 - protein, 137 aa, Oryza sativa
  misc_feature (19)..(19): Xaa can be any naturally occurring amino acid
MARTKQTARKSTGGKAPRXKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 12525 - protein, 250 aa, Pseudomonas aeruginosa UCBPP-PA14
MRAVVELLAGARRLVIFTGAGVSAESGIPTFRDALGGLWARYDPAALATPAAFADDPALVWGWYEWRRLKVLGVQPNPAHRAIAALSGRIADTRLVTQNVDDLHERAGSRDVLHLHGSLHAPRCATCAAAYRDALPDSVEPEEGRRIEPPRCPACGGQVRPGVVWFGEALPEAALREAFAAACECDLLLSVGTSGVVQPAARIPGLALEHGASVVHVNPQPVRTRHPREHCLVGPAGEMLPELLRRAFPG

SEQ ID NO: 12526 - protein, 581 aa, Desulfovibrio desulfuricans G20
MAGLAAAFGSGAMTNSIDELESMGAGDVIFAVGTNTTECHPVIGANMLQAVRQGARLVVADPRAVTLAAHAAVWLRLRPGTDVALLNGIAHVIISEGLADEAFIAQRTEGYAAFRETVLRCTPQKASAITGVPADDIRSAARILGCAANVSTYYTMGITQHTSGVDNVRAVANIALLTGNAGRPGTGVNPLRGQNNVQGACDMGALPDVLPAYQRVTDPAVRERFAAAWGREVPGKPGLRIPDVLHGLEHGTVRALYVFGENPMRSDPDVGHVEHCLDAAEFLVVQDIFLTETAAKAHVVLPGASFAEKDGTFSSTERRVQRIRRAVPPAGGSRPDWQILSELLTRMGAGPEYGSPEEIFDEMRALTPSYAGITYARLEKGGLQWPCPDVDHPGTPVLHRNAFMRGRGAFLAVEHREPAELPDDAYPLMLTTGRVVAHYHTGTMTRRCWGLNGVAPEEQVELHPDDAAPLGIADGDMVRLTSRRGSMTARVHVTEKTMRGLVFVTFHYSESCGNVLTNSAADPETGTAELKICSVRVEKADRQGPCPADTAGRRPEAAAQKHYSEPAVHPAGTPEKICNPS

SEQ ID NO: 12527 - protein, 383 aa, Candida glabrata CBS 138
MRSLAYFKTGDIHFTDKIDTPKINNDHELMIDVAWCGICGTDLHEFLEGPIFMPKDGDTHYLSGLDLPLPMGHEMSGIVKEVGKGVTRFKPGDRVVIEATTSCGDTHRWPKSKVAKGELCPACEMGLPNCCTHGSFQGLGSVGGGFAEQVVVGEKHVVKIPDKLPLDVAALVEPLSVAWHAARLAEFKEGSNALVLGSGPIGLAMILALKGMKAGKIVVSEPAKLRRELAEKLNVVVFNPTHTRAQNAIEKLKELSPKDHGFDYTFDCSGVQDTFNAAVKAACIQGHIVNVAIWGPKPVAFHPMDMTYGEKKLTGTMGYVTRDFEEVVDAIDKGYISIEECKLLITGRVKLEDGMEKGFHELIEHKETNVKILLTPNNHGELQ

SEQ ID NO: 12528 - protein, 461 aa, Hyphomonas neptunium ATCC 15444
MTDTAYDYDLFVIGGGSGGVRAGRIAAQAGAKVALAEEYRMGGTCVVRGCVPKKFMVYSSTYGKHIKLSAGYGWSVGDVSYDHSAFMVALHAEVERLSAIYDRNLKNAGVDVFDDRAEFVDAHTLRLKKSGKTVTAGKILIATGGRPWMPSADELPGIEHAIDSNGVFEMDTLPKRMLIAGGGYIAVEFAHIFAGLGAEVTLVYRGETVLRGFDDEIRLAVHEGLKEAGVRVVTKCTFKSIEKTGGGLMVTMSSGNEIDTDVVLMAVGRRANTDDLGCDKAGVKLAEQGEVIVDEWSRTNVENIWAVGDVTGRVALTPVAIREGHAFADTEFGDKPWKMDHSNIPTAVFTQPEVGTVGISEAEARKTFGEIDIYKTKFRPMKNMLNGDQTRTFMKLVVRASDQRVLGVHVVGEDAAEMIQTAAIAVKMGATKQDFDQTCALHPSSAEELVTMRTKWVPEGV

SEQ ID NO: 12529 - protein, 381 aa, Zea mays
MASSSKAPSSRRSVFDAVHIRSEFSAAGISAHFIPLIWKYVLQNPRCSDLDGVPSLPAAAYALLRQKFRPTTSTLTAAADSKDRTTTKLLICLQNGESVEAVVMRYDTRLGKYDGKPRPGGVRSTLCVSSQVGCKMGCRFCATGTMGFKSNLSSGEIVEQLVHASRYSQIRNVVFMGMGEPMNNYNALVEAIGVFTGSPFQLSPKRITVSTVGIIHGINKFNGDLPKVNLAVSLHAPDQDIRCQIMPAARAFPLGKLMNALQSYQNESKQTIFIEYIMLDGVNDQEEHAHQLGKLLETFKAVVNLIPFNPIGSSSNFKTSSDQNVKNFQKVLKGIYRIRTTIRQQMGQDIAGACGQLVVSLPDERSAGGATLLSDIEDLRI

SEQ ID NO: 12530 - protein, 390 aa, Triticum aestivum
ALGDYRTSLYKKAGWYRSGIPGISSTHASAQVLRADNSSLAGDIRKEMKVLNSKLLKAKDRNTKRDIRKELKTLAKEERKRQQLAVADVIKNADVVLSTLTGASSKKIAGITFDLVIIDEAAQALEVACWIALLKGQRCVLAGDHLQLPPTIQSVEAEKKGMGKTLFERLTEGYGEEITCMLTIQYRMHELIMNWSSKELYNNKIKAHSSVAGHMLYDLEGVNKSSSTETTIILVDTTGCDMEEVKDEEESTMNEGEAAVSIAHAKLLVESGVRAIDIGIITPYSAQVTCLKMLRNKDAKLKDLEISTVDGFQGREKEAIIITMVRSNPKKEVGFLSDHRRMNVAVTRARRQCCIVCDAETVSNDRFLKRLVEYFEENGEYLSASEYQSD

SEQ ID NO: 12531 - protein, 197 aa, Aegilops longissima
NQRSKSAFVPSVSILNMKKIASCSLRPLYLTRLDDPHTSELKPRRQLLDFRCAASAADDKESKAEVVPASSEAAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPV

SEQ ID NO: 12532 - protein, 268 aa, Cenarchaeum symbiosum
MIGDPINHSLSPTLHNAAFMELGMDCTYIAYRIPRGELEEGIGSLKDTGVEGFNVTIPHKVAVMKYMDRLDETCSMAGAANTVSIKDGVLKGYNTDMGGFLDPIKKRGIGIEGTEALVLGAGGAARAVTVALAGEGARRITIANRTQQGAREIALLARRLGADAVPADLEDVGRLARRSKFIVNCTPVGMGGEPSLVPEESIQDTSVVYDIVYMPLETDMIKKAKARNAVYIRGFEMLLGQACRAFEIWHEVEAPYKAMKQMMVGDLA

SEQ ID NO: 12533 - protein, 370 aa, Sulfitobacter sp. EE-36
MKTRAAVAVAAGQPLEVMDVNLEGPKRGEVLIEINATGLCHTDEFTRSGDDPEGIFPAILGHEGAGVVLEVGEGVTTLEVGDHVIPLYTPECRECEYCLSGKTNLCQAIRVTQGQGLLPDGTTRFSMMDGTPIHHYMGCSTFANHTVIPEIALAKVRKDAPFDKICYIGCGVTTGIGAVINTAKVEIGARCVVFGLGGIGLNVIQGLRMAGADQIVGVDLNDDKEETGRYFGMTDFVNPTKVEGDMVAHLVELTKGGADYTFDATGNTKVMRQALEAAHKGWGESIIIGVAPAGAEISTRPFQLVTGRVWKGTAFGGAKGRTDVPKIVDWYMNGKIEIDPMITHKLTLDQINEGFELMHKGESIRAVVEF

SEQ ID NO: 12534 - protein, 341 aa, Rubrobacter xylanophilus DSM 9941
MKGVVWRGPREMAVEEIPEPEAGPGAVVLRTGAAGICGSEVEGYLGRMGNRTPPLVMGHEFSGTVVAVGEGVDEAWVGRRVAVNPLISCGECRLCRSGHENICPERALIGIHRPGAFAEYVEVPAGSLHALPEGVDLRSAALAEPLANGVHAAGLGLERGPAELAVVVGAGTIGLMCLQAAVLSGIPEVWAVEPHGGRRARALELGAGRAFPPGGEAEEAVREATGGLGADVVLDAAGAGETRRAAARLVRPGGTVVLVGLHEDETALGFHDVVRRQLALQGSYAYTPRDFERALGWLVSGEAGIGELPDPLPLERGPAAFEELVRGPSDRVKVFLGGEGA

SEQ ID NO: 12535 - protein, 742 aa, Oryza sativa (indica cultivar-group)
MAMPLFLGLAVLTLLVATAAAALPPPGCPRTCGGVAVEYPFGIGPNCSLSDGFSLDCVRDTPQLRLGPVKQQQTVRVLGVDLLHGKIRTTNAIASQCLDARTGKLVNTSWEGLNAAALPYRFSDEDNRFFAVGCSGVVLLQGTAAGADDRVVIGCISTCFGNASIRTGSCSNIGCCETAIPRGLNSYLLAMERMPGGSPVNRCFYATLMEAASFSFEAADAAADGFYRKSSNGTVPVVLSFVVGSETCKEAQTSDTYACLSDHSVCVDGAPGYVCNCSQGYTGNPYLPNGCVDIDECGPGKHGCPDGMICTNFPGGYNCSCPEGEYKSNKNGVLICESDQKRSSLSVSVIIVIGVSGGVVIAVIAILITYLMRQRRALADVKRKYFERHGGLLLYDELSTRPGNTFTIYTEEQLEQATNGFDDGNILGRGGHATVYMGIVPAGGDGLVVAIKRCKVMDETNKKEFGKEMLILSQVNHKNIVKLLGCCLEVDVPMLVYEFVPNGTLYHLIHGGGGGGGGGDGGVISFATRLRIAHESAESLAYLHSFASPPILHGDVKSSNILLDESFMAKVSDFGASILAPTDEAQMVTMVQGTCGYLDPEYMRTCQLTEKSDVYSFGVVLLELLTGKKPLCLDGPEEERSLSARFVAAMGERKVGEMLDEQVKREASGESLEEITRLALECLQMCGADRPAMKEVAERLGGLRKLHQHPWTQDAVELEEARCLLHGSPEYQLSARYTTGSR

SEQ ID NO: 12536 - protein, 560 aa, Listeria innocua Clip11262
MSNKVKSDIEIASVAEILPVTTIAEHLGLDADALELYGKYKAKLSYDTIHSLKDKEQGKLVLVTAINPTPAGEGKSTVTVGLGDALSKKDKKTVIALREPSLGPTMGIKGGATGGGYAQVIPMEDINLHFTGDFHAITAANNALSAFIDNHMQQGNDLGIDGRRIVWKRVVDLNDRALRKVVVGLGGPIQGVPREDGFDITVASEIMAIICLASDLKDLKKRLSEIVIGYNYKKEPITVGEMGYEGALTLLLKDALKPNLVQTLEHTPAIVHGGPFANIAHGCNSVSATSTALKLGEYVVTEAGFGADLGAEKFLDIKVPALGKAPDCVVIVATIRALKMHGGALKTELSEENVDALAKGFTNLQKHTESIQTFGIPYVVAINKFITDSDAEVAKLEQLCEEHGIPFSLTEVWEKGGDGGLELADKVIAAVESGEEDYKRIYDDAWSIEEKLEAIVTKVYGGIGVELSSKAQKQIVEFKKYGWDRYPICMAKTQYSLSDDPTLLGRPTDFVIHIREFIPKLGAGFVVALTGDVMTMPGLPKKPAALNMDVDENGNAQGLF

SEQ ID NO: 12537 - protein, 116 aa, Glycine max
MASSRLDFLFCNLCGTMLTVPSTEYAQCPLCKTRRDIQDICDKEISFTISDEDIRRELGMEIIEEHAVMEYSKVSKKCEKCGHGEATYYTRQMRSADEGQTTFYTCTGCGHQSQEN

SEQ ID NO: 12538 - protein, 620 aa, Zea mays
HRGKGWCGRGEQELGDFCEGRLMEERRLDTPAMRRISEWILSLEFPSDITIQVGEATFNLHKLPLASRCGYIREQVSGINGSRVTHIDITGLPGGAAAFELVTKFCYGENFELTEDNVAMLRCAAEHLEMTDDDSRGGNLAGRTEAYLEAVALMSLAGAVTVLRRSEDLLPVSEEVDLVGRCVDAIAYFTCNDSQFSMSNGNGMDVSSSKVIIDDWLADELTSLRIDTFQRVVIAMKARGFKGIALGTLIMLYAQKSLRTLDTHGREKQKMEPRQEHEKRVVLETIVTLLPKERNSMSVSFLSMLLRAALCLDTTLACRLDLEKRMAAQLGQAVLDDLLIPSFLPDAGNTFDVDAVQRILVGYLEHEAEADRLDYNTDDDFTSTASPPNDVGMVGKLMESYLAEIASDVDLPVDKFTGLAEMIPERARFNDDGMYRSIDIYLKAHPYLSEAERKTVCRVMDCQKLSREACAHAAQNNRLPVQTVVQVLHHEQRRLREAPTSSFYGGESPTPAPSLQGRHGRSVPDEMSQLQRENEELKMELLRLKMNLRDPSAPPQPSDAPPSGRRPLPKKAAGGSGGFINNVSKKLGRLNPFLRPDAVGGGAKVRTKPSRTKDRRHSIG

SEQ ID NO: 12539 - protein, 506 aa, Exiguobacterium sibiricum 255-15
MIYEIPNTQGSKVQYKDRYENFINGKWTAPVGGEYFDNVTPITGKVLCQVARSGKEDVELALDAAHAAKDAWGKTSVAERSNILNKIANRMEENLEMLAYAETLENGKAVRETLNADLPLAIDHFRYFAGVIRAQEGSIGELDNDTVAYHFHEPLGVVGQIIPWNFPILMAVWKLAPALAAGNCVVLKPAEQTPASILLMTELIEDLLPPGVLNIVNGFGLEAGKPLASSKRIAKIAFTGETTTGRLIMQYASQNIIPVTLELGGKSPNIFFADIMDADDAFFDKAIEGLLMFALNQGEVCTCPSRALIEESIYEPFMERVLERVKAIKLGNPLDADVMMGAQASSEQMEKILSYLEIGKSEGAECLIGGERNHLDGDLADGYYIQPTIFKGNNKMRIFQEEIFGPVLSVTTFKTEEEALQIANDTLYGLGAGVWTRDMNRAYRFGRAIEAGRVWTNCYHQYPAHAAFGGYKMSGIGRENHKMMLNHYQRTKNLLVSYSPDKLGFF

SEQ ID NO: 12540 - protein, 443 aa, Lactobacillus acidophilus NCFM
MKKYDYIILGSGPVAIHLLAKLERTTNKVLLIEKGLWGGTCPNTGCQPKIFMEGTVRPVLNSYYLAGKGIKEAAKIDWPTLVARKKKIWTAFHKNERKSMTSEHTDTVQGKGVITGPHTVKVGDQEYEGKNIVIGTGLAPRDLDVPGNEYAITNNEFFDLDKLPKRAIVIGGGYVAMELATILQAAGAEVTILQHSDRLLRPFDQEMVGTLKRIMEDRGIKFHLNAPVKEIAKDGDQYTVTTENGDTFDTDLVINAAGRKPNVEGIGLEDVGIEFDPNKGIKVNEHMQTNIPSIFAAGDVADNGQPSLTPVAWVDAYHIINFVENGITDPIQYPPVATNAFTYPEIAQVGICEDEMEEGDYIKTLDLSDMFFSMGEGDSHAKLKVILNKNGEVRGASELSIHAAEDINNFVPLVGRKDPKKFVEENLTFAFPTPANNLDTLFR

SEQ ID NO: 12541 - protein, 404 aa, Hyphomonas neptunium ATCC 15444
MTRKFSIGPGALVAAAFIGPGTVTACTLAGANFGFALVWALVFATFATIILQEMTVRLGILGGAGLGEALVAPGTPAALKWGAIVLVLAALALGNAAYEAGNITGGALGMRAILGEGEGIQRITALATGLLAALILLLGRYKTLERVLIGLVLLMSLAFAASLVLVRPDIGSMIGGLRPTLPDGSLLTAMALIGTTIVPYNLFLHAAAVRERWKENTEAGLNAAIADTRVSVGLGGLISILVLSTAAASLFGAGMVISSGADMASALEPAYGSAARILAGAGLCAAGLSSAITAPLATAYAVCEVTGRPKSGWFFKGIALAIVFIGLSVALLGIRPVELILIAQVANGLLLPVVAAFLLITMNRKSVLGSHTNGPVRNALGVLVVLVAAFLGLRLILRALGIWP

SEQ ID NO: 12542 - protein, 422 aa, Candida glabrata CBS 138
MFKKYKNQDLDVSFWWKKNPKTPSDYVKLINEQLNKIEPTPLPNGTNITSSSSDNKRKAQEEVAKYLVGMKHYILGDVDPKPTSEAIDEFYSAMLSSDIFHNLLVHIADLDFESRKEVLLILSICLNYSKDNKFVTVDYLVSQSKTLSLMLRTMGLTLQRRDTYDIFIIVGNMIIECIKYEQLCHIFLTDTQLWSLFEFAGIANFEISTQSMQILNSVLTTHPKLVAREFFSQEKNINLFIRHINKLMAHGSYVTKRQSSKLLASLIIIRAHNVLMMTYINAPENLKLIMTLLTDKSRNLQLEAFNIFKVMVANPKKSKLVFDILVKNRDKLLAYLELFGKEVQDSTFLDEKEFIMREIESLPRIKPNTNEHNINMSNSPPKGLLHSDQKKTASSQQFNENHNELSGNNSSGNVTKSLASIG

SEQ ID NO: 12543 - protein, 659 aa, Cytophaga hutchinsonii ATCC 33406
MIAFERNNIDQETLIRLYKELVKPRMIEEKMLFLLRQGKISKWFSGIGQEAVSVGVACALEKEEYILPLHRNLGIFTSRGVPLHRLFCQFQGKPSGFTKGRDRSFHFGSKEHHIVGMISHLGPQMAVADGIALAEKLSRSNRATLVFTGDGGTSEGDFHEALNLASVWNLPLIFLVENNGYGLSTPLEEQFKIKSFKEKGPAYAIETHTIDGNNILEVYSKIRVLADYVRRESRPVLVEAITFRMRGHEEASGTKYIPEQLFEAWAKKDPVENYERYLLNEAILTIQEIESIKQKIKDGIDEAWQYTENEKEPVADASIEEEDMYAPYVHIRTRPRTTLKSPKRFIDAISDGLRLAMDKYPRLIQMGQDIAEYGGVFKVTEGLVERYSKERVRNTPLCESAVIGAGYGLAIKDYKSVIEMQFADFITSGFNQVVNNLAKSHYRWEQAADVVIRMPTGAGTSGGPFHSQSNEAWFFHTPGLKIVYPSNPYDAKGLLLAAIEDPNPVLYFEHKALYRSITEEIPDDYYTVPIGEAILAEEGDDLTIVAYGNAVWWAKEAVKKEAASADIIDLRSLLPWDKELVLKSVLKTGRVLVINEDTLTGSISAEIAAWISENAFESLDAPVMRVGSLDTAVPFSKSLEDNFLPVKRIQDKLKELQYY

SEQ ID NO: 12544 - protein, 148 aa, Triticum aestivum
  misc_feature (98)..(98): Xaa can be any naturally occurring amino acid
  misc_feature (145)..(145): Xaa can be any naturally occurring amino acid
MAVLVARQGRELQRYSTSTGGRIVVGCIPYRMRDGGDSDGEGELEVLVISSQKGHGMMFPKGGWELDESMDDAARREALEEAGVRGEMGKVLGCWHYXSRPYQTTYEGIMYPLRVTDELQQWPEMASRQRTWATVQQVMEGCQHXWMR

SEQ ID NO: 12545 - protein, 384 aa, Petunia x hybrida
MGSSQKWVIGLLLFSSIFFELTAITLADDKLEESRWGNDNGCGFGRRGCGGGRFGGRGPSFGRGRGAGGGFGGGAGGGAGGGLGGGGGLGGGGGAGGGGGLGGGGGAGGGFGGGAGGGAGGGLGGGGGLGGGGGGGAGGGGGVGGGAGSGGGFGAGGGVGGGAGAGGGVGGGGGFGGGGGGGVGGGSGHGGGFGAGGGVGGGAGGGLGGGVGGGGGGGSGGGGGIGGGSGHGGGFGAGGGVGGGVGGGAAGGGGGGGGGGGGGGGGLGGGSGHGGGFGAGGGVGGGAAGGVGGGGGFGGGGGGGVGGGSGHGGGFGAGGGVGGGAGGGLGGGGGAGGGGGIGGGHGGGFGVGVGIGIGVGVGAGAGHGVGVGSGSGSGGGGNGR

SEQ ID NO: 12546 - protein, 162 aa, Triticum aestivum
  misc_feature (53)..(53): Xaa can be any naturally occurring amino acid
  misc_feature (72)..(73): Xaa can be any naturally occurring amino acid
  misc_feature (82)..(82): Xaa can be any naturally occurring amino acid
  misc_feature (86)..(86): Xaa can be any naturally occurring amino acid
  misc_feature (90)..(90): Xaa can be any naturally occurring amino acid
  misc_feature (99)..(100): Xaa can be any naturally occurring amino acid
  misc_feature (102)..(102): Xaa can be any naturally occurring amino acid
  misc_feature (105)..(105): Xaa can be any naturally occurring amino acid
  misc_feature (115)..(115): Xaa can be any naturally occurring amino acid
  misc_feature (121)..(121): Xaa can be any naturally occurring amino acid
MAPAVMASSATTVAPFQGLKSTAGLPVSRRSSASLGSVSNGGRIRCMQVWPIXEGIKNSETLSYLPPLSTEXXWKQVDYLDXSKWXPAPXQASWFLSRXXNXSPXYYDGPYWDKXNLPCLXGPHKLNEWRSQEGLTLFPFNCAKWMRQASSNGVRGSGKAKY

SEQ ID NO: 12547 - protein, 215 aa, Geobacter sulfurreducens PCA
MITRLLEGNRRFVAEVFEKERETFATLARGQRPTVLWIGCSDSRVPVNTITQTKAGEVFVHRNVGNVVSVNDWNLSAVLEFSINHLCIPDIVICGHYGCGGIQALDEERADDKYIPIWLINAYKAKERVDEKIRALHIGLPPEQRMKLIVEENVRLQLEHLREYPFVRTAMRQGKLSIHGWIYDMESGEIKILSTERPGEGAAVSSRATEYCPLP

SEQ ID NO: 12548 - protein, 252 aa, Phaseolus vulgaris
MATSKVLLSNVLFVFVCFGICSAARTLLTLEDRVNLHVGTVVGGYGGGGGSGGGGGGAAVELGGGGYGEGAGGGEGAGAGYGAAGGGHGGGGGNGGGGGGGADGGGYGGGAGKGGGEGYGGGGANGGGYGGGGGSGGGGGGGAGGAGSGYGGGEGSGAGGGYGGANGGGGGGNGGGGGGGSGGAHGGGAAGGGEGAGQGAGGGYGGGAAGGGGRGSGGGGGGGYGGGGARGSGYGGGGGSGEGGGHGGGYYP

SEQ ID NO: 12549 - protein, 308 aa, Oryza sativa (japonica cultivar-group)
MAGAGAGESLDLPVVDLASSDLAAAAKSVRKACVEYGFFYVVNHGAEGLAEKVFGESSKFFEQPLGEKMALLRNRNYLGYTPLGADKLDASSKFKGDLNENYCIGPIRKEGYQNDANQWPSEENFPCWKETMKLYHETALATGKRILSLIALSLNLDVEFFDCPVAFLRLLHYPGEANESDDGNYGASAHSDYGVLTLVATDGTPGLQICREKDRCPQLWEDVHHIEGALIVNIGDLLQRWTNCVFRSTLHRVVAVGKERYSVAFFLHTNPDLVVQCLESCCSEACPPRFPPIRSGDYLEDRLRARYK

SEQ ID NO: 12550 - protein, 457 aa, Bacteroides fragilis NCTC 9343
MNRENKPLFLYTFITVFGGLIVGLNMAGISGAVPFLQEQFMLDDMALGLVVSILTVGCLCGALLGGGFSDRYGRQKVMFSSAVFFIVSSLGCALSGNLVSLLVFRLICGLGIGVISAVAPIYISEISPARLRGTLVSYNQLAIVIGILIAYIVDYILLDYERNWRLMLGFPFFFSVAYLLLLGILPESPRWLSARGKAGRARQVASKLNLEAGEMTVSDTNTQEGRDRIKVTELFKGNLAKVVFIGSILAALQQITGINVIINYAPSIFEMTGVAGDIALVQSILVGVVNLLFTLIAVWLVDKVGRKILLLCGSLGMGISLLYLVYTFVVPAANGIGALIAVLCYIGFFAASLAPLMWVVTSEIYPSRIRGTAMSLSTGISWLCTFLTVQFFPWILNNLGGSVAFGIFAIFSIAAFAFILFCVPETKGKSLEAIEKELGVDKEAEENVKEEHAFSKI

SEQ ID NO: 12551 - protein, 458 aa, Streptococcus agalactiae NEM316
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPDVPAWAFASFFALVIFGLNALSVRFFAEAESFFSSIKVIAIIIFIILGLGAMFGLVSFEGQHKAILFTHLTANGDFPNGIVAVVSVMLAVNYAFSGTELIGIAAGETDNPKEAVPRAIKTTIGRLVVFFVLTIVVLASLLPMKEAGVSTAPFVDVFDKMGVPFAADIMNFVILTAILSAGNSGLYASSRMLWSLANEGMLSKSVVKINKYGVPMRALLLSMAGAVLSLFSSIYAADTVYLALVSIPGFAVVVVWLAIPVAQINFRKEFLKENRLEDLSYKTPFTPVLPYITIVLLLISIVGIAWDSSQRAGLYFGVPFIILCYIYHKLRYKTW

SEQ ID NO: 12552 - protein, 378 aa, Colwellia psychrerythraea 34H
MSKRDYYETLGVSQDASEKEVKKAYKKLAMKYHPDRTQGDKSKEETFKEVKEAYEILNDDQKRAAYDQYGHAAFEQGGNGGGGGGHGGGFGQDFGDIFGDIFGGGGGGRGRQRQQRGSDLRYNVDLSLEDAVKGKSLEIKVPTYVSCEPCDGSGAKKGTSAKTCSTCHGHGQVQMRQGLFAVQQTCPTCSGKGKVIADKCTSCRGQGRVEKTKTLSVKIPAGVDTGDRIRLSGEGEAGEHGAPAGDLYVQVNVRDHEIFVRDENHLYCEVPISFVTAALGGDIEVPTLGGKVKLKVPKETQTGKMFRLRGKGVKSVRSSTTGDLMCKVVIETPVNLSGDQADLLRQLEEKMASSSKKHSPKETGFFDGVKKFFDDLKS

SEQ ID NO: 12553 - protein, 351 aa, Bradyrhizobium japonicum USDA 110
MTATSIQEEAIMSQAKRIVLAARPVGEPKPSDFRIEEFAVPTPGQGEVLLRTIWLSLDPYMRGRMSDGPSYAAPVPIDGVMEGEAVSEVAASNNPDFAKGDIVRARTGWQTHAISSGKGLIKVDPKLGPISTSIGVLGMPGMTAYTGLLDIGKPQEGETVVVAGASGAVGSAVGQIAKIKGARAVGIAGGKDKCDYVVKELGFDACIDHRDPDLAAKLKDACPKGIDVYFENVGGAVFEAVFPLLNPFARVPVCGLIAHYNDTEAKPPKWAASMMRATLTKRLTFRGFIVSDFAARHGDFLRDMSAWVREGKVKYKEFVTEGLESAPGAFMGLLKGANFGKQLVRVGQDKA

SEQ ID NO: 12554 - protein, 197 aa, Aegilops tauschii
NQRSKSAFVPSVSILNMKKFASCSLRPLYLTRLDDPHTSELKPRRQLLDFRCAASAADDKESKAEVVPASSEVAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPV

SEQ ID NO: 12555 - protein, 198 aa, Streptococcus agalactiae NEM316
MAEEFLNTHNASILLSAANKSHYPQDDLPEVALAGRSNVGKSSFINTLLGRKNLARTSSKPGKTQLLNFYNIDDKLRFVDVPGYGYAKVSKTERAKWGKMIEEYLVTRDNLRVVVSLVDFRHDPSADDIQIYEFLKYYEIPVIIVATKADKIPRGKWNKHESSIKKKLNFDKKDHFIVFSSVDRTGLDESWDTILSEL

SEQ ID NO: 12556 - protein, 338 aa, Colwellia psychrerythraea 34H
MSATKKLTIARAMAESLAQEMRADPKVFIMGEDIAQLGGVFGNTRGLYDEFGGERVRDTPISETAFIGAGVGAAMDGMRPVVELMFVDFFGVCFDAIYNMMAKNIYFSGGNSHVPMVIMASTGAGYSDGGQHSQCLYGTFAHLPGMKVVAPSNAYDAKGLMTAAIRDNSPVIYLFHKGLQGMGWLGNEPAAINQVPEENYELEIGKARTVVEGADISIVSLGIGVHHALKAAQELEKQNISIEVVDLCSLVPLDREHIIASVKKTGRLLVVDEDYHSFGVSGEIIASVTEHDHKMLKTPPCRITFPDIPIPFSRPMEQWALPSTEKIINVCLNMMESK

SEQ ID NO: 12557 - protein, 435 aa, Listeria innocua Clip11262
MLGKGKIAALGFQHVLAMYAGAVIVPLLIGGALGFNGEEMTYLVSIDIFMCGIATLLQLTVNRFFGIGLPVVLGCAVQAIAPIILIGQDMGIGAIYGSIIVSGLFVLLIAPFFSKVVRFFPPVVTGSVVTVIGLTLIPVAINNLAGGAGAKDFGSMYNLGLGFGTLLLIILVYRFGQGFSKAIAVLIGLVGGSLFAALYKGISLGPVSEASWFHMPKPFYFGTPTFEWPAIITMILIALVSMVESTGVYFALSDITERKLTQKDLTRGYRAEGLAIMLGGVFNTFPYTAYSQNVGLVQLSGIKTRKVIYAAAGFLIVLGLIPKIGAVTTIIPTPVLGGAMVAMFGMVVAQGIKMLGKVNFTSQENLLIIACAVGVGLGVTVVPDLFNAFPSFVRLFTSNGIVAGSVTAITLNIIFNMIPHRKDKKLADPEPQHAE

SEQ ID NO: 12558 - protein, 267 aa, Oryza sativa
MAGRDPISPRRLRLVSSTHLPHFLSSLRPRPQTLTLPAAIPMATTSRRSLHALLGGGAVADLVLWRRRNVSAAAVAGATAVWFLFERAGYSFPSVMANALLLLVAILFFWAKSASLLNRPLPPLPKLEVSDVVVEKAADRALVWINKVLAVGHDIAIKRDRSVFIKVILILWVVSYIGMLFNFLTLIYIGVMFSLLDPPLYEKYQDQIDEKIGMAPHMYYTRPSPSLLRNIENCPLDTSDTRTMQPVNPYQTMAAHPWTYPIRYTGT

SEQ ID NO: 12559 - protein, 364 aa, Ipomoea batatas
MVTTISATVPSRVERLAGSGIERIPKEYIRPEEERPSIGDIFAEEKMGGGPQVPTVDLKRINSEDLEVREKCREELRKAAVDWGVMHLVNHGIPEELTGRVKAAGEGFFGQPIEEKEKYANDQAAGNVQGYGSKLANNASGQLEWEDYFFHCVFPEDKTDLSIWPKTPSDYIDATREYAKQLRALTTTVLAVLSQGLGLEEGRLEKEVGGMEELLLQMKINYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRQTDQEGADTPKPDE

SEQ ID NO: 12560 - protein, 362 aa, Ipomoea batatas
MVTTITVPSRVERLAGSGIERIPKEYIRPEEERPSIGDIFAEEKMGGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCVFPEDKTDLSIWPKTPSDYIDATREYAKQLRALTTTVLAVLSQGLGLEEGRLEKEVGGMEELLLQMKINYYPKCPEPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRLTDQEGADTPKPDE

SEQ ID NO: 12561 - protein, 320 aa, Triticum aestivum
  misc_feature (96)..(96): Xaa can be any naturally occurring amino acid
MAPSRPLMRGAGPPRVFGSGRAGRASPYALALAALLLASAFLLALIAFGVFSLPVSSPALPTTGAETESSGDGGAAESDASGGSSRAARSRARRDXLSEGLGERGAQWTEVISWEPRAFVYHNFLSKEECEYLIGLAKPRMVKSTVVDSETGKSKDSRVRTSSGMFLQRGRDKVIRAIERRIADYTFIPAEHGEGLQVLHYEVGQKYEPHFDYFLDEFNTKNGGQRMATILMYLSDVEEGGETIFPDANVNSSSLPWYNELSECARKGLAVKPKMGDALLFWSMKPDATLDPLSLHGGCPVIKGNKWSSTKWLHVHEYKA

SEQ ID NO: 12562 - protein, 371 aa, Bdellovibrio bacteriovorus HD100
MAGKRDYYEILGVEKGADQDTIKKAYRKLAMQFHPDKNPGNKEAEEKFKEAAGAYEVLSDAQKRAQYDRFGHDAFTRGGGGGGFTDAEDIFSHFGDIFGDFFGGGMGGQQRQRRNRNEPRRGSDLRYVTEITLKDVITGIEKEIEFDTDKNCDECKGTGAEKGSQVSTCGTCGGSGQVVRQQGFFAMASTCPTCHGQGTVIKNPCKPCKGKGRVAEHRKIRLNIPAGVDTGTRLRVATEGEGGYMGGPPGDLYVEIRVKQHNNFERRNEDLFAELSLPYVQMLLGAEIEVPTVTGKAKLEVPKGTHHGDNVKLVGEGLPSLRGNRRGDIYFTVNVQFPEKLHKDEEKLLREIAKARGLNVTSEGGFFGKKK

SEQ ID NO: 12563 - protein, 340 aa, Hyphomonas neptunium ATCC 15444
MSKLTSTDWSLAARPVGMPKLSDFASREVDVADPKDGEIQVVNTWMSVDPYMRGRMYDRESYVPPFQIGETLQGGAVGRVTASAHPDFKTGDLVNSMLGWRTAWVAAPQAAMVQKLPNIGLPESAYLGVAGMPGLTAYAGLLRVGELKEGDTVFVSGAAGAVGSTVVQIAKIKGCTVIGTAGGKEKCDVVKSLGADHVIDYKEAGGFDGLVAALKSAAPKGIDVYFDNVGGDHLSAAIEAARPMARFALCGMIAQYNETGKPTGPHNIIQAVGKQLKLQGFIVSSHADMTPAFHADMAKWIASGKMKYEETVMNGIEKAPAAFLGLFTGANTGKMLVKLG

SEQ ID NO: 12564 - protein, 444 aa, Pseudomonas aeruginosa UCBPP-PA14
MNNHNGTLHRGWQSLQRWRIQIFVITWLAYAAFYFTRKAFSVAKLGIAEDPSFELDKSAMADLDALYLAAYAVGQFMWGVFADRFGTRVVVLGGLLTSALAALAMGTFATLPIFAACMVVQGLAQSTGWSGLCKNIGAFFATYERGRVLGLWSTCYAFGGLVATPFAGWCAYRLTHDWRMAFLSSAGVVLAVAVLFFFLQRNRPQDVGLPPVEAEAAPPANAPRPSHSGALLKALRNPHVLVLGIAYFLLKPARYAILLWGPVIIYERMPEIGKVASAIVPSAFEVAGLAGPILIGLASDKLFGARRMPACVLSLAALTLSLALFVPAMQSGSLYLVVGLLFMMGVTLYGPDSMISGAAAIDFGTSEAAGTATGFVNGCGSVGAILGGLLPGYFDTLTVFFVFTATALLASLLLVPFWNSRPGARRVEPKAHAGGPLLAAGKPR

SEQ ID NO: 12565 - protein, 253 aa, Arabidopsis thaliana
MKITTGRQRRCVWWEDGETVGGRDLVGGGTWLGCTRHGRLAFLTNFKEASSFPAAKSRGDLPLRYLQSEKSPAEFAEEIQDEISLYNGFNLVVAHVLSKSMIYITNRPPHGDKLVTQVSPGIHVLSNANLDSPWPKCLRLREGFQQLLAENGSGEFPVKTMVEEVMTNTVKDEETELPHVFTPETEYHLSSIFVDMQRPTGRYGTRSISAIIVKSHGDGGGDGEICFYERHLEEGDSWKEHTQQFVIIQNQSI

SEQ ID NO: 12566 - protein, 451 aa, Cenarchaeum symbiosum
MSTQMASARRGVATDEMKRVAQDEDVTLEWLLPKMAQGSIIIPHNVERKEKVHRVGIGTGLKTKVNVNIGTSTLNVNPDEEAEKARTAVKYHADTIMDLSDGGPVAEIRRRLLTEAPITFGTVPIYEAYSRGVEEHHNPLLITEDDFISAFENNAKDGVDYTTIHSGITKEIAERIMKVKRHGGVVSKGGTITAAWMLKHNKENPYYSNYDYLIEIARKYDVTFSLGDALRPGSILDSHDELQVQEMINIARLTKRAHESDVQVMVEGPGHVPLDQVAANVKLAKSLIGAVPYYVLGPLVTDIASGHDHIASAIGAAVSAAEGVDLLCYLTPSEHLALPNAEEVKAGLIAYRIAAHAGDLVKLRDKAIKWDIKMAEARRTLDWESQLALSIDPEEAARIHTRTGQHPGNGVPCTMCGSACVYIMLPKQREYDESADKPQEKPLQARDGSKP

SEQ ID NO: 12567 - protein, 144 aa, Zea mays
  misc_feature (20)..(20): Xaa can be any naturally occurring amino acid
  misc_feature (28)..(28): Xaa can be any naturally occurring amino acid
  misc_feature (47)..(47): Xaa can be any naturally occurring amino acid
  misc_feature (66)..(66): Xaa can be any naturally occurring amino acid
  misc_feature (79)..(79): Xaa can be any naturally occurring amino acid
  misc_feature (111)..(111): Xaa can be any naturally occurring amino acid
  misc_feature (123)..(123): Xaa can be any naturally occurring amino acid
SEDYHLHLAVEHIMLMLGDXLSRVDYMXFAHRHVDDNAHITISCCSXVDESQHSAPMAFSYSLTRXDRALQISDETNGXPLEEMIVDTNLLNFAIDYPAEYPYIAAMGVYXFKRDAMLDLLKXGMLELHESGSEILPKALPEHN

SEQ ID NO: 12568 - protein, 446 aa, Solibacter usitatus Ellin6076
MNSDGSKKHVVIVGGGFAGLSCARKLAKSDGVHVTLIDRNNFHQFQPLLYQLATSEVGTGDVATSLRQALHGHPNVDVKIGEVTAVNPATRTVSTRQGESYEGDFLVLAAGSQANFFGTSGAAENAFPLYGLEEAQRLRSRILKVFEDADRDPKLLERGALNFVIVGGGPTGTEMAGALADMIRGGLADEYPDLAVKKAQVYLVDHGASLLAAFSKKAHAYAARILQRKGVDIRLGVAVKEVAPDHVVLSDGTSIPTRTVVWAGGLMASPLAANAGLPRGHGGRIEVLPDLTVAGFPGVYVLGDFANIPSAKGQFMPQLASVAQQCGEWTAKNILTEIAGEERTAFHYHDKGIMAMIGRDAAVAEIGKKRHELDGPIAFAAWLGVHALLMSGVRQRIEAFVDWAWTYFSRSRPIQILDRGDMARIDWDEGAGESSSSSAPAVKSAR

SEQ ID NO: 12569 - protein, 268 aa, Triticum aestivum
  misc_feature (47)..(47): Xaa can be any naturally occurring amino acid
  misc_feature (56)..(56): Xaa can be any naturally occurring amino acid
MDPKLVEVTQLIDRFKAAFKASNFDVCSTLLSQLKVLLTKFPSLPPXFQQTPNAVXEELKLAREIYEQAVILSVKMEDQDAFERDFCQLKPYYMDTCGIIPPSSEEYPIMGANLLRLLVQNRIAEFHTELELLPAKALDNAYIKHGVELEQSFMEGAYNRVLSARQTAPHETYIYFMDLLVKTVRDEIAGCSEKGYDYLSINDAKQMFKFSSDKELQQYIAEEHPEWDVKDGRVLFQKAKESQPCKEIPAAPVINQTLGYARELERIV

SEQ ID NO: 12570 - protein, 356 aa, Galdieria sulphuraria
MEHWSQYKDELIATAKALVTPGKGILAGDESTGTIGKRFASIQVENNEENRRSYRELLFTAPNFGHYISGVITFEETLYHKTSQGKPFVDVMKEAGVIPGIKVDKGVTPIPGTKDETSTQGLDSLLSRCQKYYETGARFAKWRAVIKISIADGCPSDVAIKENAWGLARYAAICQQAGLVPIVETRKFLWMEITLLKTLTSDREVLYEVYYALDQQHVLLEGTLLKPNMVLPGTDCKDKASPKKIAECTVRTLQRTVPAAVPGIVFLSGGQSEEEASVNLNAMNQVEMVKPWKLSFSYGRALQSSCLKAWQGKAENVRAAQEAFLARAKANGEATLGKYAGGTGNNESLFVKDYKY

SEQ ID NO: 12571 - protein, 433 aa, Bacillus anthracis str. Ames
MQPSAPPHLESTKTIFSNSITKLVVFICWLAILADGYDLGIYGAVLPKLLEDNSWALSPAHAGTIASYALFGMFIGAILVGTITDLIGRKWTLICCLALFSITMGLAALAPSPELFGLWRFIGGIGLGGVIPTASALTVEYSPKKRQSFIYALMFTGYPLGIVLGAILSMFMLEDFGWRIMFGIGMIPLLLIPFIIRYLPESIQFLLSRNRQEEVDKILNRFQIEFYAKDETHQAPSNIRKKNGFLTLFSKEYIKATLLFWITYIMGMFLIYGLNTWLPQMMRQAGYPLGSSLSFLLMLNITAAIGALFAGAIADRIGAKIVISISYLMAAICIGLLTIKPSVSIIYLLIGLAGIGSVGITQILNAYVTQYFPSHIRATSLGWGLGLGRVGAIAGPILVGIIMTMQYDLAWNFYLFSFAGLLAAISVFFIPTK

SEQ ID NO: 12572 - protein, 942 aa, Coprinopsis cinerea okayama7#130
MLYRQFAPSTTSLSDEYDEDEPSQSNFFKADQPLFATDAAVHPHWSSSNQPGASSKRALKAPAKSPIMDLPPEILIAILKYLSSPRDLLNALKVSTTWCECAVELLWVRPTFPRYSTLQKMARLLKQSKSTFPYAKFIRRLNFMTLSSELRDETLAVFNRCSRLERLTLTGCKLITPTSLEQVLTCFPNLVAVDLSGVVETTTEVITAFAPVAKRLQGINLSNCSKVTDPALIALAENCPMLRRVKLSGVNLVTDAGVSAIVKKCPLLLEIDLHQCELITDVAVRDIWLYSTHMREMRLSQCTAITDLAFPALNSAVNPFPSNDPNVLPPLHVNRTFEQLRLLDLTACANITDDAVEGIIAHAPKIRNLVLAKCTALTDRSVEAICALGKHLHYLHLGHASRITDASVKTLARSCTRIRYIDFANCIKLTDMSVFELSALPKLRRIGLVRVTNLTDEAVYSLAERHATLERIHLSYCDQISVMAIHFLLLKLHKLTHLSLSGVPAFRNPDLQQFCREAPKRQNFCVFSGKGVSHLRAFLTQLFDTITEQNGTDDTEYEDEDVFPEPFQRAPEPETGDGDEDMVGPAYHVISPNVNTTRGTRFSRQEAISPRSYEVALQQRETQRRAHRTFADGFSAMFSAGGNIGVTTVHGAVSGPLDTNRITVELDPPDRLPVVEPVSPVSPPGNSAGITNTEPSATSASFFQGFQEPVFAPNQGARTPELHFAEIGHGRGASAQHVASPGSSRNHGSRSSARDRTPRQPHAAIAAAIHQSAHRGRSSNAHRPVSDPGSVSLDMNGEREGWSQQGNGVVLPGPSIRELEASVQSALNPSPSTARNGQRRQTDGSHRERQRGLRARAGRDGEEEQHHHHGGGGSSSRGRSVRRTIRNGLNAAENYASTFLFGRPWTEDGGSGPGQGSNGNHSVNQNNAGSSTTHATHWFGGR

SEQ ID NO: 12573 - protein, 414 aa, Legionella pneumophila str. Paris
MSVKNAIYAQSGGVTAVINASACGVIQTAKLFPEQIGKVYAAKNGIIGALNEELIDTSLESEEDIAKLMQTPSGAFGSCRYKLKDNGEEYQRLIAVFKAHNIGYFFYNGGGDSQDTAHKVSQLGKTMGYPITCIGIPKTVDNDLPFTDNCPGFGSVAKYIAISTKEAGFDVASMAASSTKVFILEVMGRHAGWIAAASGLAEQNPGEPPHIILLPEVPFEPTRFLKKVKDCVNSYGYCVIVVSEGIRNKEGKFLSEAGLRDAFGHAQLGGVAPVIAQLIKSELGFKYHWAVADYLQRAARHIASQADLDQAYALGKAAVEYAVKGYNAIMPIVIREQDEPYQWSIGQVPLAEVANQEKAMPPEYIAEDGMGITDACKRYLSPLIQGEAYPNYKNGLPDYVRLKNQLVAKKINQD

SEQ ID NO: 12574 - protein, 506 aa, Burkholderia thailandensis E264
MNHADMQHLNIEFPYRKQYGNFIGGEWVAPIGGEYFDNVSPVTGRPFTAIPRSREADVELALDAAHAAKAGWAATDAAQRANVLLRIADRMEANLARLAVAETIDNGKPLRETTAADVPLAIDHFRYFAGCIRAQEGSIADIGGDMVAYHFHEPLGVVGQIIPWNFPLLMAAWKLAPALAAGNCVVLKPAEQTPASILVFAELIQDLLPPGVLNIVNGFGLEAGKPLASSKRIAKIAFTGETSTGRLIMQYASENLIPVTLELGGKSPNIFFADVMDRDDSYFDKALEGFAMFALNQGEVCTCPSRALVEESIYERFIERAIKRVEAIKQGHPLDSQTMIGAQASSEQLEKILSYIDIGRGEGAQCLTGGERNVLGGELAEGYYVKPTVFRGHNKMRIFQEEIFGPVLAVTTFKTEEEALEIANDTQYGLGAGVWTRDGNRAYRFGRGIQAGRVWTNCYHAYPAHAAFGGYKQSGIGRETHKMMLDHYQQTKNLLVSYSEKPLGFF

SEQ ID NO: 12575 - protein, 549 aa, Oryza sativa (japonica cultivar-group)
MASINSFCNHMIFKLILGAIEKLKKKKNSSFATILSSSCCFATGDCSAHRLHLPVVACKRNRKATYSLQTIGSGGAHRGGVRRWRRWCRRAGAAGVVAHSGAAGARGWGRWGVESAAAAAALGGWGGARGRRACTPWRRRRSAAALGAELVWILCYEVKRPLLGPKDLPLCINKLPPMIDREPAGSSRHGSNMDPSINIPVNRDAITEEVAAAFAESEVIPERYCRPDEVHDGIVVGHDDDEAYELPVVDMEKLLDPELAEAEIAKLGSACQDWGFFQLVNHGVDEQVVNEMKDSTVKFFSLPLESKRTVEIQDNGFEGFGHHYRRASGKLDWAESVILLTQPIQERNPEMWPTNPSSFRDALDKYSAEMTKLAMRIASIMATDLGVDQEALVGAFRDKQQSMAIHHYPPCRHPDKVIGITPHSDGLGLTLLLQLDDTPGLQIRKDGRWLPVRPRPGTFIINVADILEVLTNGAYKSVEHRVLADAEKGRTTIVTFHEAYVDGMVKPIPEVLKLNGAEARYKSIERIEYIKGNFVALSEGTRFLESLKI

SEQ ID NO: 12576 - protein, 393 aa, Physcomitrella patens
MAKTKQIKNFTLNFGPQHPAAHGVLRLVLEMNGEVVERAEPHIGLLHRGTEKLIEYKTYLQALPYFDRLDYVSMMAQEHAYSLAVEKLCNCEVPLRAQYIRVLFCEITRILNHLLALTTHAMDVGALTPFLWAFEEREKLLEFYERVSGARMHASYIRPGGVAQDMPLGLSEDIFLFTQQFASRIDEIEEMLTNNRIWKQRLVDIGTVTAQQALDWGFSGVMLRGSGVCWDLRKSAPYDVYNQLSFDVPVGTRGDCYDRYCIRIEEMRQSIRIIMQCLNQMPSGMIKADDRKLCPPSRSQMKQSMESLIHHFKLYTEGFSVPASSTYTAVEAPKGEFGVFLVSNGTNRPYRCKIRAPGFAHLQGLDFMSKHHMLADVVTIIGTQDIVFGEVDR

SEQ ID NO: 12577 - protein, 411 aa, Oryza sativa (japonica cultivar-group)
MNALAATSRNFRQAARLLGLDSKLEKSLLIPFREIKVECTIPKDDGTLASFIGFRVQHDNARGPMKGGIRYHPEVDPDEVNALAQLMTWKTAVAAIPYGGAKGGIGCAPGELSTSELERLTRVFTQKIHDLIGAHTDVPAPDMGTNSQTMAWILDEYSKFHGHSPAVVTGKPIDLGGSLGRDAATGRGVMYATEALLAEHGKSISGSTFVIQGFGNVGSWAARIIHEKGGKVIALGDVTGSIRNKNGLDIPALMKHRNEGGALKDFHDAEVMDSSELLVHECDVLIPCALGGVLNRENAPDVKAKFIIEAANHPTDPEADEILAKKGVTILPDIYANSGGVIVSYFEWVQNIQGFMWDEEKVNMELHKYMNNSFQHIKAMCKSHDCNLRMGAFTLGVNRVARATLLRGWEA

SEQ ID NO: 12578 - protein, 200 aa, Hordeum vulgare
MASKSKGLVVLALLLAAAILVASADEHPQAKKEENEAGVENFFHGGGGHHGHGRGGHGGGGYGGGGGYGGGGGGYPGGGGGYGGGGGGYPGHGGEGGGGYGGGGGYPGHGGEGGGGYGGGGGYHGHGGEGGGGYGGGGGYHGHGGEGGGGYGGGGGGYPGHGGGGGHGGGRCKWGCCGHGFLHHGCRCCARADEVPEVRN

SEQ ID NO: 12579 - protein, 212 aa, Oryza sativa (japonica cultivar-group)
MAEEEDLADMPRVVGVLAALLERVTERNDAAAAELELAVAGAPAASAFRATTKPDITVRAYMARIARFAGCSPACYVVAYIYLDRLLRRRRRACAFSVDSYSVHRLLITAVLAAVKFMDDICYNNAYFAKVGGVSLPEMNYLEVDFLFGVGFDLNVSPETFGHYCAVLQSEMLCLELEPPPSPSPAPAARLHCFLSEDDTSSSGSTQHQLAA

SEQ ID NO: 12580 - protein, 137 aa, Triticum aestivum
  misc_feature (72)..(72): Xaa can be any naturally occurring amino acid
  misc_feature (74)..(74): Xaa can be any naturally occurring amino acid
  misc_feature (90)..(90): Xaa can be any naturally occurring amino acid
  misc_feature (96)..(96): Xaa can be any naturally occurring amino acid
  misc_feature (106)..(106): Xaa can be any naturally occurring amino acid
  misc_feature (110)..(110): Xaa can be any naturally occurring amino acid
  misc_feature (114)..(114): Xaa can be any naturally occurring amino acid
  misc_feature (122)..(122): Xaa can be any naturally occurring amino acid
  misc_feature (127)..(128): Xaa can be any naturally occurring amino acid
RTEVVDVARKGEGTTATIVVKTATGEEFHGGKCIITVGAWTSKLVKSVTGADLPVQPLHTLICYWKVKPGHXRXLNDRAGFPTSATTGPXTSNTPXQWITRGLFKXPMHXGRPXTPDGRDEXGPRGXXRLGTPPWNK

SEQ ID NO: 12581 - protein, 589 aa, Saccharomyces cerevisiae
MSGVSNKTVSINGWYGMPIHLLREEGDFAQFMILTINELKIAIHGYLRNTPWYNMLKDYLFVIFCYKLISNFFYLLKVYGPVRLAVRTYEHSSRRLFRWLLDSPFLRGTVEKEVTKVKQSIEDELIRSDSQLMNFPQLPSNGIPQDDVIEELNKLNDLIPHTQWKEGKVSGAVYHGGDDLIHLQTIAYEKYCVANQLHPDVFPAVRKMESEVVSMVLRMFNAPSDTGCGTTTSGGTESLLLACLSAKMYALHHRGITEPEIIAPVTAHAGFDKAAYYFGMKLRHVELDPTTYQVDLGKVKKFINKNTILLVGSAPNFPHGIADDIEGLGKIAQKYKLPLHVDSCLGSFIVSFMEKAGYKNLPLLDFRVPGVTSISCDTHKYGFAPKGSSVIMYRNSDLRMHQYYVNPAWTGGLYGSPTLAGSRPGAIVVGCWATMVNMGENGYIESCQEIVGAAMKFKKYIQENIPDLNIMGNPRYSVISFSSKTLNIHELSDRLSKKGWHFNALQKPVALHMAFTRLSAHVVDEICDILRTTVQELKSESNSKPSPDGTSALYGVAGSVKTAGVADKLIVGFLDALYKLGPGEDTATK

SEQ ID NO: 12582 - protein, 364 aa, Hyphomonas neptunium ATCC 15444
MTSPQDYRQTPPEPDHRGGGLSRRSLLGMAAIGTTIAAVGIGGTRLWTGSSEIPDWTYKDIPPQNGRRVLVTGANGYPEEDRSGLGYHIALGLARAGADVIIASRNQTRGEEAIRRIGAESPAGRVRFETLDLADLKSVKDFTARMQASGNGLDLLVNNAGTMGTLERQESIDGFERVFATNAIGPFALTAGLLPLLRNGNAPRIVWMCSGRSAFGALDLDDLQQENAYEYASAYNDSKQAHLIAALECERRSRAHGWGVVSIAAHPGVARTSLILDGPGLDSAEGWRRRNMPFMFQDAAQGALPALYAAVSSQAAGGAYYGPKGLMGIRGLPGVSQVPDNSRDPQLATTVWETLEQLGTVSLR

SEQ ID NO: 12583 - protein, 163 aa, Rhodobacter capsulatus
MAFDYVRAAKYFVLWDFIKGFALGMKYFVAPKPTLNYPHEKGPLSPRFRGEHALRRYPSGEERCIACKLCEAICPAQAITIDAEPRDDGSRRTTRYDIDMTKCIYCGYCQEACPVDAIVEGPNFEYATETREELFYTKEKLLENGARWEAEIARNIEMDAPYR

SEQ ID NO: 12584 - protein, 525 aa, Oryza sativa (japonica cultivar-group)
MMENLGSVSTLWSALVSVLLFWPVVNNHVPAGLRQWLSTMVDKLTSYLSPYLHVTISEYGHQRFRRSDFFLAVEAYLSHACARRARKLRADLGKDARTVQITVDDHQEVTDSFRGATIWWYPSKKPPRTNVISFYPRDDDARFYRLVFHRRHRDLVLDAYLPHVLAEGRAVTIRNRQRRLFTNNAPGASTSYYSRKSVWSHVPFEHPATFDTLAMEPADKDAILDDLTAFRDSKDYYAKVGKAWKRGYLLHGPPGTGKSTMIAAMANFLDYDVYDLELTAVKTNTDLRKLYIETTGKSIIVIEDIDCSVDLTAKRSNDKKKKKSSDEDDDDKPKLPTEQEKDEASKVTLSGLLNFIDGLWSACGGERIIIFTTNHKEKLDPALIRRGRMDVHIEMSYCRFEAFKVLAKNYLGVEQHEMFVEIRRLLEEIDMSPADVAENLMPKASKGKKRDPDACLAGLIEALNKAKVEAAEAAKAKEEEEAAAAKAKEEEEAAKAKAAKEKEKDDEAAGTKVDETVNNKSNGTI

SEQ ID NO: 12585 - protein, 452 aa, Oryza sativa (japonica cultivar-group)
STTTTVTIDDHASDSFSRSEAFLAVEAYLSASPCAARARRLRADRMALAVDDHEEVADDFRGATMWWRKSKAIPRANVISWAPRQDERRSYHLTFHRRHRALVEADYFPHVLAEGRAVTVRNRQRRLFTNNPGADWSGYDDARVWSHVKLEHPSTFATLAMDPVRKQEIIDDLDMFRDGKDYASVGKAWKRGYLLFGPPGTGKSTMIAAMANFLDYDVYDLELTAVESNTELRRLFIETTGKSIIVIEDIDCSIDLTGKRKKKKKDKKKKKMMPPSDDDDEEKKVTLSGLLNFIDGLWSACGGERIIIFTTNHKEKLDPALIRRGRMDMHIEMSYCCFESFKVLAKNYLGVEQHEMFGEIRQLLEEADMSPADVAENLMPRSKTKDVDACLERLVKALHEAKETKAAGGNDDDDESSSSSDDSDSSSDSEEQDKLAVVTKLDFSLAQPNYII

SEQ ID NO: 12586 - protein, 666 aa, Burkholderia thailandensis E264
MTSPTLSFAQNRPLDVICIGRVAVDLYAQQIGARLEDASSFAKYLGGSSGNIAFGCARLGLKSAMLSRVGHDHMGRFVRETLAREGCDTSRLRTDAERLTALVLLGLKDRDTFPLIFHRENCADMALDEDDFDEAFIASSKALLITGTHFSTEQVMRASRRALDYARRNQVRTVLDIDYRPVLWGLTGKADGETRFIANEGVTAHLQRILPLFDVVIGTEEEFRIAGGKDALLDALAMVRAVTSAALVVKRGPLGCSIVDGDVPATLDALPVIGGVEVDVMNVLGAGDAFASGFLSQWLRGRPFAEAARAANACGALVVSRHGCAPAMPTPAELAYFLAEAKRDPARMRRPDLDATLARLHRVTPARTPRDEVLGFAFDHRNQFFELARQTGASVARIDALKRLFVEAVAQTEAQLGLAGRIGVLIDDRYGQDALNDATGRGWWIGRPVELPGSLPLEFDHGRSIGTTLVSWPQEHVAKCLVQYHPDEAAEPRIEQETQLRALYDAVQASGHELLLEVIPPRRADLPQAADTVYRALKRLYNLGIYPEWWKLAPLDAAQWQAIDALVAERDPYCRGVVLLGLSASVDELVDGFRAAAASATCRGFTVGRTIFHEPSRAWLAGEIGDAELVARVRQTFETLIGAWRAARADTRAQGRHAAAAPRVAA

SEQ ID NO: 12587 - protein, 449 aa, Streptococcus agalactiae NEM316
MTSGKTYVASVLEKVKKQNEHEEEFLQAVEEVFESLVPVFDKYPQYIEENLLERLVEPERVISFRVPWVDDKGQVQVNRGYRVQFSSAIGPYKGGLRFHPTVTQSIVKFLGFEQIFKNSLTGLPIGGGKGGSNFDPKGKSDNEVMRFTQSFMTELQKYIGPDLDVPAGDIGVGGREIGYLYGQYKRLNGYQNGVLTGKGLTYGGSLVRTEATGYGAVYFAKEMLAARGQDLTGKVALVSGSGNVAIYATEKLQELGATVVAVSDSSGYVYDPDGIDLETLKQIKEVERARIVKYTEKHPKANFTPADQGSIWSIKADLAFPCATQNELDEEDAKLLVENGVLAVTEGANMPSTLGAIKVFQKAGVAFGPAKAANAGGVAVSALEMAQNSSRRAWTFEEVDQELQRIMKTIFVNASEATDEFGDSGNLVLGANIAGFLKVAQAMSAQGIV

SEQ ID NO: 12588 - protein, 597 aa, Nocardia farcinica IFM 10152
MPDLSLFGHDPFWLVVAKSVFLFVYIILIPLVAVLAERKVVARMQMRVGPNRVGPFGSLQSIADGVKMAFKEDLVPAIVDKPIYLLAPVVSVIPAFMAFAVIPLGGEVSVAGNTTALQLTDMPVGVLYILAITSIGVYGIVLAGWASGSTYPLLGGLRSTAQVISYEIAMALCFAAVFLHAGTMATSGIVGAQHPTWFVFLLLPSFLIYCVSMVGETNRAPFDLPEAEGELVGGFHTEYSSLKFAMFMLAEYVNMGTVSALATTLFLGGWSAPWPFNLIPGADAGWWGLLWFTAKVWTFMFVFVWLRGTLPRLRYDQFMRLGWQLLIPVSLLWVMLVATARLLRADGHAWATGAQVVVGVALTAAMIGLFLRAGRRPAAPPEPEPEPSGEAVFLGFPTPPVPADAHRVDNPKGGLLEPLAGFAVTAATMFKKPNTEFYPEQKVPTAPRYHGRHQLNRHPDGLEKCIGCELCAWACPADAIYVEGADNTEDERYSPGERYGRVYQINYLRCIGCGLCIEACPTRALTMTNDYELTDDNRADLIYEKDRLLAPLAPGMVAPPPAMAPGTTEADYYLGAVTGGAPAAEQPAPAGAKGGAR

SEQ ID NO: 12589 - protein, 411 aa, Brassica napus
MNALAATNRNFRHASRILGLDSKIEKSLMIPFREIKVECTIPKDDGTLVSYVGFRVQHDNARGPMKGGIRYHPEVDPDEVNALAQLMTWKTAVADIPYGGAKGGIGCNPRDLSLSELERLTHVFTQKIHDLIGIHTDVPAPDMGTNAQTMAWILDEYSKFHGHSPAVVTGKPIDLGGSLGREAATGRGVVYATEALLAEYGKSIKGLTFVVQGFGNVGTWAAKLIHEKGGKVVAVSDITGAVRNPEGLDIDALLSHKEATGSLVDFSGGDAMDSNELLIHECDVLIPCALGGVLNKENAGDVKAKFIIEAANHPTDPDADEILSKKGVIILPDIYANAGGVTVSYFEWVQNIQGFMWEEEKVNLELQKYMTRAFHNIKSMCHTHSCNLRMGAFTLGVNRVARATQLRGWEA

SEQ ID NO: 12590 - protein, 216 aa, Burkholderia thailandensis E264
MHAPHTATALRRTKKLPPLRVGIGGPVGSGKTTLLEMLCKGMRERYDLVAITNDIYTKEDQRLLTIAGALPEERIMGVETGGCPHTAIREDASINLEAVERMLARFPDADIVFIESGGDNLAATFSPELSDLTIYVIDVAGGEKIPRKGGPGITKSDLLVINKTDLAPLVGANLDVMASDTKKMRGERPYVMCNLKALDGVADVIAFIEKKGLLTV

SEQ ID NO: 12591 - protein, 392 aa, Desulfovibrio desulfuricans G20
MTQTRRVARRVQQIRISATKLMPMLAARIGGCVSLGQGVPSFSTPPHIVDAVCRVLRDDPSAGKYSLQPGMPALRQAIAEHLTAAKGFAADPDSEVAVTVGAMEALLMALLTVVDRGDEVIIPSPGYASHAEQVLMAEGVPVHVPLRPADWGLDVEAVRAAVTERTRAVIVCNPGNPTGTVYADEDVRALCRLALEHNLVLISDETYDYMVFGGHAAPLSPASLPEMRENVIVINSFSKKYALTGWRVGYAAASAGWMGEMLKVHDATAICAPTVSQHAALAALTGPQDCVEQMCAALEKRRSLTMDRMAALAPAFTCVPPRGAFYVMARYSCTPEPSPEVARRILEEARVITVPGASFGPAGENHLRLSFGADEAELTECFDRLQRWAERQ

SEQ ID NO: 12592 - protein, 264 aa, Mesembryanthemum crystallinum
MSSESSREENVYMAKLAEQAERYEEMVEFMEKVAKMTDTEELSVEERNLLSVAYKNVIGARRASWRIISSIEQKEESRGNEDHVSTIKEYRGKIETELSKICDGILNLLESHLIPSASTAESKVFYLKMKGDYHRYLAEFKTGAERKEAAENTLLAYKSAQDIALAELAPTHPIRLGLALNFSVFYYEILNSPDRACNLAKQAFDEAISELDTLGEESYKDSTLIMQLLRDNLTLWTSDNAEEGGDEIKEAAAKRESGEEKPQQ

SEQ ID NO: 12593 - protein, 453 aa, Nocardia farcinica IFM 10152
MKDTETRPGRHRAPEPAHPEQPDTTGDTVVTVSGQDWDTVTETLGGAREERIVVNMGPQHPSTHGVLRLILEIEGETVVEARCGIGYLHTGIEKNLEYRTWMQGVTFVTRMDYLSPFYNETAYCLGVERLLGITEQIPERASIVRVLLMELNRISSHLVCLATGGMELGALTPMLFGFRERELILDVFETITGLRMNHAYIRPGGLAQDLPDDGVAKVRELLDLMPKRLRDMEHLLTQNPIFKARTQDIGYLDLTGCMALGITGPVLRSAGLPHDLRKSQPYCGYETYEFDVPTTTGCDCYGRYLIRVEEMKESLKIVEQCLDRLRPGPVMIEDKKLAWPADLKLGADGLGNSPAHIGRIMGSSMEGLIHHFKLVTEGIRVPAGQVYVAVESPRGELGVHMVSDGGTRPYRVHYRDPSFTNLQAVAAMCEGGMVADVIAAVASIDPVMGGVDR

SEQ ID NO: 12594 - protein, 253 aa, Nocardia farcinica IFM 10152
MSPDTPRGGDLHPPEPDAAATAGPEGTPPDTEPAAEVIGVRHGMFGIRGTGDTSGYGRLVRPVTLPGGTAPPYGGWFDEVVDRLRTALENSGTPFGSALEKIVVFRGELTLHVRREHLVTVARLLRDDPALRFELCLGVNGVHYPDDAGRELHAVYPLRSITHNRLLRVETCAPDTDPHIPSLFEVYPTTDWHERETYDFFGILFDGHPSLTRITMPDDWRGHPQRKDYPLGGIPVEYKGARIPPPDERRAYS

SEQ ID NO: 12595 - protein, 547 aa, Listeria innocua Clip11262
MTLKSGFDYMNNPLLNKGTAFTSEERLNYKLDGLLPPIIETIEQQALRIENQLENLESPLHKHQFLTNLYNENRTLYYYVVTKNVSEYLPIIYTPTIGDAVIHYHTDYTAPDEALFIDAFTPEKLRASVENYAQNNPNIDMIVITDGEGVLGIGDWGVNGVKIAVGKLAVYTVAAGLSPDRVLPVVIDAGTNNKTLLEDSRYLGNKRPRLSESDYDTFIAQFVEVMSDVFPSAILHWEDFGRANASRILHNYRDKICTFNDDIQGTGAMVVAAALATINVSNIPLNKQKIIIFGAGTAGIGIADQLSGQLMRETGLPFESAKKHFYLLDRSGLVLDNMTDLTDGQKKYAHQASDWASVPTDTLEHLVEAIHPTMLIGCSGVTGAFKESIVKKMTEHTERPAILPLSNPTKLAEATAADLIKWTDGKALIVTGSPSKPVTYQNITYEIGQANNALLYPGLGLGALVTRSKFITDGMLAAASSAVSDQISTNELGAALLPHVRTLRETSRAVAIAVANQAIKENIHQVELASVTKAVEREMWQPTYKGV

SEQ ID NO: 12596 - protein, 501 aa, Mycobacterium smegmatis str. MC2 155
MSAPPTSMAGQMMRRRPVIGAPVAHGASDHLKRSIGTFQLTLFGVGATVGTGIFLVLQEAVPEAGPAVLVSFVLAGVAAGLSALCYAEMASAVPVSGSTYSYAYTTMGEFVAMGVAACLLLEYGVSMSATSIGWGGYLNQLLDDVFGFRIPQALTSAPWGENPGIMNLTATLLIVMCGLLLIRGASESALVNTIMVIIKLAVLALFVAVAFTAFTTDHFAGFWDKGFAGITAAAGSIFFTFIGLDAVSTAGDEVKNPQKTMPRAILGALVVVASVYILVAFAGLGTQSADEFGSEEQSEAGLAVILTNILHGQTWASTILSFGAVISIFSVTLVVMYGQTRILFAMGRDGLLPSMFARVNSHTMTPINNTIVVALVTGTLAGFVPLDYLWDLVSIGTLVAFIVVSAGVVLLRVREPDLPRSFKVPGYPVTPVLSIIACLFVLYGLPAVTWLWFSVWVGAVLLFYLLWGRRHSALNDGGDGYIPGAAAGEDDVMTGHPEDRA

SEQ ID NO: 12597 - protein, 365 aa, Arabidopsis thaliana
MAALKGYGLCSMDSALQFPCPKLFNGYKRRSSKWVSPKAAVVPNFHLPMRSLEVKNRTNTDDIKALRVITAIKTPYLPDGRFDLEAYDDLVNIQIQNGAEGVIVGGTTGEGQLMSWDEHIMLIGHTVNCFGGSIKVIGNTGSNSTREAIHATEQGFAVGMHAALHINPYYGKTSIEGLIAHFQSVLHMGPTIIYNVPGRTGQDIPPRAIFKLSQNPNLAGVKECVGNKRVEEYTENGVVVWSGNDDECHDSRWDYGATGVISVTSNLVPGLMRKLMFEGRNSSLNSKLLPLMAWLFHEPNPIGINTALAQLGVSRPVFRLPYVPLPLSKRLEFVKLVKEIGREHFVGEKDVQALDDDDFILIGRY

SEQ ID NO: 12598 - protein, 504 aa, Arabidopsis thaliana
MVVINSLRRLARTTQVHLHSKYATCMSGNSTSRRIFTTEAAPEKKNTVGSKGHDMLAPFTAGWQSADLDPLVIAKSEGSYVYDDTGKKYLDSLAGLWCTALGGNEPRLVSAAVEQLNTLPFYHSFWNRTTKPSLDLAKVLLEMFTANKMAKAFFTSGGSDANDTQVKLVWYYNNALGRPEKKKFIARKKSYHGSTLISASLSGLPPLHQNFDLPAPFVLHTDCPHYWRFHLPGETEEEFSTRLAKNLEDLIIKEGPETIGAFIAEPVMGAGGVIPPPATYFEKVQAVVKKYDILFIADEVICAFGRLGTMFGCDKYNIKPDLVTLAKALSSAYMPIGAILMSQEVADVINSHSSKLGVFSHGFTYSGHPVSCAVAIEALKIYKERNIPEYVAKVAPRFQDGVKAFASGSPIIGETRGTGLILGTEFVDNKSPNEPFPPEWGVGAFFGAECQKHGMLVRVAGDGILMSPPLIISPEEIDELISIYGKALKATEEKVKELKAQHKK

SEQ ID NO: 12599 - protein, 984 aa, Burkholderia thailandensis E264
MTSSAFDSSRQGCGSGQCACKSAAHARRADPFDDTDYGTPQRHADADVTLDIDGREVTVPAGTSVMRAAIEAGINVPKLCATDSLEPFGSCRLCLVEIEGRRGYPASCTTPVEAGMKVRTQSDRLQDLRRNVMELYISDHPLDCLTCAANGDCELQDMAGAVGLREVRYGFDGKNHLSDAKDESNPYFSYDPAKCIVCNRCVRACEETQGTFALTIAARGFDSRVAASAGDAFMDSECVSCGACVAACPTATLIEKSVARLGQPEHEVVTTCAYCGVGCSLKAEMKGEQVVRMTPHKNGQANEGHACVKGRFAWGYATHKDRITKPMIREKITDPWREVSWDEAIGHAAAQFRRIQDKHGRDSIGGITSSRCTNEETYLVQKLVRAAFGNNNVDTCARVCHSPTGYGLKVTLGESAGTQTFASVGSADVIVVIGANPTDGHPVFGSRLKRRVREGAKLIVADPRRIDLVDGPHVKAVHHLQLRPGTNVALVNALAHVIVTEGLVDEAFVAERCEPHAFDVWRAFAARPENSPEATADITGVPADAVRAAARLYATGGRAAIFYGLGVTEHAQGSTMVMGIANLAMATGNLGIEGAGVNPLRGQNNVQGSCDMGSFPHELPGYRHIGDAAVRARFDEAWATTLQPEPGLRIPNMFDAALDGSFKGLYCQGEDIVQSDPNTQHVAAALSSLECLVVQDIFLNETAKYAHVFLPGATFLEKDGTFTNAERRISRVRRAMRPLSGYADWEVTLMLSRALGYDMHYAHPSEIMDEIARLTPTFAGVSYALLDALGSVQWPCNDAAPEGTPTMHVDHFVRGKGKFMITQYIASPEKVTPRYPLILTTGRILSQYNVGAQTRRTENVRWHDEDRLEIHPHDASDRGIKTGDWVGVESRAGQTVLRALVTERMQPGVVYTTFHFPESGANVITTDSSDWATNCPEYKVTAVQVAPVAQPSEWQRAYTRFRAEQLALLEQRTAANAPATATGK

SEQ ID NO: 12600 - protein, 238 aa, Oryza sativa
MAGGGGEYLRQFVEETAWYNEIFLSHVVPGDWWRALPHPLQSWLRNGLGGYLIYFACGFLWCFVIYYWKRHAYIPKDSIPTIEAMKKQIIVASKAMPLYCALPTLSEYMVENGWTQCYVNISEVGWPMYLVYLALYLIFVEFGIYWMHRELHDIKPLYKYLHTYHHIYNKENTLSPFAEAVWTTNIHDCIHGKVWPVMGAGYHTIHHTTYRHNYGHYTVWMDWMFGTLREPEDILKKD

SEQ ID NO: 12601 - protein, 398 aa, Arabidopsis thaliana
MMSDLPRDLLEERLSRVPVKSLREARFTCKNWKTLSKKRSFTKKHLAQEATSRESEFKVVMVLHCKVYLTSINLRGIHNGFDPSINRQAKLVSLNGTDQIDISEVYHCDGLLLCISKDYTRVVVWNPYRSQTLWLKPSSPDHRMDWYICAIGYEKRKSSLRYKVLRFVDFAEEEFVEYEIYELKSNSWRVLDVTSDWEVEFYARGVSLKGNTYWFATDKFPEISSNLIHSVYFLLCFNFTSERFGPRLHLPCYPMDVDTVSLSSVREEQLAVLFQRKDNLHMEIWVTTKIEPEEVMWSKLFLAVDMQPLTDFKFGIADASFIIDEEKKVVVVFAKDKDVMYPTHNTAYIIGEDGYYKEVDLGKTTDKIRDPLVCSYVPSSAQIKQGGKRKKKGKLITD

SEQ ID NO: 12602 - protein, 626 aa, Gibberella zeae PH-1
MSHDIKKTTDIKVEVALARDVEAIEMNDMSASSSQYKDDGNNNNTTKAWAVSVPSSEEQSREQSDWLDGFRRADRRKMKKGWDKQYQSEEPPQIPGDNRYFDIRAANAKTATSALARELKGRHLQMIAFGGAIGTGLFVTSGTALHEGGPGSVLISYIAIGALQYCTMQSLAELAVIFPIAGSFSAFSTRFLDPSWGFAMGWNYCLQWLFTLPLEIIAGAFTITYWNEGITKSVFVVIFLAAIFIINLFGVKAYGEAEFVFSTIKVTAIVAFILLGIVINIGGEPTGSYIGGRYWVDPGFFNNGFKGFCSVLVTSCFSFTGTELIGLAAAETANPRKSLPSAIKQVFWRITLFYIVSLMLVSLLVPHNDPRILDASSSNSAASPFVVAIESMGTTVLPSVMNAVILIAVISVGNSSVFGSSRTLAALADQSMAPAIFSYVDKQGRPLVAIIFASCVGLLAFIVDLKAQNVIFNWLLSVSSLATLFTWGSICLTHIRFRKSWAHASHTLEQLPFRARSGTAGSWFALCGYTLILLSQVWTAVSPVEMKADATTGDIVQNVFLRLMAVPIVLVMYVGHKLWYRTSFVKLEDIDIQTGRRYYRVHLMNEEDREARGAWPLWKKIYRQVC

SEQ ID NO: 12603 - protein, 434 aa, Burkholderia thailandensis E264
MSSQSQSPSVAQSIPSYLHADDLGPWGNYLQQVDRVAPYLGSLSRWIETLKRPKRILIVDVPIELDNGTVAHFEGYRVQHNVSRGPGKGGVRYHQDVTLSEVMALSAWMSVKNAAVNVPYGGAKGGIRVDPRKLSRGELERVTRRYTSEIGIIIGPNTDIPAPDVNTNEQIMAWMMDTYSMNQGQTATGVVTGKPISLGGSLGRKEATGRGVFVVGCEAAKKKGVEIEGARIAVQGFGNVGGIAAKLFQEAGAKVIAVQDHTGTIHQPAGVDTAKLLDHVGRTGGVAGFEGAEPMPNDEFWTVETEILIPAALENQITEKNASKIRTKIIVEGANGPTTTAADDILSANGVLVIPDVIANAGGVTVSYFEWVQDFSSFFWTEDEINHRLERVMREAFAGVWAVAEEHKVSVRTAAFIVACKRILMAREMRGLYP

SEQ ID NO: 12604 - protein, 338 aa, Burkholderia sp. 383
MSTPVNRQLLLKTRPEGRVGREHFSLVETPVPALADGEVLVRVLYLSMDPTNRVWMSDVPQYLPPVAIGEVMRALGIGRVVASRNAGFAEGDLVQGLVGWQDYAVVPADQAAQLVKLPAASGLPLPTLLGACGMSGLTAYYGLTDITPVQPGETLVVSAAAGSVGSIAGQIGKIHGARVVGIAGGADKCRYLTETLGFDAAVDYKADDFRQQLKAATPDGVHVNFENVGGEVMRAVLSRMVIGGRVALCGVISNYNSGRAADDVGVLISKRLTMRGFLILDYRKSREAVQTLAGWLRDGRLKAEETVADGLENAPDVLNRLFDGDHRGKLVLRVDPDA

SEQ ID NO: 12605 - protein, 470 aa, Bacillus licheniformis ATCC 14580
MSGERRQIVIIGGGITGLAAAFYLEKEIKKNDLPAEVTLVEASPRLGGKMQTVHKDGYVIERGPDSFLERKQSAPQLVKDLGLEHLLVNNATGQSYVLVSETLYPIPEGAVMGVPTKIGPFLTTGLFSLPGKLRAGMDLVLPASKPQEDQSLGEFFRRRVGGEVVENLIEPLLSGIYAGDIDRLSLMSTFPQFYQTEQKYRSLIIGMKKSRGAQSVGKPANKKKGQFQTVKTGLQTIVEELEKQLGITKVYKGTKVVSIERAGSAYSMKLDNGKVLHADSAVVTAPHKAAAAMFQKEDWLKGLEDMVSTSVANVALGFPEEAVQMEHQGTGFVISRNSDFSITACTWTNKKWPSTTPEGKVLLRAYVGKAGDESVVEQSDNEMVKIVLDDLKRIMKIDGEPEMTCITRWHEAMPQYHVGHKKRIKEIREGLEASYPGVFITGASFEGVGIPDCIDQGKQAVADVLSHLFE

SEQ ID NO: 12606 - protein, 124 aa, Brassica napus
DHDNNATFLSTKSGKGTPQWMAPEVLRSEPSNEKCDVFSFGVILWELMTTLIPWDRLNSIQVVGVVGFMDRRLDLPEGLNPRIASIIQDCWQTDPAKRPSFEEIISRMMGLFRKAGSSAPEDED

SEQ ID NO: 12607 - protein, 209 aa, Triticum aestivum
RLLLTFSAALVGVSHGSDGTNSSVPPGKFPLGFALTLTASALFSLILSLMQLTFDKVLRSDTFHDVMEMQFWSNTAAAVVSVAGLFISGEWSALHGEMDGYKKGRVAYGMTLAWTAISWQLTTMGLMGLVASVSSLFTNVISTVGLPLSPIIAVIFLGDRMDGVKVLAMLVAVWGFLSYIYQHYLDDAKVKKILAERSAEHRTVKLATE

SEQ ID NO: 12608 - protein, 233 aa, Arabidopsis thaliana
SKPSLSQLAPLEAILFDVDGTLCDSDPIHLIAFQELLQEIGFNNGVPIDEKFFVENIAGKHNSEIALLLFPDDVSRGLKFCDEKEALYRKIVAEKIKPLDGLIKLTKWIEDRGLKRAAVTNAPKENAELMISKLGLTDFFQAVILGSECEFPKPHPGPYLKALEVLNVSKEHTLVFEDSISGIKAGVAAGMPVIGLTTGNPASLLMQAKPAFLIENYADPKLWAVLEELDNKS

SEQ ID NO: 12609 - protein, 462 aa, Burkholderia thailandensis E264
MQPAPLAPPASHGADHAESAHDLVYGPDDRPAPTVAFVAALQHLLAILVPIVTPGLLICQALGVASRDTTLIVSMSLVISGIATFVQCKRFGPLGAGLLIVQGTSFNFVGPLIAGGSLMVKQGTPVETVMAAIFGVVIAGSFVEMAVSRILPFVKRLITPLVTGIVVLLIGLTLIKVGLVSMGGGYGAIAKGSFGSAENLTLSGLVLGTIIVLNRVPVVWVRSTALVIALAIGYLAAAAMGRLDFTGAREAALFQIPTPLHFGLGFSWSLFVPMLIIYLVTSLEAIGDVTATSKISRQPVEGPLWMRRIKGGVLVNGANSLLAGVFNTFPSSVFAQNNGVIQLTGIASRHVGIWIAGMLVLLGLFPVVAGVLQAVPEPVLGGAAMVMFGAVAASGINILAGIRLDRRALLIIAVSLALGLGVSQVPEILANLPHALKNVLESGVATGGICALVMNWFLPEKK

SEQ ID NO: 12610 - protein, 205 aa, Neurospora crassa
MLRTSNAMMPSVMGAAQRRALSDSAEPARVPSVESARVPEKLAKEDSPLATPKRNSPDYNVPIDKATSTWTPVPKHIQNGSEEGILPAAVVSGAPMELQARTVRIYLPSKPATQSSNSRVLWRMDWDVLEKGHRWENELMGWQSSGDFVQGTHLTFRTKEEAIQFAEKQGYEYFVQEPNQRHFTPKAYANNFLYSPKKLKIVRTK

SEQ ID NO: 12611 - protein, 317 aa, Mesorhizobium loti MAFF303099
MKKLVCAGEILVEIMAERIGQSFLAPGPLVGPFPSGAPAIFIDQAARLGQPAGLIAAVGDDDFGHLNIERLRADGADISAIKVHRGAATGTAFVTYETDGSRHFVYNIKHSAAGLIEIGAEARALLAGADHFHVMGTSLFSPEVIEVARKGIETVKARGGTVSFDPNIRKEMLDLPGLRDALHFVLSKTDVFLPSGPELFIFARATDEESAVREMLDRGISAVVIKKGAQGAVHYDKTGRTASPGFVVEEIDPTGAGDCFAAAFVSFWLRGAAPEKALRIANGCGALAVTRKGPMEGIASLAAVEAYVATARTGAPA

SEQ ID NO: 12612 - protein, 99 aa, Arabidopsis thaliana
  misc_feature (62)..(62): Xaa can be any naturally occurring amino acid
FGEGFERGLDLAWGDPQDPNKAVDLPPKSKSMLVPGKIQHIICTGNLCIKKIHDSLKTICPXDWHIVQGGLAKNPRTLGNKTLPFGQLKLGLGHGHQGI

SEQ ID NO: 12613 - protein, 321 aa, Mesorhizobium loti MAFF303099
MMEMAMTLDPDALRALVIGRVAGGEPFEKGSVAAARAAYNASFPTQQGEHEPVAASQERQTDGPNGPVKIRVHRGIGAPRAGARAVLYLHGGGWVIGNLSSHDEICRWLANLSNAVVVYPDYRLAPEHKFPAGLEDCTAALRFMAENAGELGIDPARISVAGDSAGGNLAAVLALLARDRLVPRLAAQVLIYPNTDARQTADSYRRFGDGFGLTAATMAWFRDHYVRTPNDITDWRVSPLLASSLAGAAPAFVVIAGHDILADEGTAYAERLRVAGVPLVLRPWPGQIHGFVSMGRHILAARQAVSEAAAWLQLQTRVQAD

SEQ ID NO: 12614 - protein, 377 aa, Oryza sativa (japonica cultivar-group)
MADADDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDYLMKILTERGYSFTTTAEREIVRDVKEKLSYIALDFDQEMATAATGSSVEKSYELPDGQVITIGAERFRCPEVLFQPSFVGMEAAGIHETTYNSIMKCDVDIRKDLYGNIVLSGGTTMFPGIADRMSKEITALAPSSMKIKVVAPPERKYSVWIGGSILASLSTFQQARTRPPTPFFPYFLLPPFRNV

SEQ ID NO: 12615 - protein, 257 aa, Glycine max
MSDSSREENVYMAKLADEAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDIAGDEIKETSKQQPGE

SEQ ID NO: 12616 - protein, 322 aa, Oceanospirillum sp. MED92
MQPHQLNPAIEPQFEAVNDYIINHLGSNVPLVEKIGHYIVESGGKRLRPLLVLLAANAAGYKGDKHVPLAAIIEFIHTATLLHDDVVDNSDLRRGKDTANAKWGNAPSVLVGDFLYSRAFQIMVEIGSMQIMEVISNATNVIAEGEVLQLLNTKNPDTTEEAYMQVILGKTAMLFEAATEAGAILADATAEEREGLRLYGLHLGTAFQLIDDVMDYLSTAEEMGKNVGDDLAEGKATLPLIHAMRAGNEEQRLLVRQAIRKGGLDDLQPIMDIVKETGAIEYTQQKAQEEADKAIAALSALSDSSFKETLVQLANMAVKRKS

SEQ ID NO: 12617 - protein, 306 aa, Nocardia farcinica IFM 10152
MSFRPSGIFVPLVTPFDEHGAVAAAELARLAHTVLDEGAAGLVALGTTAEPATLSAAERVRVLRVCGEVCRARGVPLIAAVGSNDTVATVRAIVQTVARTDVAAVLTVVPYYVRPSEAGVVAHFEYVAERSPVPVLVYNVPYRTAQTVGYEAMLELARKPGIVGVKQAVGAVDTDTARLIAHAPATFSVLAGEDTLVSPLLAMGACGGILATANVCAGELVELHRRWLDGTPDPARELADRLVEPARLLLSEPNPTVIKAVLHARGLLSTPRVRLPLLTAAPSPAVLAAVRALRAEYPGEVVTTGR

SEQ ID NO: 12618 - protein, 316 aa, Mesorhizobium loti MAFF303099
MPAVPSILGFGAIAIDDIVYVDQPLSAGKGRVRQSARAFGGNVATALAAVARLGGSAGFVGWLGTAADDPVLCDLIESGVETAFAPRHADARPVRSRITVGSDGERFIAYDDDAMLGTTPDFSDDILNRAAVLIVDSYAIRSMDVVTRARDLGLAILGDIEWSGGPATERLIGLCDHLILPLGFARTATGCRLPAEMLEALWSPSRSAVVLTDGGRGVYYRGREETRLWQLPPHRVAVVDSTGAGDCFHGAYAHALTRGADTAGRVAFAAAAAALSITGRGGREALPTEDQVTELLASANAPSAVELKYAQLDTGT

SEQ ID NO: 12619 - protein, 424 aa, Corynebacterium efficiens YS-314
MSTDATTTGLLIVGANQAGVQLAVSLRATGFTDHITLLGEEDHRPYQRPALSKEFLQGKIDKERLIFRSNEYWEDNNISLVKGVRIERIDKNDDGSGVAVGRDGSTYAFRRLALAVGARPRRLDLPGSDLRGVTYLRNADDALELKALVGDVRDAVVIGGGFIGLEAACSLQELGKNVTVLEHGPRLVGRAVGEETAGFFLEQHRARGIDIRLNARLSGFVGEGGAVTGVELDDATIIPAQLVIVGIGVIPNTELAEQMGLEVDNGIVVDEHAVASDGTTIAIGDVANIPNPIPGSPAGERIRLESVNNAIEHAKIAAYSLAGTPEAYSGIPWFWSNQGDLKLQIAGLTLGYDQTLIRRDDAKKKFSVLYYRDGQIIAADCVNSPLDFMAVRGALSKRQNIPFDAAGDINTPLKKLAVDLEVAS

SEQ ID NO: 12620 - protein, 141 aa, Mesorhizobium sp. BNC1
MAQIEHILTSHAPKPLGHYSQAARAGGFIHVSGQLPIKPEGQSEQSDDLFDNQASLVLRNLLAVLEAAGATPSHVVKVTAYIVGVEHWSSFNAAYAKAFGEARPARSVVPVPALHHGYLIELDAVALDPSDTDRGAAAITA

SEQ ID NO: 12621 - protein, 218 aa, Oryza sativa
MEVEEAAYRTVWSEPPKRPAGRTKFRETRHPVYRGVRRRGGRPGAAGRWVCEVRVPGARGSRLWLGTFATAEAAARAHDAAALALRGRAACLNFADFAWRMPPVPASAALAGARGVRDPVAVAVEAFQRQSAAPSSPAETFANDGDEEEANKDVLPVAAAEVFDAGAFELDDGFRFGGMDAGSYYASLAQGLLVEPPAAGAWWEDGELAGSDMPLWSY

SEQ ID NO: 12622 - protein, 695 aa, Oryza sativa (japonica cultivar-group)
MEIVDKIAEPKEPLMVTGRKVQSLEAPIPIKASWKGKSSQQQQQQQQDEKDFPADGEESFLSLDSSDEGGRSSFSGASHPLEPIDMDLMKTVYVAIDEEKSEQPVCLVRGVSAKGPFIDDLSICVTGMKANAVVGAGSADGLAEEMKVPGAAVPSLATARSSQATEAVSLPPDSEEKDCVWDASLPPSGNVSPHSSIDSMGVVTAMNTMSSCTSTYKSEAVSSEPVPTMERNCGSVKGSVRGDSLESAKTSMSRASDSSGVSDDSSWSNITGGASKPHKGNDPRWKAIHAVRTRDGVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQRQAGKHFSEYAARFYAAEVLLALEYLHMLGVVYRDLKPENVLVRDDGHIMLSDFDLSLRCAVSPTLIRASAFDSDPRRAGGSFCVQPVCMEPTSVCIQPACFMPKLFGQKSKKKTKKTRSELGPSATTMPELVAEPTSARSMSFVGTHEYLAPEIIKGEGHGSAVDWWTFGIFLHELLYGKTPFKGSGNRATLFNVVGQQLRFPESPSTSYASRDLIKGLLVKEPQHRLGVKRGATEIKQHPFFEGVNWALIRCSTPPDVPRPVEAELPVKYGVAEAIGSNSKRMVGADMKSGGKYLDFEFF

SEQ ID NO: 12623 - protein, 438 aa, Burkholderia sp. 383
MSLLPTTATAPFCPSEVKGSITIDAGAPRWLKLKRFFGPGLLVAIGYMDPGNWATDIQAGSQFGYSLLWVVAFSSLAAIFLQMLAARLGLVAGRDLAQASYDRYGRFGRIVQWVTAEVSIIACDIAEVLGCALAFKLLLGVPLAWGIVLTALDTVIVLGLQGKGFRQIEAIVLALIATMAFCFVAQVAITPPDWHAVVGGLVPGDPGHDRKDAIVLALGIVGATIMPHNLYLHSSVVQTRRVVGGARGMIRDTLALVRIDTFVSLFVAMLVNAAILVVAGAAFHATGQHNVTDIEQAYKLITPIAGGAAALLFGIALLASGQSSTLTGTIAGQVIMDGFLHTKIPCYQRRLITRGLALVPALIGVLWLGDGSVGQLLVWSQVLLSLQLPFAMWPLIRSVSDRNTMGEHTIGRGMQIAAWALFAVITGTNLLLITGVAG

SEQ ID NO: 12624 - protein, 148 aa, Chlamydomonas reinhardtii
MLQLANRSVRAKAARASQSARSVSCAAAKRGADVAPLTSALAVTASILLTTGAASASAADLALGAQVFNGNCAACHMGGRNSVMPEKTLDKAALEQYLDGGFKVESSIYQVENGKGAMPAWADRLSEEEIQAVAEYVFKQATDAAWKY

SEQ ID NO: 12625 - protein, 585 aa, Elaeagnus umbellata
MCGILALLGCSDDSQAKRVRVLELSRRLKHRGPDWSGLFQFGDCYLAHQRLAIIDPASGDQPLFNEDKTVVVTVNGEIYNHEELRKKLSHHKFRTGSDCDVIAHLYEEYGEDFVDMLDGIFAFVLLDTRDNSFIVARDAIGVTSLYIGWGLDGSIWISSELKGLNNDCEHFETFPPGHLYSSKAGGMRRWYNPVWFSETIPSAPYDPLALRRAFENAVIKRLMTDVPFGVLLSGGLDSSLVASITARHLSGTKAAKQWGTKLHSFCVGLEGSPDLKAAKEVAAYLGTVHHEFHFTVQDGIDAIEDVIYHVETYDVTTIRASTPMFLMSRKIKSLGVKMVMSGEGSDEIFGGYLYFHKAPNKEEFHEETCRKIKALYLYDCLRANKSTTAWGLEARVPFLDKEFINVAMNIDPEYKKIKRDEGRIEKWVLRKAFDDEERPYLPKHILYRQKEQFSDGVGYSWIDGLKAHAAKHVTDKMIRNAAHIFPHNTPNTKEGYYYRMIFERFYPQNSARLTVPGGASVACSTAKAVEWDESWSKNLDPSGRAALGVHLSAYDNQVPSGVVQPEIISNVPQITVNTLGLEIQS

SEQ ID NO: 12626 - protein, 175 aa, Triticum aestivum
MAPTVMASSDTSVAPFQGLKSTAGLPVSRRSNGASLGSVSNGGRIRCMQVWPIKGIKKCETLSYLPPIITEALLKQVDYLIRSKWVPCLEFRKVGFIFREHNASPGYYDGRYWTMWKLPMFGCTDATQVINDVEEVNKEYPDAYVRIIGFDNMRQVQCVSFIAFKPPGCEESGKA

SEQ ID NO: 12627 - protein, 487 aa, Legionella pneumophila subsp. pneumophila str. Philadelphia 1
MKTNIPTLSKPIKDSGYRRGLKDRHVQLIALGGIIGSGYFLGTGEVINLVGPSVFIAYLLGGLIIYLTMLCMGELAVAIPISGSFVTYTSDFISPTVACGVGWSYWITWVAYIPAECVAGGIIMELFTGVSGYIWVVCFGLIITYINLAKVDTFGEIEFWLALIKIISLLAFVFLAILIFFGLIHGSEPPGIIGFKYLLGDGGLLPNGAMSLLTAMVLLLVNYQGSEIIGLAAGESENPARMIPHAIRNVTFRILFLYIIPVFCLVLIFPWQKAGLSNSVFADALNFYGLKWAGAVTSFVTLSATLSCANSGFYGAVRSLNALARDGMAPHVLAKFNQNSVPQNAVIATLIGVWILLGVGYFFGQTKLYIALLLVSGFTGTLAWLSLCIAQISFRNRLYKAGYSIKDLRYVTPYSPYTGILAVILMVGSLFFLLLNKDPIYKLSFIIGVVSFIIPVIIYKVFDLSKVRKKALHVKSRVKFQDLFPPQ

SEQ ID NO: 12628 - protein, 201 aa, Zea mays
MDLVPHPDSPHSDNSGGGGGSASGALSPGASSAGAASALASPSRYEAQKRRDWNTFGQYLRNHRPPLSLAQCSGAHVLEFLRYLDQFGKTKVHTPACPFFGHPNPPAPCPCPLRQAWGSLDALVGRLRAAFEENGGRPESNPFAARAVRLYLREVREHQARARGVSYEKKKRKKAQRPADHASGSGGGQGPHHPPPAGASG

SEQ ID NO: 12629 - protein, 412 aa, Arabidopsis thaliana
  misc_feature (60)..(61): Xaa can be any naturally occurring amino acid
MSSIIHGAGAATTTLSTFNSVDSKKLFVAPSRTNLSVRSQRYIVAGSDASKEKEGLFWWXXPGLRVRHSQKLIPNAVATKEADTSASTGHELLLFEALQEGLEEEMDRDPHVCVMGEDVGHYGGSYKVTKGLADKFGDLRVLDTPICENAFTGMGIGAAMTGLRPVIEGMNMGFLLLAFNQISNNCGMLHYTSGGQFTIPVVIRGPGGVGRQLGAEHSQRLESYFQSIPGIQMVACSTPYNAKGLMKAAIRSENPVILFEHVLLYNLKEKIPDEDYVCNLEEAEMVRPGEHITILTYSRMRYHVMQAAKTLVNKGYDPEVIDIRSLKPFDLHTIGNSVKKTHRVLIVEECMRTGGIGASLTAAINENFHDYLDAPVMCLSSQDVPTPYAGTLEEWTVVQPAQIVTAVEQLCQ

SEQ ID NO: 12630 - protein, 391 aa, Oryza sativa (japonica cultivar-group)
MAPLRGAKRRRKAAAEKKAAMAAAAAAGGAPGAGGGDWWDGFCMRMSGTLSGIQDAQRFEFIFKMPRRTFNYICGLVRDEMMVRSSSYTFLDGKVLSLEDRVAVALIRLNSGGSLVTVGSAVGVNHSTVSLITWRFVEAMEERASHHLRWPDSSEVEKIKSMFEKIHGLPNCCGVVDTTHITMCLSSAEPNCKVWLDHEKNYSMVLQAVISPDMRFMDIVTGWPGSMKESSILHSSGLFKMCEKGARLNGSKMVVSDGSEIGEYIIGDAGYPLLPWLLTPYQEKDLSDSKLEFNKRHAAAITVAPSTLANFKDTWKFLHGEMWRPDKHRLPRIIHVCCMLHNIIICLQDATIDEAAMSNDHDANYKQQVCQLADENAVRVRDKLSEHLVSR

SEQ ID NO: 12631 - protein, 326 aa, Cenarchaeum symbiosum
MRRPIRTGRYAGYISLRGGWPLLSYTMRRNLWTSLLRRFMAARMIGEDDVRKFVPSRRRDSRKGENGKVLVVGGSYIYHGAPIFSSVAALRSGCDLVYTAVPKINAPATRAASPSMIVIPLADQKLTRGAARKLAGQIPTGLDSATIGMGLAIAERSALKVLVVALVDMDVRISLDAGALVREILGDISGKNCLVTPHAGEFKRLFGESPPADIEGRASMVERLAQEHGITILLKGPTDVISDGNRTLLNDRGAPAMTVGGTGDVLSGIAAGILARNRSPLESAAAAAYINGLAGEAAQEMHGLHITAMDLCELLPSVMKPFDRLE

SEQ ID NO: 12632 - protein, 194 aa, Saccharomyces cerevisiae
MVTSNVVLVSGEGERFTVDKKIAERSLLLKNYLNDMHDSNLQNNSDSESDSDSETNHKSKDNNNGDDDDEDDDEIVMPVPNVRSSVLQKVIEWAEHHRDSNFPDEDDDDSRKSAPVDSWDREFLKVDQEMLYEIILAANYLNIKPLLDAGCKVVAEMIRGRSPEEIRRTFNIVNDFTPEEEAAIRRENEWAEDR

SEQ ID NO: 12633 - protein, 117 aa, Streptomyces coelicolor A3(2)
MAGEPQDDCLFCKIVAGQIPATIVRETDTTVAFRDINPQAPTHVLVIPKAHHKDAAALAAEAPQLAADVLRETQAVADDEKLDSYRTVFNTGSGAGQTVWHAHAHVLGGRGLEWPPG

SEQ ID NO: 12634 - protein, 118 aa, Zea mays
MQAKISRSPLVSASKMSGRGKGGKGLGKGGAKRHRKALRDNIQGITKPAIRRLARRGGVKRISGLIYEETRGVLKIFLENVIRDAVTYTEHARRKTVTAMDVVYALKRQGRTLYGFGG

SEQ ID NO: 12635 - protein, 437 aa, Idiomarina baltica OS145
MSTNTSTGAHSRAVAAQAIHAVLEQGQSLTQALTTYSEQLSAEDKRLAQAISYGVMRYLPVLTEKVSGKLDKPLKGKNQIIQSLLLVGTYQLFKLRTKDHAAVSATVEASKLLKRKALSGLVNGVLRQVLREAPTRNDDGERELPSAEGGNHPRWLREKIRAAYGEKAEAVFTANDSQPPLWLRANRRHTNVTDYTALLAENGIEAVADSQASDAIRLVKPVPVTKLPHFEAGWVSVQDRSAQLAADMVDAQPEHRVLDCCAAPGGKTVHLLERTEFQTPLIAIDVDEQRLERVSENLYRADLSCEVVCADVLDLDSWWDKQPFDRILLDAPCSATGVIRRHPDIKWLRRSSDIDQLVELQQSMLERLWPTLKPGGQLIYATCSILPEENSEQISHFLGQHSDANLIAIEANRPMLQLLPGENDGDGFFYAKIEKLP

SEQ ID NO: 12636 - protein, 608 aa, Malus x domestica
MDVRRRSTMDTPATKARSGPMKVKVVDHENDVGVVGAKASDALPLPLYLTNAVCFTLFFSVVYFLLTRWREKIKTSTPLHVVNLSEIVAILAFVASFIYLLGFFGIDFVQSLILRPSNDVWAADDDEEEHERLILKDDARKVPCGAGLDCSPIPQIASVAAAAPKAVAQKVFDKEVVLSTSCDFTAQPLTEEDEEVVKSVVAGTIPSYSLESKLGDCRRAAAIRREALQRITGKSLGGLPLEGFDYESILGQCCEMPVGYVQIPVGIAGPLMLHGREFSVPMATTEGCLVASTNRGFKAINLSGGATSVLLRDGMTRAPCVRFNSAKRAAELKFYLEEPNNYDTLSTVFNRSSRFGRLQTIKCAIAGKNLYMRFTCSTGDAMGMNMVSKGVQNVLDFLQNDFPDMDVIGISGNYCSDKKPAAVNWIEGRGKSVVCEAVIKGDVVQKVLKTNVASLCELNMLKNLTGSAMAGALGGFNAHASNIVSAIYIATGQDPAQNVESSHCITMMEPINDGQDLHVSVTMPSIEVGTVGGGTQLASQSACLNLLGVKGANREAPGSNARLLATVVAGSVLAGELSLMSAISAGQLMNSHMKYYRSSKDVSAVASA

SEQ ID NO: 12637 - protein, 472 aa, Mycobacterium smegmatis str. MC2 155
MRPARIVIVGSGFAGFECARRLSKQLKRHRSEAVVTLISPVDYLLYTPLLPEVAGGATDPRFATVPLNDRLPEVQFIRAYVDSVDLSARSLRCRDQENMSHELSWDRLVLTPGSISRLFDIPGLAEHGRGLKSTAQALFLRDHIIEQFELARIDEDRERANARKTVVVVGSSYSGTELIAQLCAMASVAVHDFGFEPGDVRLILVERSGRLMPEIGPALAVRAEHVLKRRGVRFLTGVTLSRVAADHVILSDGTRIGTYTVAWVAGVVASPLITATGLPTEKGRLKVGPDLQVPGFDGVFAGGDAAAVPDVTNPGTITPPTAQHATRQGKILARNVAASLGYGSAREYRHRDLGTVVDLGPGFAVANPLNIPLSGFLAKLVTRAYHLYAIPRNANRWAVALGYLTNVLFGRPLVSIGFAQPSWAQFSASEEFMTAPTATQPLDEQMYTDDLRFQEASADRASAPGDRARKAT

SEQ ID NO: 12638 - protein, 287 aa, Erythrobacter sp. NAP1
MTSLPPLAQVIGDPIAQSKSPIIHRFWLEKLGLSGDYTAAHVSAEHLADYLGTSRTKSGWVGCNVTMPHKQDIIPLLDALDPTAAKLGAVNTVVRSDDGLLTGYNTDAGGFLEPLRQELANNHLFRMARILGTGGAARAIIAALADQGFTLVVAGRDPAKARALLDKLAPEGEHHAIHLSHFADTTDFAFDDREGCMDLIVNASPLGMTGNEPLAFDLSHAPPRSIVYDIVTSPVETALLTEAKAAGFRTIGGLAMLIGQAAIAFEKFYGTPPPRAHDAELMKRLSQ

SEQ ID NO: 12639 - protein, 194 aa, Glycine max
MRPPRGGGRGGGFRGGRDGGGRGRGGFGRGGGGFGRGGGGYRDEGPPSEVVEVSSFMHACEGDAVTKLTNEKVPFFNAPIYLKNMTQIGKVDEIFGPINEAYFSIKMMEGIVATSYSSGDKFYIDPRKLLPLARFLPQPKGQSAGRGGGGGGRGGFRGGRGGGGFRGRGAPRGGRGGPPRGGGRGGGFRGRGRS

SEQ ID NO: 12640 - protein, 659 aa, Skeletonema costatum
MASYESDLLSTWDEDPSLQKGFDWEIEKLRRYFAGLRQTPDGRWVRKSTLFEFLVTNSPSKVVGVGPDGERYESPPKPVNIFDVGVLVGKNTLTWLGFGPNLGMAAVPDAVIQKYEGSFFTFIKGALGGDLQTLAGGPLFLLLAKYYTDHGPIFNLSFGPKSFLVISDPVMARHILRDSSPEQYCKGMLAEILEPIMGDGLIPADPKIWKVRRRAVVPGFHKKWLNSMIGLFGDCGDRLVDDLEKRSTSDKPVIDMEERFCSVTLDIIGKAVFNYDFGSVTKESPIVKAVYRVLREAEHRSSSFIPYWNLPYAEKWMVGQVEFRKDMGMLDDILAKLINRAVETRQEATVEELEERETSDDPSLLRFLVDMRGEDLTSKVLRDDLMTMLIAGHETTAAMLTWTMFGLVSNDPGMMKEIQAEVRTVMGNKSRPDYDDVVAMKKLRYALIEALRLYPEPPVLIRRARQEDTLPPGGTGLSGGVKVLRGTDIFISTWNLHRAPEYWENADKYDPTRWERPFKNPGVKGWNGYDPEKQSSQSLYPNEITSDYAFLPFGAGKRKCIGDQFAMLEASVTLSMIMNKFDFTLVGTPEDVGMKTGATIHTMNGLNMMVSPRSETNPIPGTNEWWTKQHLMRGLSSTGRPYTSDEDAAWTTSANGMRP

SEQ ID NO: 12641 - protein, 1565 aa, Gibberella zeae PH-1
MRETIQSYIVRISPPGSDKASPPVKGRDKGKAPRKRVGLTQVYPEPGSKRNHQKLKNDIIALHGLDATSPETWIGWKVDGDPNSGDVNWLEDKHMLPRFMPDSRILTYQWNANYDAYASSDRFSGHATSLLQDLHADRFSECRSNCPIIFIVSCFGGLLLAQALVIASHPTEPGHRQHSSILRHTIGAAFLGTPFGGSPLDDLANQFGNLIHSDKYKFPVMCVYETRHTDLSAYKRRLGANFSSMGLDENYHGIVVDSKSATISGMEAYGFDVRHNMLHKFNDSNDVNFKKIRHWLVKTADIAGETLGCKASNDRPVNDLYDDRSHSGSKSDTRLFDLPGSRVRKNPRKPEAREKLYNKLHFKTLGERYKNIWPAHRATCKWLLKNKEYQAWLDKGKLEDHHGVLWLKGNPGTGKSTLMKFAVSKLSMENPKDIHIFFFFNARGDALEQSTVGMYQSLLHQLFSQIPRLKYVFDDFAQFDLPETDIYESWALQTLESLLMHAISELGSHKLWVFVDALDEGNEKEVRKMITFFGGLGKEAKDANVDMRVLFASRHYPQITISHKVEIILESEKEHYLDIKRYVQSELYIKDGMTAQGIQDEVINRASGFFLWVVLVVEILNETAAKGMNQKEKLKELPDHLSTLFEGILTRDRENMKGTLLCIQWVLFSRKPLTREELYYAILHGANEKETRSWAADYVTIEIMDAFILTCSKGLVQFSGETAQFIHETVRDFLIHDNGMQLIASDATKSIKGAAHDTLKSCCLNCISSTLKIIWGSGRPVRFDNLDRLRGIYDSIVESGRKNYSKSKPLYKTPFLHYALFHLLHHANAAEAGGVSQVSFIQAFQLRSWVYLRKVFLELGTFNSLRSTFLYTLAEEGLGSLIMAMLHADPGKTPHLLVEELLRHEDVELNFRDAEKGRTPMWCDAEEGYEAIVKLLLERQGVDVESKDTEYGQTPLCVAARFGHREVVRLMLYGSSLAGSLKLFSSPRPISHPSHSLRCWNRDAEFNMAYQREFEMQAIPPPSPKTLPSTEPSSNTPTPDPDPDSTSPGALHRLLTSFTRAPPPSHSEDEYSLSSYNTSYATNGRLFNMSKANYNSANTALARELKNRHLQMIAFGGSIGTGLFVASGVALFRGGPASLLIAFITMGTMQFFTMQALGELSVAFPVGVLPLEIIAGAFTTNYWNPDASKSIFIILFFFLILGINLLGVKGYGEAEFIFSAVKITAVMGFILLGIIINIAGEPEGGYIGFSHWQNPGAFNNGFKGFASVLVTATFSFAGTEMVGLAAAETSNPKKSLPAAVKQVFWRISLFYILSILLIGLLVPYNEPRLLGAKYGSDAAASPFVIAIEMSGSDILPDIMNAVILISLISVGNTAVYASSRTIAALAEQSLAPKIFAYIDRAGRPLIAIICCGTVGLLAFVANSDIHNEIFNWLLAISGLSTLFTWASICVCHIRFRKAWRLSGYKLSQLAFKSQVGVWGSWVALAAYTTVLLLQFWVAISPIQPTDQAPFTTPERIKNFFLQVLTVPVILIFYIVHKLWMRTKIVRDKDIDIHTGRRYLQEYAAY

SEQ ID NO: 12642 - protein, 241 aa, Burkholderia thailandensis E264
MSSSSPSFAASQSGAPRLEACEAVLFDLDGTLADTAPDLAAAVNKMQRSRGAAPTPLDALRPLASAGARGLIGGAFGIVPADAEFDALRDEFLANYATDLCVHTTLFPGIGALLDDLDARGVRWGIVTNKAARFTDPLVALLGLAARAACVVSGDTASHPKPHPAPLLHAAQSLSLAPERIVYVGDDLRDIQAGSAAGMPTVAAAYGYCGDGVAPADWQAQHLVETTDDLQRLLRVLRYND

SEQ ID NO: 12643 - protein, 191 aa, Zea mays
MGFSEAQEELVLRSWKAMKSDSESTALKFFLRIFEIAPGAKQMFSFLRDAGDAPLEKHPKLKAHAVTVFVMACESATQLRSTGDVKVREATLKRLGATHARAGVADAHFEVVKTALLDTIRDAVPDMWTPEMKAAWEEAYDQLAAVIKEEMKNAAAAEEQTKNAATAEEEIKNAAAAEEETTNAAAAVDGS

SEQ ID NO: 12644 - protein, 314 aa, Saccharomyces cerevisiae
MEQLCKRYVHTPAAFIQNIVANTKRTTLATQLSVEKAKKKVPKTALKKKLNSRPKERLPNWLKLNDVFNIHYEKPSNSDINKVNRFFNKAKVEFEWCAASFDDIPENPFLNKKSHKDILKDHGECGTTLIDTLPEVIFLGGTNVGKSSILNNITTSHVSRDLGSLARVSKTTGFTKTLNCYNVGNRLRMIDSPGYGFNSSKEQGKVTLQYLLERKQLVRCFLLLAGDKEINNTDNMIIQYIHEHGVPFEVVFTKMDKVKDLNKFKKKVMSSGLMDLPTLPRLVLTNSLTSSTSPKRFGIDLLRYVIFQSCGLIL

SEQ ID NO: 12645 - protein, 285 aa, Bacillus licheniformis ATCC 14580
MSKQPKKVLPPQHQTQRPGLEYLMDPRPVFDRPKRERKLAGKTAIITGGDSGIGRAVSVLFAKEGANVVIVYLNEHRDAEETKGYVEKEGVGCKLIAGDIGDEAFCNDVVRRAKEAFPTIDILVNNAAEQHPQKGIEKITSHQLIRTFQTNIFSMFYLTKAVLPHLKKGSSIINTTSITAYAGNERLIDYSSTKGAITSFTRSLALSLVDQGIRVNGVAPGPIWTPLIPSTFTEREVEIFGSTTPMERPGQPAEVAPSYLFLASDDSSYMTGQVLHVNGGTIING

SEQ ID NO: 12646 - protein, 378 aa, Streptomyces coelicolor A3(2)
MATDYYAVLGVRRDASQDEIKKAFRRLARELHPDVNPDPKTQERFKEINAAYEVLSDPQKKQVYDLGGDPLSQAAGGGAGGFGAGGFGNFSDIMDAFFGTASQRGPRSRTRRGQDAMIRIEVELDEAAFGTTKDIQVDTAVVCNTCNGEGAAPGTSAQTCDMCRGRGEVSQVTRSFLGQVMTSRPCPQCQGFGTVVPTPCPECAGDGRVRSRRTLTVKIPAGVDNGTRIQLAGEGEVGPGGGPAGDLYVEIHELPHSTFQRRGDDLHCTVTIPMTAAALGTKVPLETLDGMEEVDIRPGTQSGQSIPKHGRGVTHLRGGGRGDLIVHVEVTTPGKLDPEQERLLRELAKLRGEERPTGQFQPGQQGLFSRLKDAFNGR

SEQ ID NO: 12647 - protein, 162 aa, Parasponia andersonii
MSSSEVNKVFTEEQEALVVKAWAVMKKNSAELGLQFFLKIFEIAPSAKNLFSYLKDSPVPLEQNPKLKPHATTVFVMTCESAVQLRKAGKVTVKESDLKRIGAIHFKTGVVNEHFEVTRFALLETIKEAVPEMWSPEMKNAWGVAYDQLVAAIKFEMKPSST

SEQ ID NO: 12648 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEVEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMTHDDKPLYKRMFSTK

SEQ ID NO: 12649 - protein, 196 aa, Campylobacter upsaliensis RM3195
MISSATFLTSLAKFDPNFEANCAEVAFLGRSNVGKSSLINTLCKQKKLAKSSSTPGKTQLINFFEIKCKKNEEEFKIHFIDLPGFGYAKVSKNLKEIWNKNLDEFLKLRTSIKLFLHLIDARHTNLEIDLDVDVYLKSFLRGDQQILKVFTKADKLNQSQKTKLKNDFENSLLISNLNKSGLTLLENIILEKTLGL

SEQ ID NO: 12650 - protein, 483 aa, Glycine max
LFSLHKARVPSLKPPACDAATPCNEVSGGKAAMLFAGLYLVALGVGGVKGSLPSHGAEQFDDNTPSGRRQRSTFFNYFVFCLSCGALIAVTFVVWVEDNKGWEWGFGISTIAIFVSIPVFLAGSTTYRSKIPSGSPLTTILKVLVAASLNSCFNSRNSSSAVVNMTSSPSNPHSGSRKQQAGKEASNTTNKEPEALTNTLKFLNKAADQNNNNPIYSSIECTVEQVEDVKIVLKVLPIFACTIMLNCCLAQLSTFSVEQAATMDTKLGSLKVPPASLPIFPVLFIMVLAPIYDHIITPFARRVTKTEMGITHLQRIGIGLVLSIVAMAVAAVVEVKRKRVAMETHTNNNNSLLGHDATKPLPITFLWIAFQYLFLGSADLFTLAGLLEFFFTEAPSSMRSLATSLSWASLAVGYYLSSAIVSIVNSVTGNTSHRPWLSGANLNHYHLERFYWLKKKKKEKKKKKNLFWAIRYKYRGTGTTNNN

SEQ ID NO: 12651 - protein, 449 aa, Streptococcus agalactiae NEM316
MSKQYDYIVIGGGSAGSGTANRAAMYGAKVLLIEGGQVGGTCVNLGCVPKKIMWYGAQVSETLHKYSSGYGFEVNNLNFDFTTLKANRDAYVQRSRQSYAANFERNGVEKIDGFARFIDNHTIEVNGQQYKAPHITIATGGHPLYPDIIGSELGETSDDFFGWETLPDSILIVGAGYIAAELAGVVNELGVETHLAFRKDHILRGFDDMVTSEVMAEMEKSGISLHANHVPKSLKRDEGGKLIFEAENGKTLVVDRVIWAIGRGPNVDMGLENTDIVLNDKGYIKTDEFENTSVDGVYAIGDVNGKIALTPVAIAAGRRLSERLFNHKDNEKLDYHNVPSVIFTHPVIGTVGLSEAAAIEQFGEDNIKVYTSTFTSMYTAVTTNRQAVKMKLITLGKEEKVIGLHGVGYGIDEMIQGFSVAIKMGATKADFDDTVAIHPTGSEEFVTMR

SEQ ID NO: 12652 - protein, 253 aa, Brassica napus
MASNFWTSTHYKELKDPEEINVVHPLDAQRGISLEDFRLIKLHMSNYISKLAQHIKIRQRVVATAVTYMRRVYTRKSLTEYEPRLVAPTCLYLACKAEESVVHAKILVFYIKKLYADEKFRYEIKDILEMEMKVLEALNFYLVVFHPYRSLPEYLQDSGLNDTSMTHLTWGLVNDTYKMDLILTHPPHLITIACIYVASVYKERDIKTWFEELSADMNIVKNIAMEILDFYENHRMFTEERVHAAFNKLATSP

SEQ ID NO: 12653 - protein, 156 aa, Brassica napus
  misc_feature (123)..(123): Xaa can be any naturally occurring amino acid
  misc_feature (155)..(155): Xaa can be any naturally occurring amino acid
PLSAALTMISCGEDSSQGLCELPDLDLGSLQSGQQLLDKAFYECEQDLMMKSAMESSFSDVLDIKNISDVLDVKNVSDVLDIKNVSLVTASNEKQDMQKSVSSGNLSSMDWSQAQQEAVVIQXFPDFAQLDFCSDYGMRRAFSEGDIQKLGTGLXP

SEQ ID NO: 12654 - protein, 578 aa, Arabidopsis thaliana
MCGILAVLGCVDNSQAKRSRIIELSRRLRHRGPDWSGLHCYEDCYLAHERLAIVDPTSGDQPLYNEDKTIAVTVNGEIYNHKDLRENLKSHQFRTGSDCEVIAHLYEEHGEEFVDMLDGMFAFVLLDTRDKSFIAARDAIGITPLYIGWGLDGSVWFASEMKALSDDCEQFMCFPPGHIYSSKQGGLRRWYNPPWFSEVVPSTPYDPLVVRNTFEKAVIKRLMTDVPLGVLLSGGLDSSLVASVALRHLEKSEAACQWGSKLHTFCIGLKGSPDLKAGREVADYLGTRHHELHFTVQDGIDAIEEVIYHVETYDVTTIRASTPMFLMSRKIKSLGVKMVLSGEGSDEIFGGYLYFHKAPNKKEFHEETCRKIKALHQYDCLRANKSTSAWGVEARVPFLDKEFINVAMSIDPEWKMIRPDLGRIEKWVLRNAFDDEKNPYLPKHILYRQKEQFSDGVGYSWIDGLKDHANKHVSDTMLMNASFVFPDNTPLTKEAYYYRTIFEKFFPKSAARATVPGGPSVACSTAKAVEWDAAWSQNLDPSGRAALGVHVSAYGEDKTEDSRPEKLQKLAEKTPAIV

SEQ ID NO: 12655 - protein, 143 aa, Erythrobacter sp. NAP1
MTISKIIGDRDATDIISCEVTTPVAEAVSLLAGKRIGALPVMRDGKIAGIISERDVVYRLAESGHDALDMTVGDIMTSPAVTVEPTTLIDDALALMTKRRFRHFPVVDNDKLVAFISIGDLVKHKIDEVEHEAAALRDYIQHA

SEQ ID NO: 12656 - protein, 396 aa, Glycine max
MAVEYTCCSTAFFVHILVIVLLVLFAGLMSGLTLGLMSLSLVDLEVLAKSGTPQDRKHAEKILPVVKNQHLLLCTLLICNAAAMETLPIFLDGLVTAWGAILISVTLILLFGEIIPQSVCSRYGLAIGASVAPFVRVLVCICFPVAYPISKAGKGGELTHDETTIIAGALELSEKTASDAMTPISETFTVDINSKLDRELMNEILEKGHSRVPVYYEQPTNIIGLVLVKNLLTVHPEDEAPMKSVTIRRIPRVPESMPLYDILNEFQKGHSHMAVVVRRCDKTNQQSSQNNANDSVRDVKVDIDGEKPPKEKALKPKMPLHKWKSFPNTNKSSNRGSRSRKWSKNMYSDILEIDGSPLPKLPEEEEAVGIITMEDVIEELLQEEIFDETDHHFEDS

SEQ ID NO: 12657 - protein, 578 aa, Arabidopsis thaliana
MCGILAVLGCIDNSQAKRSRIIELSRRLRHRGPDWSGLHCYEDCYLAHERLAIIDPTSGDQPLYNEDKTVAVTVNGEIYNHKILREKLKSHQFRTGSDCEVIAHLYEEHGEEFIDMLDGMFAFVLLDTRDKSFIAARDAIGITPLYIGWGLDGSVWFASEMKALSDDCEQFMSFPPGHIYSSKQGGLRRWYNPPWYNEQVPSTPYDPLVLRNAFEKAVIKRLMTDVPFGVLLSGGLDSSLVAAVALRHLEKSEAARQWGSQLHTFCIGLQGSPDLKAGREVADYLGTRHHEFQFTVQDGIDAIEEVIYHIETYDVTTIRASTPMFLMSRKIKSLGVKMVLSGEGSDEILGGYLYFHKAPNKKEFHEETCRKIKALHQFDCLRANKSTSAWGVEARVPFLDKEFLNVAMSIDPEWKLIKPDLGRIEKWVLRNAFDDEERPYLPKHILYRQKEQFSDGVGYSWIDGLKDHANKHVSDTMLSNASFFFPDNTPLTKEAYYYRTIFEKFFPKSAARATVPGGPSIACSTAKAVEWDATWSKNLDPSGRAALGVHVAAYEEDKAAAAAKAGSDLVDPLPKNGT

SEQ ID NO: 12658 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEVEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMAHDDKPLYKRMFSTK

SEQ ID NO: 12659 - protein, 1116 aa, Magnaporthe grisea 70-15
MSHNHNPRANNRRGSIREKLKMGTAKNPPKAVPEQDDDEDVKLVPIPQPSRAPFVGNLPDLDVKFPLDSMVNLANKYGSIFKLDLPGLEFVTVSDWDLVHEVCDDSRFKKSIKGDLEELRNAVHDGLFTSSGEDEENWGIAHRVLMTAFGPLSIRNMFDEMHEVASQLALKWARQGPHEPLDVSGDTTRLALDTVALCSMGFRFNSYYRQDLHPFIKAMNEVLDEAGRRANRFMPSVFYHSHNKKFRENIKLLRTTAREVLDARKTQKGPEKRRDLLTAMLDGVDPKTGKKMTDESIIDNLITFLVAGHETTAATLSFALYNLAKFPEVSRKAQKEVDDVVGKGAVKLEHVPKLKYISALIRETLRLNAPITAFGREAIGDQVLGGKYLLKDKTQIVCFLTKSQSDPVIWGPDADEFKPERMLDDSFDRMQKKHPHCWAPFGTGVRGCIGRPFAWQEMVLCLAVLLQNYNFVMYNPAYALRLAQSLTIRPKDLYLRAISREGLTPAQLEARLAGGYTNGVHAEAPAEAAAPGGPVDGSKGAGRMAIYYGSNSGTCEFMAQRLAADAGSHGYTASVDTLDAAKEAMPTGIPVVIITASYEGQPTQNACHFVNWIQNLEEGKLKGVKYAVWGGGHSDWADTYQKVPGQIDTTLHKLGATRILPIGTTNAKDRDMFSDFETWEDQTLWPAMRDQFGGSEAAEAAPSVEVTFSTPRASDLRQDVRESLVVDARSLSKPGGEAGAREKRHLEIRLPTGCSYAAGDYLAVLPHNPRESVARIMRRFNLAWDTYMTVGAARATTLPTGVSLPVSEVLSSYVEIGQTATRRNITDLGQFANDDDTKYEILKLSKDSFDDEVRAKSLSVIGILERFPSLLVPFETFLFMLPPMRVRQYSISSSPLVDKGKLTLTYSVLNAPAHSGMGRHVGVASSYLSSLMPGDKLQASVRPAAGGFRLPPDPIRTPMICIAAGTGLAPFRAFIQERAALLRTSAQTPPAAPALLFYGCRDPDQDDLYRDELDAWEAAGAVVVYRAFSRRADASGGCRYVQDRLWREREAVGELWRRDARVYICGAGRMAGGVKEVLVRIMQSEGERMGTPISVEEGMAWFDKHRNERFATDVFD

SEQ ID NO: 12660 - protein, 406 aa, Burkholderia sp. 383
MSADPFVIVGAGHAARRTAEALRERDAAARIVMIGAERELPYDRPALSKDALLSDGGEQRAFVRDAAWYDAQRIELRLGTRVDAIERDAQRVRLDDGTTLPYASLVLATGSRVRTFDGAIDEGVKPHYVRTVDDARTLRAQLLPGRRVAVLGGGFIGLEVAAAARQLGCEVTVIDPAPRLLQRALPEVVGAYAHQLHDARGVVFQMATLPRAIRRAPGGGAIVETDRGDVPADLVVVGIGVVPNVELAQAAGLDIDNGIRVDAGCRTVDPAIFAAGEVTMHFNPLLGRHVRIESWQVAENQPAVAAANVLGADDTYAELPWLWSDQYDCNLQMLGLFGSERTIVVRGDPANGPFTVFGLGDDGKIVAVAAANLGRDIGASRRLIAAGAVPDPVKLADPAVNLKAFM

SEQ ID NO: 12661 - protein, 409 aa, Oryza sativa (japonica cultivar-group)
MEPFKGNFSNLLNQGSSSQATNSEAQNSLSTQFPTSYPQNFRPSFLQNFHPFGPPSNYQPYRHPPIFQGAQQQEYYGQPTPGSLEGFQLQENLVHSSNQAFGFAANRSQFGMQYSTSIRATANTSSHGSASPCHTRHNEKEVVEVEEASDSSEEGRRGTRINWTEDDNIRLMSSWLNNSVDPIKGNDKKSEQYWKAVAREFNSNMPSNGNKRNPKQCRTHWDNVKRDVTKFCGFYSKARTTFTSGYSDDMIMEKAREWYKKHNNQKPFTLEYMWKDLKDQPKWRRVLEESSHNKRSKISESGAYTSSSNQDTEEETERKEKRPEGQKAAKQRQKGKGAPSPLGDKPSQNMVLFHEAITTKAAALLKAAEATLIGAEAKKEKAIAKKREGKGRKIPNVFKTDGEGYINLQ

SEQ ID NO: 12662 - protein, 567 aa, Saccharomyces cerevisiae; identical to SEQ ID NO: 1105

SEQ ID NO: 12663 - protein, 622 aa, Streptomyces coelicolor A3(2)
MPAIPSHVPEPSRTDPALIRNFCIIAHIDHGKSTLADRMLQLTGVVEQRQMRAQYLDRMDIERERGITIKSQAVRLPWAPSHDKGATHILNMIDTPGHVDFTYEVSRSLAACEGTILLVDAAQGIEAQTLANLYLAMENDLTIIPVLNKIDLPAAQPEKFAEELANLVGCDPDDVLKVSAKTGLGVDVLLDKVVAEVPAPVGVKDAPARAMIFDSVYDSYRGVVTYVRVIDGQLNKRERIRMMSTGATHELLEIGTNSPEMLSADGLGVGEVGYLITGVKDVRQSKVGDTVTSQHKGATEALGGYKDPRPMVFSGLYPLDGSDYPELREALDKLQLNDAALVYEPETSAALGFGFRVGFLGLLHLDVIRERLEREFGLDLIATAPNVVYRVIMEDGTEHTVTNPSEFPEGKINEVYEPVVRATILAPTEFIGSIMELCQTRRGTLLGMDYLSEDRVEIRYTLPLAEIVFDFFDQLKSKTRGYASLDYEPTGEQTSSLVKVDILLHGDKVDAFSAITHKDAAYAYGVRLVAKLRELIPRQAFEVPIQAAIGSRVIARETIRAIRKDVLAKCYGGDISRKRKLLEKQKEGKKRMKMVGSVEVPQEAFIAVLSSDDSAGSGKGKK

SEQ ID NO: 12664 - protein, 349 aa, Sinorhizobium meliloti
MSGATLEAYLASCTTHGDELSRDVAAVIQRLAKAALDIRKLVNQGALGTVFNGMHSGSNTDGDVQKDLDILCDDQFLSCLQGAPVACYASEELENPVLLDPAARLAVAIDPLDGSSNIDNNISIGTIFSVLPAAKGPDVDPSHSFLQPGNRQLAAGFFVYGPQTALVLSLGRGTDIFIFSSRLGCFVDAYKSVGIPDRANEFAINMSNYRHWEEAIRLYVDDCLAGSEGPRERDFNMRWIASLVAEAYRILVRGGIFLYPADSRKGYSHGRIRLVYEANPIAFIVENAGGSATTSVDRILDLVPESLHQRVPLVFGSRREVGRITRYHVDPNMIGERAPLFGKRGLFRA

SEQ ID NO: 12665 - protein, 325 aa, Enterococcus faecalis V583
MAQKTMIQAITDALALELEKDENVLIFGEDVGNNGGVFRATEGLQEKFGEDRVFDTPLAESGIGGLAFGLALQGYRPVPEIQFFGFVFEVFDEIVGQMARTRYRMGGTRNMPITVRAPFGGGVHTPELHSDNLEGLIAQSPGVRVVIPSNPYDAKGLLISSIRSNDPVVYLEHMKLYRSFREEVPDEAYEVPLDKAAVTREGTDVSIITYGAMVREAIKAADSLAKDNISAEIIDLRTVAPLDVETIINSVEKTGRVVVVQEAQKQAGVGAMVVSEISERAVLSLEAPIGRVSAPDTIFPFGQAENIWLPNAKDIEAKAREIVEF

SEQ ID NO: 12666 - protein, 539 aa, Enterococcus faecalis V583
MAYQFKLPDIGEGIAEGEIVKWFVKPGDTINEDDTLLEVQNDKSVEEIPSPVTGTVKNIVVPEGTVANVGDVLIEIDAPGHEDNDAAPAAPAQEQTPAQPAAVPTTEAAGGFFQFKLPDIGEGIAEGEIVKWFVKAGDTINEDDSLLEVQNDKSVEEIPSPVTGTVKNIVVPEGTVANVGDVLVEIDAPGHNSAAPSVAAPATDAPKAEASAPAASTGVVAAADPNKRVLAMPSVRQYAREKDVDITQVTATGKGGRVIKADIDAFVSGGSQAAPATEAAATEAAPKAEAAAPKAAPKAFTSDLGEMETREKMTPTRKAIAKAMVNSKHTAPHVTLHDEVEVSKLWDHRKKFKDVAAANGTKLTFLPYVVKALTSTVQKFPILNASIDDAAQEIVYKNYFNIGIATDTDHGLYVPNVKNANTKSMFAIADEINEKAALAIEGKLTAQDMRDGTITISNIGSVGGGWFTPVINYPEVAILGVGTIAQEPVVNADGEIVVGRMMKLSLSFDHRIVDGATAQKAMNNIKRLLADPELLLMEG

SEQ ID NO: 12667 - protein, 468 aa, Enterococcus faecalis V583
MVVGDFAIELDTVVIGAGPGGYVAAIRAAEMGQKVAIIEREYIGGVCLNVGCIPSKALIAAGHHYQEAQDSSTFGVTAKGVELDFAKTQDWKDNTVVKSLTGGVGMLLKKHKVEIIEGEAFFVDENTLRVIHPDSAQTYSFNNAIVATGSRPIEIPGFKFGGRVLDSTGGLNLKEVPKKFVIIGGGVIGAELGGAYANLGSEVTILEGSPSILPTYEKDMVKVVTDHFKKKNVTIVTSAMAKEAVDNGDSVTVKYEVNGKEESVEADYVMVTVGRRPNTDDLGLEQAGVEIGERGLIPVDNQGRTNVKNIFAIGDIVPGAALAHKASYEAKIAAEAISGKKVAVDYKAMPAVAFTDPELASVGMTVAEAKEAGIEAKGYKFPFAGNGRAISLDKTEGFMRLVTTVEDNVIIGAQIAGVGASDMISELALAIESGMNAEDIALTIHPHPSLGEITMDTAELALGLPIHI

SEQ ID NO: 12668 - protein, 412 aa, Medicago sativa subsp. x varia
MTELDPSKKVADRYLKREVLGEGTYGVVYKAIDTQTGQTVAIKKIRIGKQKEGVNFTALREIKLLKELKDPNIIELIDCFPHKGNLHLVFEFMETDLEAVIRDRNIFLAPGDIKSYLQMTLKGLAHCHKKWILHRDMKPNNLLIGPNGQLKLADFGLARIFGSPDRRFTHQVFARWYRAPELLFGTKQYGPGVDVWAAACIFAELLLRRPFLQGSSDIDQLGKIFAAFGTPSPSQWPDMVYLPDYVEYQFVPAPPLRSLFPMATDDALDLLSKMFTYDPKDRISVQQALEHRYFTCPPQPTDPVKLPRPAPKKEIKPSDLNPPEGPTVLSPPRKTRRVMPGRDGLEGNSLQGDRVDDNHGNLKQTGGDNTGKNEPAPMSLDFSVFGLKPPNRPTINSADRSHLKRKLDLEFQ

SEQ ID NO: 12669 - protein, 138 aa, Yersinia pestis
TAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHH

SEQ ID NO: 12670 - protein, 468 aa, Bacteroides thetaiotaomicron VPI-5482
MKSTINFGYLIFLSVVAALGGFLFGYDTAVISGTIAQVTQLFQLDTLQQGWYVGCALIGSIVGVLFAGILSDKLGRKMTMIISATLFSTSALGCAISADFTQLVVYRIIGGVGIGVVSIVSPLYISEVAVAQYRGRLVSLYQLAVTVGFLGAYLINYQLLAYAESGNQLSMDWLNKIFVTEVWRGMLGMETLPAVLFFIIIFFIPESPRWLIVRGKEEKAVNILERIYNSVSEAASQLKETKSVLTSETKSEWAMLMKPGIFKAVIIGVCIAILGQFMGVNAVLYYGPSIFENAGLSGGDSLFYQVLVGLVNTLTTVLALVIIDRVGRKQLVYYGVSGMVVSLLLIGVYFLFGDSWGVSSLFLLVFFLFYVFCCAVSICAVVFVLLSEMYPTKVRGLAMSIAGFALWIGTYLIGQLTPWMLQNLTPAGTFFLFAVMCVPYMLIVWKLVPETTGKSLEEIERYWTRSEQ

SEQ ID NO: 12671 - protein, 336 aa, Gibberella zeae PH-1
MSRYTAAHANLQGPGDARPTALQIVKDEDLVGKLTDKVILVTGGNSGLGLETAKTLHATGATVYITARTSEKLEEAIKDIKAWPEAESSAPVYGIELQLDSLASVRAAAKKFLEKSEKLNILILNAGVMATPEGRTEDGFETQFGTNHLGHFLFFELLKPALIASSTPSFHSRVVSLSSKGHRYGGVRFDDFNFEKEPYIPWIAYAQSKTANIYFASELERRYGSQGLHGLSVHPGFIFTNLARHIDVSQIDVKGDTKNYVKNIEQGSATTVYAALSKDWEGRGGRYLADCDEEPPLKPGIDPASSAPGYASWIYNEEAEGRLWAESLRLVGLKKD

SEQ ID NO: 12672 - protein, 359 aa, Yarrowia lipolytica CLIB122
MALTKQPTLWGVPLKLISLVTLTAQNSSLILVMRYSRIMPAGPNGHYFTSTAVLLNELLKLAICLCVAIYITPGHSIQTLYKDVFGPDAWKLSIPAVLYTLQNSLQYVAVSNLDAATFQVTYQLKIITTAFFSVALLRRSLSNTQWLSLFILTIGVALVQLPAAAVEAIVDSLRWSWWSGEEAKTVVTKVARDLVTRGAPTDTNSKVGLVAVILACCLSGLAGVYFEKVLKGSQTSLWTRNVQLSFFSLIPATLIGCWWYQGAEIAEYGFFNGYNTTVWSAIILQALGGIVVALCVKFADNIAKNFATSISILISFVASVYLFEMEVTVNFVAGAALVVFATFLYSRPAPVPQELPKSN

SEQ ID NO: 12673 - protein, 135 aa, Aspergillus nidulans FGSC A4
MRVPIITTLLTLALTGLSQAASLGVETTHGVECNRKTTKGDTVKMHYRGTLAEDGSQFDASYDRGTPFKFKLGAGRVIKGWDEGLLDMCVGEKRTLTIPPEYGYGDRGIGPIPGGATLIFQTELLEIEGVPKDEL

SEQ ID NO: 12674 - protein, 1462 aa, Aspergillus nidulans FGSC A4
MDPITDSRPKAVDRDSTATSCNSTLDENQIENDREVTNLARVLSERSKHSHHQLPFNFGKDPSLDPQNAQFNARAWAKAFYNVRYSSTDAPPPRVAGVAFKNLNVAGYGSPVDYQMSVGNALLKLPTLAWQWLGGKKQRTEILQDVDGLLLPGEQLCVLGPPGSGCSTLLKTIAQETHGFEVDPSSYVNYQGITPKQMSKKFRGEAIYTAEVDAHFPQLVVGDTLYFAALARTPRHVPGGMSREEYAVHLRDVIMSTFGISHTINTKVGNDFVRGVSGGERKRVTIAEAALSYAPLQCWDNSTRGLDSANAVEFCKTLRTQGDVFGITSCVAIYQAPQAAYELFDKVTVLYEGRQIYFGPAKEAKDYFIRLGFVCPEAQTTPDFLTSMSSPVERVIRPGFENLVPRTADDFAQRWKESPERQALLRDIDRYNTEHPFNATDLDLFSSSRDAEKSKNQRPKSPYTLSYWGQIRICLWRDFQRLKNDPSVTLAMLILNFFEALIISSVFYNLPGNTSSFFSRGALLFMMVLLSAFSSVLEIITLYEKRTIVEKHSRYALYHPSAEAISSMIMDMPYKIVNSLLNSLVLYFMGNLRREAGAFFFLYLISFAMMMGMSMFFRFFASLTKSIEQALAPSSIILLALVLYTGFAIPVSYMRGWASWIRWLNPVSYGFEAVMVNEFNGREFPCVSFVPSGPGYENVSPQERVCSTVGAVPGSDVVQGADFVRSSYGYEYSHRWRNFGIIVALTVFLTMCHLVTSELVSSQRSKGEVLVFRRGKAQKMREKRHHTDEEQIAAPAAQNEKVIQEEPGLVSGVEQQSSIFHWEDVTYDIKIKGETRRILDRVDGWIRPGTLTALMGVSGAGKTTLLDVLASRTTIGVVGGNMLVDGRSRDESFQRKTGYVQQQDLHLHTSTVREALKFSALLRQPPQYSRAERLAYVETVIDLLNMREYADAIVGVPGEGLNVEQRKRLTIGVELAARPKLLLFLDEPTSGLDSQTSWSICNLMETLTKNGQAILCTIHQPSAMLFQRFDRLLLLAKGGKTVYFGEVGQGARTLMDYFVRNGGSACPPGANPAEHMLEVIGAAPGAQTDIDWPEVWRSSPEYQQVRSELARLRELANRPSPVSDPNDKSSYAEFAAPFSEQLLQVGRRVFQQYWRSPSYIYSKALLTVGCSLFIGFSFFKADNTRQGLQNQMFGVFVFLFVVVQLVMQVIPSFVTQRTLYESRERQSKTYAWQAFVLSNIIVEFVWNTIMAIFCYLVWFYPVGLYQNARYTDTIHSRSTLTLLIIWAVFLFASSFAHMLIAGVDSAEMASALSNIFFIMMYAFCGILAGPNALPGFWIFMYRVNPLTYLVSSLLSATLGDAPMHCANNEVLTFFAPPGLTCREYMEDYRSVNGGYLLNPDAQGSDQCQFCSLEYTNQYLSSLSIDFNNRWRDFGLLWVYVIVNTVGAIVFYKLFRVPRAKKD

SEQ ID NO: 12675 - protein, 195 aa, Burkholderia thailandensis E264
MVQGRGVGPCAARARSAPRLRRGRRAAEGRAGRRHRVPHGPALVLFPEIRGHRRRRRMGRGRSGAQRSRTYLQMTQPTIEDTLLRLAAVIDSRKGGDPEQSYVSRLFHKGDDAVLKKIGEEATEVVLAAKDVRQGGAPSALVGEVADLWFHCLVALSHFDLSPADVIAELERREGMSGIEEKALRKRREREENGG

SEQ ID NO: 12676 - protein, 237 aa, Brassica napus
PDKAFMSSKMRRTVKKLAKCFPTAIVTGRCIDKVYNFVKLAELYYAGSHGMDIKGPAKGFSRHKRSLLYQPASDYLPMIDEVYKQLLEKTKSTPGVIVENHKFTASVHFRCVEEKKWSELVLQVRSVLEKYPTLKLSQGRKVFEIRPMIDWDKGKALEFLLESLGFGNSNNVFPVYIGDDRTDEDAFKMLRVRGEGFGILVPKFPKDTDASYSLQDPSEVMNFLRRLVEWKQMQPRI

SEQ ID NO: 12677 - protein, 389 aa, Arabidopsis thaliana
MEQQEKKKRKVYRRRRLQSKPTSSFPLDLASEILLRLPVKSVVRFRCVSKLWSSIITDPYFIKTYETQSSTRQSLLFCFKQSDKLFVFSIPKHHYDSNSSSQAAIDRFQVKLPQEFSYPSPTESVHGLICFHVLATVIVWNPSMRQFLTLPKPRKSWKELTVFLGYDPIEGKHKVVCLPRNRTCDECQVLTLGSAQKSWRTVKTKHKHRSTNDTWGRCIKGVVYYIAYVYHTRVWCIMSFHVKSEKFDMIKLPLENIYRDVMINYEGRLACVDKLYTLNNDGIRLWILEDAEKHKWSSKQFLARYVHNDLRTNTISKLTGVTHAGEFVYISTQYLKSFVLFCDPKKNRFRKVEFNGIVDEEFRLSNGVGRGRIYALYNFPNHCESLMSL

SEQ ID NO: 12678 - protein, 161 aa, Pyrococcus furiosus DSM 3638
MNEVERTLVIIKPDAVVRGLIGEIISRFEKKGLKIVGMKMIWIDRELAEKHYEEHKGKPFFEALIDYITKAPVVVMVVEGRYAVEVVRKMAGATDPKDAAPGTIRGDYGLDIGDAIYNVIHASDSKESAEREISLYFKPEEIYEYCKAADWFYREKKQAKC

SEQ ID NO: 12679 - protein, 325 aa, Triticum aestivum
  misc_feature (49)..(49): Xaa can be any naturally occurring amino acid
  misc_feature (292)..(292): Xaa can be any naturally occurring amino acid
  misc_feature (296)..(296): Xaa can be any naturally occurring amino acid
  misc_feature (299)..(299): Xaa can be any naturally occurring amino acid
HYRTSLYKKAGWYRSGIPGISSTHASDKLLLPNPFDRPRSVFLMQLDGXHDYVDCFISDAGSIYKTKIDGAKSAAIELTDKDELIVIRSDESSGLDVLDNELANLATWLAGSYQKADSKLNIPLKSGNSLTLFLTKEADVEFASSLISLLKTIERGIQVHEDFSGGMVSPAELLVCHFTGIKALEDEYGSAEIVKQGAEVVQTALTKAFDQLQGAYNGKIVGLVISAKEASTSLASIIDAPSSLHISRRLAEASKTNATASIAAIYLVRLSLAWITGIILLVSTLIGMCLLXDMPXTRXTLLYSMARLINRSGIPGRPTRPLSES

SEQ ID NO: 12680 - protein, 130 aa, Prochlorococcus marinus str. MIT 9301
MAPKQVIKTSNAPDPVGPYNQAIKAGDFIYCSGQIAIDPAVNEITCLGDIEKETFQVLKNLAEVLKAGGAKIDDVIKTTIYLTDLSNFQIVNKVYSDFFNIENPPARACVEVSSLPKGVLVEIDCIAFLD

SEQ ID NO: 12681 - protein, 311 aa, Glycine max
  misc_feature (239)..(239): Xaa can be any naturally occurring amino acid
PRVRDVRAKLAKDLPSISGVESHDANVAERQEGTEVVQPSMSVMAGPLLSMQDSMKSDEILRSPNKDGLDIVDIDSVELKDPQVWSSYAPDIYNSIFVREFERRPSSDYMDMLQQDITPSMRGILIDWLVEVSEEYKLLPDTLYLTVNLIDRSLSQSLVQKQRLQLLGVTCMLIASKYEEICAPRVEEFCFITDNTYTKAEVLKMESEVLNLLHFQLSVPTTKTFLRRFILASQSSYKXFLQFLPSLIAASAVLLARWTLNQSEHPWNSTMEHYTNYKVSELKTTVLALADLQHDMKGCSLNSWPRGPNSL

SEQ ID NO: 12682 - protein, 616 aa, Corynebacterium efficiens YS-314
MRHLRCSDSLDLTGMKSVFTVDQIRRAENKLLAVQDHPDELMMSAATAVAAVARAMLTHPAGEDAGEIAGGMAGEVAGDFAEEDILLLVGSGGNGGDALYAGAFLASEGHHVDALLLGGDRVHERALEFFTAAGGTVVTGKPPHYDYCLVIDGILGIGGRGGIQVDTAQFMEHFYSAGIPVLAVDIPSGVDADTGALPEPTLVQLEGYETGAPIARQKIPTHINADVTITFGGLRRAHAVSAACGYVLMSDIRVNGTGQGGQGTSQGAGLSLAEALQEVQFEDASPTLYTSRAWRAELENPDAAPVPPVPGVFPIGSQFILLDMEPTPESDKYTGGVVGIVAGSAQYLGAAVLACSGAVRATSSMVRFVGDEAVRGQVLAALPEVVATPTIGESGRVQSWVYGPGRGTGEEQVRELATLFGHPEPVLVDADGITLIARSPELLETLRHRAGPTVLTPHKGEFERLADALREAGAQIPSAHTDPIGAALAAARELDCCVLLKGRATVVATSDYAYVVNAGHSWSATPGSGDVLSGLVGAHLARSYAELSRVPEFIPDMRIPGTAVYSMVAPAVSIHAVAAILSARTEFGHAPTSASRIAEHIPAATARANANRPLNS

SEQ ID NO: 12683 - protein, 509 aa, Arabidopsis thaliana
MLDISNYVFFFFTLVTILLSCLVYILTRHSHNPKCANLPPGPKGWPVVGNLLQFARSGKQFFEYVDEMRNIYGPIFTLKMGIRTMIIISDANLAHQALIERGAQFATRPAETPTRKIFSSSDITVHSAMYGPVWRSLRRNMVQNMLCSNRLKEFGSIRKSAIDKLVEKIKSEAKENDGLVWVLRNARFAAFCILLDMCFGVKMEEESIEKMDQMMTEILTAVDPRIHDYLPILTPFYFKERKNSLELRRKLVQFVVGFIEKRRLAIRNLGSDKTASSFAYLDTLFDLRVDGRETSPSDEDLVTLCSEFLNAGTDTTGTAIEWGIAELISNPKIQSRLYDEIKSTVGDDRTVEEKDLNKMVFLQAFVKELLRRHPPTYFTLTHGVTEPTNLAGYDIPVGANVEFYLPGISEDPKIWSKPEKFDPDRFITGGEDADLTGVAGVKMMPFGIGRRICPGLGMAVVHVELMLSRMVQEFEWSSYPPESQVDFTGKLVFAVVMKNPLRARVKARV

SEQ ID NO: 12684 - protein, 288 aa, Shigella flexneri 2a str. 2457T
MDVTAKYELIGLMAYPIRHSLSPEMQNKALEKAGLPFTYMAFEVDNDSFPGAIEGLKALKMRGTGVSMPNKQLACEYVDELTPAAKLVGAINTIVNDDGYLRGYNTDGTGHIRAIKESGFDIKGKTMVLLGAGGASTAIGAQGAIEGLKEIKLFNRRDEFFDKALAFAQRVNENTDCVVTDTDLADQQAFAEALASADILTNGTKVGMKPLENESLVNDISLLHPGLLVTECVYNPHMTKLLQQAQQAGCKTIDGYGMLLWQGAEQFTLWTGKDFPLEYVKQVMGFGA

SEQ ID NO: 12685 - protein, 72 aa, Glycine max
AGNPRAINIEGLSLDKFLENQVANNGWVIEKSQGRAQLIVLPRNEFNDPALKKNAADSVPLEHITRIFPILS

SEQ ID NO: 12686 - protein, 308 aa, Burkholderia thailandensis E264
MPAAFPDVLALGEAMVEFNQARPGEPNYLQGVGGDTSNFCIAAARQGARAGFVSAVGDDHFGRLLLDLWRGEHVDTSYVRIDDGAPTGVYFVSHGEHGHAFDYLRAGSAASRYAIRDLPLDALAAARFVHLSGVSLAISTSACDAAFAAIGHARANGARVSFDTNLRLKLWPLPRARAVMTEALRHTDVCLPSWDDVTALTGLVERDAIVDALLGLGPSVVALKLGREGAYVATPGERRVVPGFAVDALDATGAGDCFGGAFVARLAAGDDPFSAARYANAAAALSTRGFGAVAPIPSRDAVERLLNG

SEQ ID NO: 12687 - protein, 857 aa, Arabidopsis thaliana
MKSLLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQGEDVVAGIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 12688 - protein, 768 aa, Oryza sativa (japonica cultivar-group)
MVKLAFGSCGDSFSASSIKAYVAEFIATLLFVFAGVGSAIAYGQLTKGGALDPAGLVAIAIAHAFALFVGVSMAANISGGHLNPVVTFGLAVGGHITILTGIFYWVAQLLGASVACLLCSSPPTDRLAIPTHAIAGISEIEGMVMEIVITFALVYTVYATAADPKKGSLGTVAPMAIGFIVGANILAAGPFSGSSMNPARSFGPAVAAGNFAGNWVYWVGPLIGGGLAGLVYDDVFIASYQPVMIGFTVILCDRSDQAVYAGQTSGDRAVTRCLGRVFAVMDRESAWCRMQSYIMAENYDIWRKVSLPYVIPEVINTAAEKIAFELNCKARNILLSGISCSDYDRVAHLQTAHEIWVALNNFHQGTNNIKEFRRDLFKKEYIKFEMKPGEALDDYLSRFNKILSDLRSVDSSYDANYPQSEISRHFLNGLDMSIWEMKVTSIQESVNMSTLTLDSLYTKLKTHEMNILSRKGDSKSSALVSSSTSLDVGASSSKSSVLALFNAMSDDQLEQFEEEDLVLLSNKFSRAMKNVRNRKRGEPNHCFECGALDHLRSHCPKLGRGKKEDDGRVKEDDVNKKKNMKEKEKKKHCIKWLIQKLIKVFDESEDEDESKGKQVVDLVFIARNASSDVDESDDDNEEKLSYDQLEYAAYKFGKKLQTCSIVLDEKDHTIEILNAEIARLKFLIPNDDNCQSCEVLFSEISALRYVNSVNCKKLEFEIEKSKKLESSFALGFALLARVVDELILTKNVLKKIQSGFLCKFFSQCFMCK

SEQ ID NO: 12689 - protein, 501 aa, Brachypodium sylvaticum
EITDDRSSEQITEAISEKSDAMLISSNTSYSTTPDSMILVIKDQLKRAKKYIRFLPSRGNHGFIKDLRRRMRDIQQALGGATIDRQLPKKYFLFHCTTNVRGKIRAMELILRKIRQVHDNCVAAIDKLQTTLHSAENQLEAHKQQANYVAQIAVKALPKRLHCLALLLTNEYYSSSSSNKLFPYEDKLEDPKLQHYALFSDNVLAAAVVVNSTLVHAKKPADHVFHIVTDKLNYAAMRMWFLANPLGKAAVQVQNIEDFTWLNSSYSPVMKQLGSHFMIDYYFSTPQNRPDRNPKFRNPKYLSILNHLRFYLPEIFPRLNKVLFLDDDIVVQQDLSALWLIDLKGKVNGAVQTCGEVFHRFDRYLNFSNPLIAKNFDRRACGWAYGMNMFDLSEWRRQNITDVYHYWQEQNEHRLLWKLGTLPAGLVTFWNRTFPLDRSWHLLGLGYKQNVNPEDIERAAVIHYNGNLKPWLEVGLSKYRKYWTKYVNSDQAFIRGCNIHP

SEQ ID NO: 12690 - protein, 331 aa, Frankia sp. EAN1pec
MTMREALNLALDQALERDERVFLIGEDIADPGASGPTAGLSSRYGTERVLDTPISEAAIVGAAIGAAMEGFRPVAEIMIMDFIGIAADQIINHAAKMRFMTGGRTTAPITVRTQIYGGLGTGATHSQSLEAWFMHIPGLKVIVPSTPRDGKGLLTSAIFDDDPCIFLETIRLQGQRGMVPVDPGFSIPLGQADVKRAGTDVTLISYGRGVVESLGAADALARQEISAEVLDLRTLVPLDTAAIVESVRRTTRAVVVHDAVRFAGPGAEIVAILQGELFDQLAAPVERVGARFVPNPAPPALESQVYPDSEKIIAAVHRTLRWKTTREGARG

SEQ ID NO: 12691 - protein, 125 aa, Glycine max
MASATVSSTAGTAGNRAGAGMEATFTGLKCKGGFPTRKTNNDITYIGSNGGRGQCMQVWTPIGNKKCETISYLPDLDDAQLAQEVEYLLRKGWIPRLEFEMEHGFVYREHNRSPGYYDGHYWTMW

SEQ ID NO: 12692 - protein, 332 aa, Frankia sp. EAN1pec
MTTEQAAEPALDVRRRLYELMTLMKAADDRLSKGIASGELQCVYWPSRGQEAIAAAVGVVLRLDDQLVTTYRGLHDLIGKGVPLVEIYGEMLGRQVGSGRGKGGTMHIAHPDSGLMMSTGIVGAGPPVAVGLAMAARRKGLDRVTVASFGDGATNTGSFHEAANMAALWDLPLVLVCQNNQYAEMTPTGHTMKIAQVADRAAGYGMPGVRVDGNDPLAVVAALEEAVERARAGAGPTLLECVTFRFRGHYFGDPMKYIPTEQMDAAIAADPLPRFRSRLLDDGICGARELDEIETAAVSAVDEALAAVLAAPAAALDELDRDVYADPRNCPA

SEQ ID NO: 12693 - protein, 182 aa, Campylobacter coli RM2228
MTKLTQNEQQFLSESIRVIPNFPKEGIIFRDITTLLNNQKALSFLLDHLSKRYQTMNLDFIAGTESRGFIFAAMICAKLNLPFVPIRKPNKLPSNTYSCEYELEYGTDRVEIHQDAFRNIKNAKILLVDDLIATGGTALASFELIKKAGGECIEACFLMNLKNLGGEEKLQKHCSVYSVLEF

SEQ ID NO: 12694 - protein, 293 aa, Helicobacter hepaticus ATCC 51449
MVFGAMSALITPFINHKVDFETYETLIKRQITYGMDACVPVGTTGESATLSHKEHMECIEVAVAVCRGSKVKVLAGAGSNSTSEAKELALFAQKCGADALLCVTPYYNKPTQEGLFEHYKAVANAVEIPVMLYNVPSRTGVSIEIETAKRLRDACKNIYAIKEAAGLMERVVAFGAEVPNLALLSGEDVINYPILANNGKGVISVTGNLFPQEIADLTHYALQGNMEKSYEINTRLYEMNRILFCESNPVPIKAAMFLAGLLKNLEYRLPLVPPSKENMAKIQQILEKYEVKE

SEQ ID NO: 12695 - protein, 256 aa, Alkaliphilus metalliredigenes QYMF
MCILFFAYKVHPKYDFIFLGNRDEFTNRPTLNSHFWDTYPNILAGIDLEKGGTWAGVTKEGRVAFLTNYRDPSLPSTAPLSRGFLTRDFLIQGGSPLSYLENIQTNQSKYNGFNLIVGTLNDLWFYSNIENEIRPIKPGLYGLSNALLNTPWFKVDRGKKRLAALLDTDFTVEQLFDILDDTEVPPDGKLPKTGVPLEMERLLSTIHIDSPAYGTRSKTVILMTNKGELQFYEKALEPKGNWALATYQFNVHMEHP

SEQ ID NO: 12696 - protein, 171 aa, Brachypodium sylvaticum
MIPESAPELIVVYENGQGEKDLPVPTQKRRLIIDTYSAQCNKCRKWRIIPTKRKYEEIREKLRSGPFSCEHASEWKPGVTCDDPTDASQDDGKFWAIDKPGIAQTPLGWDRTISIRSEGSTRFADVYYITPTGKNLRSKVDVGRYLKENPQCAAAIEQFSFAKPVPLQREY

SEQ ID NO: 12697 - protein, 254 aa, Mesorhizobium loti MAFF303099
MRVVYWVGTSWKMNKTLAEALDFAERLAGFIPGFDDRIQPFVIPPFTAVREVKRALSSTRIKVGAQNMHWADAGAWTGEISPPMLRDCGLDLVELGHSERREHFGETDRTVGLKTAAAVKHGMIPLICVGETLAERESGQADAVLSAQVEGALQFLEGEAKTAKILFAYEPVWAIGDKGIPASADYADKQQALIKTVAGALLPSVPPVLYGGSVNPGNAAELVGQPNIDGLFIGRSAWQADGYIDILGRASAAI

SEQ ID NO: 12698 - protein, 146 aa, Oryza sativa (indica cultivar-group)
MAGITGSRALMVVALLCAAVAMTAAQEASNVRATYHYYNPQQNNWDLNKVSAYCATWDANKPLSWRQKYGWTAFCGPAGPRGRDSCGKCIQVKNRGTGATIIARIVDQCSNGGLDLDYETIFKKIDTDGRGYQMGHLQVDYKFVNC

SEQ ID NO: 12699 - protein, 149 aa, Oryza sativa (indica cultivar-group)
MAMMRRVVMVVAVLCAVATMAMAQEASNVRATYHYYRPAENNWDLGAPAVSAYCATWDADKPLEWRQKYGWTAFCGPVGPTGQDACGKCLSVTNTATGDQITARIVDQCANGGLDLDWDTVFSKIDSDGQGYQNGHLIVDYQFVDCGDN

SEQ ID NO: 12700 - protein, 410 aa, Rickettsia sp. AT1
DSEFAELKIRGKIFKLPIFKASIGEDVIDISRVSAEADCFTYDPGFMSTASCQSTITYIDGDKGILRHRGYDIKDLAEKSDFLEVAYLLIYGELPNSEQYNNFTKQVAHHSLVNERLHYLFQTFCSSSHPMAIMLAAVGSLSAFYPDLLNFKEADYELTAIRMIAKIPTIAAMSYRYSIGQPFIYPDNSLDFTENFLHMMFATHCTKYKVNPIIKNALNKIFILHADHEQNASTSTVRIAGSSGANPFACISTGIASLWGPAHGGANEAVINMLKEIGSSENIPKYIAKAKDKNDPFRLMGFGHRVYKNYDPRAAVLKETCKEVLKELGQLENNPLLQIAIELEAIALKDEYFIERKLYPNVDFYSGIIYKAMGIPSQMFTVLFAIARTVGWMAQWKEMHEDPEQKISRP

SEQ ID NO: 12701 - protein, 148 aa, Oryza sativa (indica cultivar-group)
MAMRRVVLVAAVLCAVVAMVTAQEASNVRATYHYYRPAQNNWDLGAPAVSAYCATWDANKPLSWRQKYGWTAFCGPVGPRGQAACGKCLLVTNTATGAQITARIVDQCANGGLDLDWDTVFTKIDTDGQGYQKGHLIVNYKFVDCGDN

SEQ ID NO: 12702 - protein, 411 aa, Rickettsia sp. DT1
DSEFAELKIRGKIFKLPILKASIGEDVIDISRVSAEADCFTYDPGFMSTASCQSTVTYIDGDKGILRHRGYDIKDLAEKSDFLEVAYLLIYGELPSGEQYNNFTKQVAHHSLVNDRLHYLFQTFCSSSHPMAIMLAAVGSLSAFYPDLLNFKEADYELTAIRMIAKIPTIAAMSYKYSIGQPFIYPDNSLDFTENFLHMMFATPYTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSLMFTVLFAIARTVGWMAQWKEMHEDPEQKISRPR

SEQ ID NO: 12703 - protein, 614 aa, Aspergillus nidulans FGSC A4
MTVSTITNNPVDVPLGKFPATQPAELSAADADRVAQTVIDQFNSALTKQDDKSIAALFFKDGYWRDHLCLAWDLYTAKGHDGIASFLDRTRPRAIHVEVDRSSDFRRPTACALDGLGNSYGIQFFTTIDLESGRGRGIVRLAKNDGEWKILTFFTSLLELKGHEEPLNGRRSKGVEHGGRPDRKNWQERREADAEFMDREPSVLIIGAGQGGLTAAARLKMLNVDTLVIDKNSRIGDNWRQRYKQLVLHDPVWYDHMPYLSFPPHWPVFTPKDKLAEWFESYAKILELNVWTRTTLKTPSWDGKQWTVILERRAPDGSLTSRTVHPRHIIQATGHSGEKYIPPIPGIDSFKGDRICHSSDFTGALHEHRGKKAIVIGSCNSGHDIAQDFYEKGYDVTMVQRSTTCVISSEAITDIGLKGLYDEQAPPTEDADLWFWGMPAELLKTQQIGVTAIQNKHDEATIKGLEEAGFKVDNGPNGAGLLIKYFQRGGGYYIDVGASQLIVDGHIKIKQGVEISEIQSHGLKFADGTELEADEIVLATGYQNMRTQTRRLFGDETADAVGDVWGFDEHGEMRGIWRPSGHKGLWFMGGNLAISRYYSRILALQIKAAELRLS

SEQ ID NO: 12704 - protein, 158 aa, Oryza sativa (indica cultivar-group)
MLMGRKIMGLLLGCVGLVAVMHVAAAQQAFGVRATYHFYRPAANGWDLTATGAFCSTWDAGKPFDWRSKYGWTAFCGPVGPTGRDSCGKCLRVTNRATGAQTTARIVDKCANGGLDLDWDTVFSKIDTDGQGFQRGHLTVDYSFVNCGDNNYLAEVVI

SEQ ID NO: 12705 - protein, 355 aa, Pyrococcus furiosus DSM 3638
MIKIAVIPGDGIGKEVVAEGLKVLRKIEELSNVKFDFQEYPFGAEHYLKTGETLPDWALEEFRHFDAIYFGAIGDPRVKPGILEHGILLKLRFSLDLYVNLRPVKLYHPKLTPLKGKEKIDMVFIRENTEGLYAGAGGFLRKGTPHEVAIQEMINTRFGVERTIRFAFEYAKTKGRKKVTLVDKANVLTYAHDLWQRVFKEVASEYQEIETDHYYVDAMAMKMIRSPEIFEVVVTPNMFGDILTDLGAEIVGGLGLAASGNINPRGVSMFEPVHGSAPDIAGKGIANPLAAILTAALMLEHLGLDREASLVEKAVAKTIEENKVTPDLGGELKTSEVGNEVVKNLEVLWDEGEES

SEQ ID NO: 12706 - protein, 101 aa, Oryza sativa (indica cultivar-group)
MEVRSVSLLVLVAVVLSASGGAAAQQASGVVATYNPDTINWDLRAMTNTATAASAVARVVDQCSTGGLDLDVAVFRQIDTDGGGMANGHLVVDYEFVDCQE

SEQ ID NO: 12707 - protein, 865 aa, Glycine max
MFQNIMNAFTTTGDDDNGPGHRVKGTVVLMKKNVLDFNDFSASFLDRLHEFVGKRVSLQLVSSVNVDPGNGNGLKGKLGKPAYLEDWITTIAPLTAGEAAFKVTFEWDEEIGTPGAFIIRNNHHSEFYLKSLTLEDVPGQGVIRFICNSWVYPADKYEKDRIFFSNKTYLPSETPMPLLKYREEELENLRGNGKGQLQEWDRVYDYALYNDLGNPDKGPQHARPTLGGSKDYPYPRRGRTSRPPAKSDPKCESRLNIASSLDIYVPRDERFGHLKMADFLAYALKSIVQVLKPEFESLFDSTPNEFDKFEDVLKLYEGGIEVPEGILTEVRDNIPAEMLKEIFRSDGQRLLKFPVPQVIAVDKSAWQTDEEFGRELLAGINPVVIRGLQEFPPASKLDPKIYGNQTSTITKEHIESNLEGFTVDEAIKERRLFILDLHDALIPYVKRINSTSTKMYASRTILFLQDSGTLKPLAIELSLPHPEGDQYGAISKVYTPVEQGIENSFWQLAKAYVVVADSGYHQLISHWLHTHAVIEPIILATNRHLSVLHPIHKLLHPHFRDTMNINALGRQILINAGGALELTVCPSKYSMEFSSVLYKDWVFPEQALPEDLVKRGVAVKDSTSPYGLRLLIEDYPFAVDGLEIWFAIKTWVKDYCSFYYKEDDTIKKDTELQSWWKEIREVGHGDKKDEPWWPKMQTCEELIQTCTIIIWIASALHAAINFGQYPYGGFPPSRPAISRRFMPEKGTPEYDELVANPDKAYLKTVTSQFLAVLGISLVEILSKHSSDEVYLGQRDTPDWTSDAEPLQAFEKFGKKLADIEERILRMNSDEKFRNRYGPVKMPYTLLYPSSKGGLTGMGVPNSISI

SEQ ID NO: 12708 - protein, 454 aa, Prochlorococcus marinus str. MIT 9301
MEFEFDLIVVGAGSGGLAAAKRAASYGAKVAIIEANQIGGTCVIRGCVPKKLMVYAAKSKKNMDSSEGYGLKNEGINFESNILLKNVREEVSRLSNLHRNSLKKLNITIFEGLGRFITQNELEIICSNTKKIKNKISSKKILISVGGKPKKLNIPGIDLAWTSDDIFELEKFPKSLLIVGGGYIACEFASIFRNLGTEVTQLIRGKHLLNGFDEDLSLCLEESPTFTDIKIISNAQLKSIDRVNGNLESTLESGDKLLTNNILIATGREPNLLPLNLDFLNLKMDGQYLDVDELNQTSNANIFAVGDIINKPNLTPVAIEQGRVFSDNFFNDQKRKVNYEYIPKAVFTIPEISTVGLSEKRAKEIYSEKNIKIFKCKFTPMSNTFKKNKSKCMLKIVVHKLTDKVLGCHMFGETSSEIIQMVSVSLNAGITKKDFDITMALHPTISEEFVTMYG

SEQ ID NO: 12709 - protein, 600 aa, Corynebacterium efficiens YS-314
MTASVQDPHALSAEWLNQLSDTTTAGDPDAVADLFEEEGYWRDLLAFTWNLTTAEGVEQIRQMISATHPRCAISDVEVTEAIEESPGVLRVQFTFDTAEFHSRGIARLRDGKCWTLLTSARGLKKHPEPAGRRRPQGAEHGVHPDRKNWHDQRAERRATLGRSEQPYTLIIGGGQGGIALAARLKRLGVPTIVVDKHDRPGDQWRSRYYSLCLHDPVWYDHLPYLPFPDDWPVFTPKDKMGDWLEHYVGIMDLDFWPRTECTSAEFNEETGTWTVHVTRDGEKLELHPTQLVLATGMSGVPNRPHLPGQENFKGEIRHSSEHPGGPGDAGKNVVILGANNSAHDIAADLYENGAHPIMIQRSSTHIVRSESLMREVFGPLYSEDALEAGIDTDTADLLFASWPYAILPDVQRPAFDKIREADAEFYSRLEKAGFLLDFGDDDSGLFLKYLRRGSGYYIDVGASDLVADGSIPVRSGVSIDHVTEDSVVLTDGTELPADVIILATGYGSMNGWAAELISQDVADRVGRVWGLGSDTTKDPGPWEGELRNMWKPTQVDNLWFHGGNLHQSRHYSRYLALQLKARYEGMDTPVYGLAPVHHAS

SEQ ID NO: 12710 - protein, 198 aa, Triticum aestivum
MGWGEVKRVTKETNVHVKINLDGTGVANSSTGIPFLDHMLDQLASHGLFDVYVKATGDTHIDDHHSNEDIALAIGTALLQALGDRKGINRFGHFTAPLDEAAVEVILDLSGRPHLSCGLSIPTERVGTYDTQLVEHFFQSLVNTSGMTLHIRQLAGNNSHHIIEATFKAFARALRQATEYDLRRQGTMPSSKGVLSRS

SEQ ID NO: 12711 - protein, 327 aa, Shewanella sp. ANA-3
MQQLFIQLLEERYFNRLPEKVVMKFATESADFVRFWLVHCVRSSASERELALALFFSAEWQLEELSRLKAFWNDYVVIESLQQHERLKARFCELNPWLTTISPYHADAICVFSALLAFEQSPISVGQQLQSAKLFYSQLPSNLLEEVKESSLPYLQPITVYGHQGKGSIEAGIRNNMHYPTPIPNGSVALACAERVTAKFSGIKIAYAEPMVVLRYEPGQFYQWHYDAIHAHTSEIKAELERFGQRCRTGILYLNDDFQGGETEFKAPYIQVKPQAAAILVFDNTDKSGKPIPSSLHRGCEVTSGHKWVCTQWFRDKPFWLRSGLLT

SEQ ID NO: 12712 - protein, 456 aa, Saccharomyces cerevisiae
MSDKPIDIQYDKQATPNLSGVITPPTNETGNDSVREKLSKLVGDAMSNNPYFAAGGGLMILGTGLAVARSGIIKASRVLYRQMIVDLEIQSKDKSYAWFLTWMAKHPQRVSRHLSVRTNYIQHDNGSVSTKFSLVPGPGNHWIRYKGAFILIKRERSAKMIDIANGSPFETVTLTTLYRDKHLFDDILNEAKDIALKTTEGKTVIYTSFGPEWRKFGQPKAKRMLPSVILDSGIKEGILDDVYDFMKNGKWYSDRGIPYRRGYLLYGPPGSGKTSFIQALAGELDYNICILNLSENNLTDDRLNHLMNNMPERSILLLEDIDAAFNKRSQTGEQGFHSSVTFSGLLNALDGVTSSEETITFMTTNHPEKLDAAIMRPGRIDYKVFVGNATPYQVEKMFMKFYPGETDICKKFVNSVKELDITVSTAQLQGLFVMNKDAPHDALKMVSSLRNANHIF

SEQ ID NO: 12713 - protein, 742 aa, Burkholderia thailandensis E264
MAPTTPPAQRRRPRNPPRIQADRFLPPPLPRRVKGENMTSESRRRFLHAVAQSASAAAALTVFPESIRRALAIPAASRTGTIRDVEHIVVFMQENRSFDHYFGHLRGVRGYNDRFPITLPNGKPVWYQPSKANPGKPVLPFRLNTLTTSAQCIGDLDHSWYKTHAAIDGGRYDQWPANKTDMTMGYHVREDIPFHYALADAFTVCDNYFCSLPGPTHPNRSYLMTGTVDPTGKYGGPLLDNSDYVDGDAPPKYDLLTWTTYPERLEANGISWQIYQQGTTGADPLNGNYGTNILQNFANFIDAKPGSSLYRRAQTARTLDDLKADVLANRLPQVSWLLPPAAFSEHPKYTPAYGANYTSQILDALTSNPDVWRKTVLFIMYDENDGFFDHVVPPQPATTRAQGLSTVPVDGEIHDVVNPGRGGSYTADGLPYGLGPRVPMTVVSPWTKGGFVCSQVFDHTSVIRFIAARFGVDEPNITPWRRAVCGDLTSAFDFRTPDATLPPLPDTSNYRSIADQLCSTKPAPSVPAAPSPVDPQEPGVRPARALPYELHVNATVHGGARLRIEFANRGEQGAHFYVYASNRSDGPWRYTVGAHRSLHDEFDLGATNGAYAFTVYGPNGFVRVFEGLAAAEGHGRHAAAHPEVKAGYDVANGNLYLKLTNHGGQSVRLTLADNAYGAPPRQITLRGGDERVEQWALAPSHHWYDVTVSDGATGQFVRRFAGHVENGKSSYSDPAAVAPVTG

SEQ ID NO: 12714 - protein, 200 aa, Prosthecochloris aestuarii DSM 271
MSQPDNHSSRSASVSRRTSETDISIDLNLDGTGTHSISSGVVFLDHMLANFSKHAQIDITLTCKGDTDVDDHHSVEDIALVLGSALLQSLGDKKGIKRYGWSMIPMDEALARCALDLGGRSYSVFNATFNRSVVNGFSTEMVEHFFLSLSRTLHANIHISILEGQNTHHKIEAIFKAFAYALKDAISISGTGIPSTKGVI

SEQ ID NO: 12715 - protein, 226 aa, Saccharomyces cerevisiae
MSANLDKSLDEIIGSNKAGSNRARVGGTRGNGPRRVGKQVGSQRRSLPNRRGPIRKNTRAPPNAVARVAKLLDTTREVKVNVEGLPRDIKQDAVREFFASQVGGVQRVLLSYNERGQSTGMANITFKNGELARRAVERFNGSPIDGGRSRLRLNLIVDPNQRPVKSLADRIKAMPQKGGNAPRPVKRGPNRKAAMAKSQNKPKREKPAKKSLEDLDKEMADYFEKK

SEQ ID NO: 12716 - protein, 589 aa, Burkholderia thailandensis E264
MSLIEVKVPDIGDFSGVDVIEVNVKPGDVIEKEQTLLTLESDKASMEVPSDVAGTVKEIKVKAGDKVSQGTVIALVEASAGAAAPAKAAEPAKPAVPAPAAAPAAAPASAPQAGSYAGAADIECDMLVLGAGPGGYSAAFRAADLGMKTVLVERYSTLGGVCLNVGCIPSKALLHTALVVEEAEALASHGISFGKPQVDLDKLRDFKGGVVKKLTTGLAGMAKARKVEVVTGVGAFVDPYHMEVQGEGGKKVVKFKQAIIAAGSQAVKLPFMPEDPRVVDSTGALELRQLPKRMLVIGGGIIGLEMATVYSTLGAEIDVVEMMDGLMMGADRDLVKVWEKYNAKRFGNVMLKTKTVGAQAKEDGIYVKFEGEKAPAEAQRYDLVLVAVGRSPNGKKIGAEKAGVAVTERGFIDVDKQMRTNVPHIFAIGDIVGQPMLAHKAVHEGHVAAEAAHGEKAYFDALQIPSVAYTDPEVAWAGKTEDQCKAEGIKYGKAVFPWAASGRAIANGRDEGFTKLIFDEQTHRVIGGGIVGLNAGDLISEVCLAVEMGADAQDIGKTIHPHPTLGESVGMAAELYEGVCTDLPPQRKK

SEQ ID NO: 12717 - protein, 411 aa, Rickettsia asiatica
DSKFAELKIRGKIFKLPILKASIGEDVIDISRVSAEADCFTYDPGFMSTASCQSTITYIDGDKGILRHRGYDIKDLAEKSDFLEVAYLLIYGELPSSEQYNNFTKQVAHHSLVNERLHYLFQTFCSSSHPMAIMLAAVGSLSAFYPDLLNCKEADYKLTAIRMIAKIPTIAAMSYKYSIGQPFIYPDNSLDFTENFLHMMFAMPCTKYKVNPIIKNALNKIFILHADHEQNASTSTVRIAGSSGANPFACISTGIASLWGPAHGGANEAVINMLKEIGSSENIPKYIAKAKDKNDPFRLIGFGHRVYKNYDPRAAVLKETCKEVLKELGQLENNPLLQIAIELEAIALKDEYFIERKLYPNVDFYSGIIYKAMGIPSQMFTVLFAIARTIGWMAQWKEMHGDPEQKISRPR

SEQ ID NO: 12718 - protein, 388 aa, Arabidopsis thaliana
MLSSIKPSSSSFSTAISGSVRRSIPTTLNFSPLPIIKNCHNQSFHSNVVSHQKPLHISSASNFKREVKVEAYEADRSRPLDINIELPDEQSAQKLKIGIYFATWWALNVVFNIYNKKVLNAFPYPWLTSTLSLACGSLMMLVSWAIRIADAPKTDLEFWKTLFPVAVAHTIGHVAATVSMSKVAVSFTHIIKSGEPAFSVLVSRFFMGETFPLPVYLSLSPIIGGCALAAITELNFNITGFMGAMISNLAFVFRNIFSKKGMKGKSVSGMNYYACLSMMSLVILTPFAIAVEGPQMWAAGWQNAVSQVGPNFVWWVVAQSVFYHLYNQVSYMSLDQISPLTFSIGNTMKRISVIVASIIIFHTPIQPVNALGAAIAIFGTFLYSQAKQ

SEQ ID NO: 12719 - protein, 347 aa, Idiomarina baltica OS145
MSSSRLIERIAVITSGGDAPGMNAALRAVVLAAEHDGIDVVGFRHGYEGLLNNDYMKLGRDEVEHILQYSGTIIKSARSERFKTDEGGIEAAHNLDAQNVDAFIVIGGDGSFRGANHLAKFWQGPIIGIPGTIDNDLFGTDNTIGYDTAVETAMDALDKIRDTAEAMDRVFIVEVMGRNAGYIAISSAMASGAERMILPELQKDKPLTIDALVKHVEGVNRVRGDSSYVMVLCENQWPGGAVRLAEQLEDRLNFPCRPCLLGHVQRGGRPTAMDRILATRLGVYAVQLVQEGITGVMAGIEKNELVTTPLEDTWVKRKVLSQELIDIQTKCFNPIKKDRHKATVDKA

SEQ ID NO: 12720 - protein, 546 aa, Mesorhizobium loti MAFF303099
MANSYEQDLDRNAANHQPLTPLTYLERAAKTYPDHIAIIHGRQRISYRDFWRRSLKVASALQKRGIGKGDTVTVMLSNTPPMLEAHFGVPMTKAVLHSLNTRLDAAVIAFQLDHAETKVLIVDREFSGVVRQALDLAKVTPLVIDYDDPDYAADAPYPKGERIGALDYEDFVAGGDEDFAWSMPDDEWDAISLNYTSGTTGNPKGVVYHHRGAALMAYTNTIHAGMAKHAVYLWTLPMFHCNGWCFPWTLAVQAGTHVCLRWVRPKPIYDAIADHGVTHLCGAPVVMSVLINARDEDKRTFAQTVTFNTAAAPPPEAVLSGMADAGFAVTHLYGLTETYGPAVVNEWHGEWDDLAKGERSAKKARQGVRYAALEGLTVMDPETMQATPADGETIGEVMFRGNIVMKGYLKNRKASDEAFAGGWFHSGDLGVMHPDGYIQLKDRSKDIIISGGENISSIEVEDALYKHPSVASCGVVARHDDKWGEVPVAYVELKPGKTASEAEIIEHCRALLARFKVPKAVIFAEIPKTSTGKIQKFRLREMAKLA

SEQ ID NO: 12721 - protein, 906 aa, Enterococcus faecalis V583
MKTKLHTQTVTLSIDNQEVTVPKGTTILEAAKGLGVEIPTLCHLKELAPDGSCRMCVVEVEGGRRGGLTTACTAHCQEDMVVATHSEKVADSRRFILDLLLSNHKLECFSCGKNGDCQLQQYALDYGIDVTSFTEGKRMPCHQEDTSNPFFSYDPEKCIMCRRCARVCQLRQGRDVLSIANRGFETKMMPSYGQAFDQSICESCGNCVSSCPTGALTAKDTKEYRKWETQKIPTTCPHCGTGCQMNLLVKNNRLVGVEPLDGPANKNLLCVKGKFASYKFVGSGDRLTEPLIKRNGIFEPASWEEALTLVSSKFNEIKAENGPDALAGFSCSRATNEDNYVFQKMVRAAFGTNNVDNCARVCHSASVHGLAQTLGSGAMTNPIADITEDVDMILLVGSNPEEAHPVIGAQIRQAIQRGTQVVVVDPRKINLVKDSALHLQVQAGTNVAFANGMMHVILKEGLADRHFIEERTEGFLDLEKMVADYTPEKVAEICHIHPEDLIQAARMYAKAEKAPIIYCLGVTEHSTGTEGVMSMSNLAMLVGKVGKPGCGVNPLRGQNNVQGACDMGCMPYDFPGYQKVNNPEVIDKFEKAWHVPLNRNTGLTSTKVLPAATAGSVKGLYIFGEDPIVTDPDTGHVRQALESLDFLVVQELFMTETAAYADVVLPGISYAEKDGTFTNTERRVQRVRKAVEPRGQAREDYEIFCEVMTRMGYPCAYESAKEIMEEISAVTPSFGGINYERLEKESLQWPCRSLTDPGTPIMHVGSFARGKGLFKAIPYKQAQELPDEEYPYLMSTGRMLYHYNTRAMTGRTEGINQIANHSYIEINAVDAQALGIQEGDKVEVHSRRGKIETYAAVGNRVFPQEVFMTFHFPDGNVNEITNAVFDDIATIPEYKVCAVAIKPVNK

SEQ ID NO: 12722 - protein, 553 aa, Salinibacter ruber DSM 13855
MYTLLTNRVCVPSRPWAAHRGGAARTNATEPPKKFRSERTWKRLRFGVVPAFISTPRPFLQAVSSFPMEGSNATPQANGQAESSDGFFGEVNQMFDEAAARTDHPRGVLHQIRACDNIIRFEFPIERDDGSIQVIRGYRGEHSHHMQPTKGGIRYAPSVNVDEVMALSALMSYKCAIVDVPFGGAKGGVCIDARNYSTTELERITRRYTFELERKDFIGPGTDVPAPDYGTGPQEMAWIMDTYNQIGDEDLNALACVTGKPVGQGGVRGRTEATGRGVYYGIREACAYPKDMKRLGLEMGLEGKSVVIQGLGNVGYHAARFLEDGGAKIVGIAEIEGAIHDPDGLDVDDVVAHREETGSILGFADAENIETSAAALELPCDILIPAALEGVITTENAPDIQASIIAEAANGPVTSEADEILQEKNAMIIPDVYLNAGGVTVSYFEWLRNLSHVRHGRMSRRFEERNAERILRAVDELTAEDFSEDLLESLIEQVGFGAGERDLVHSGLEDTMSHAYDEIRAIREKKGVDMRTAAFVSAIDKIAGSYDQMGIFP

SEQ ID NO: 12723 - protein, 166 aa, Triticum aestivum
  misc_feature (44)..(44): Xaa can be any naturally occurring amino acid
  misc_feature (75)..(75): Xaa can be any naturally occurring amino acid
  misc_feature (97)..(97): Xaa can be any naturally occurring amino acid
  misc_feature (133)..(133): Xaa can be any naturally occurring amino acid
  misc_feature (138)..(138): Xaa can be any naturally occurring amino acid
  misc_feature (145)..(145): Xaa can be any naturally occurring amino acid
  misc_feature (150)..(150): Xaa can be any naturally occurring amino acid
MAAAAAMMVSGGRAALAVAGVLCAVAAMAAAQQASNVRATYHLXYNPGARTGGDLEPAWSAYCATVGTPDKPLSXWRQKHGWTAFCGPARQKGQAPXGKCIRVKNRANRRVHPWRGSVDQCNNGGLDLDYETXFKKIXTNGQGYXMGQLXLDYSRLLTTDSADPPV

SEQ ID NO: 12724 - protein, 220 aa, Prochlorococcus marinus str. MIT 9301
MTYSTNFSIEDLRFDNYGLIPAIAQDWLDGSILMLAWMNKESLTMTLETKNVHYWSRSRSEIWRKGATSGSTQILKEIRFDCDNDALILLIEQNGSGACHTGEKSCFFNEIKINQSDKKEKKTTPFSNICSELFNTINERSINPSEKSYTNHLLTKGSNTILKKIGEESAEFIMACKDNDKNSISNEAADLIYHLQVALMHKGVNWRDVLAVLESRRNNN

SEQ ID NO: 12725 - protein, 523 aa, Corynebacterium efficiens YS-314
MSLTPNHRPVLVVDYGAQYAQLIARRVREAGIYSEVIPHTATPQEIQEKNPVALVLSGGPSSVYAEDAPGIDPDILKLGLPVFGICYGFQAMTHALGGKVAATGKREYGRTDLEVKGGVLHDGLELSHKVWMSHGDAVSEAPEGFTVTASSEAAPVAAFENVEAKMAGVQYHPEVLHSPHGQQVLTRFLTEIAGLEQNWTAANIAEELVEKIREQVGPEGRAICGLSGGVDSAVAAALVQRAIGDRLTCVFVDHGLLRAGEREQVEKDFVAATGAKLVTVDERKAFLDKLAGVTEPEAKRKAIGAEFIRSFERAVAGVLEDSPEGSTVDFLVQGTLYPDVVESGGGAGTANIKSHHNVGGLPDDVEFELVEPLRLLFKDEVRAVGRELGLPEVIVARQPFPGPGLGIRIIGEVTEERLETLRHADLIARTELTAAGLDGIIWQCPVVLLADVRSVGVQGDGRTYGHPIVLRPVSSEDAMTADWTRLPYEVLERISTRITNEVADVNRVVLDVTSKPPGTIEWE

SEQ ID NO: 12726 - protein, 565 aa, Shigella flexneri 2a str. 2457T
MEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGLVLPELKDIQKVSRAIAFAVGKMAQQQGVAVKTSAEALQQAIDDNFWQAEYRDYRRTSI

SEQ ID NO: 12727 - protein, 482 aa, Shewanella oneidensis MR-1
MLLNDPSLLRQQCYINGQWCDANSKETVAITNPATGAVIACVPVMGQAETQAAIAAAEAALPAWRALTAKERGAKLRRWFELLNENSDDLALLMTSEQGKPLTEAKGEVTYAASFIEWFAEEAKRIYGDTIPGHQGDKRIMVIKQPVGVTAAITPWNFPAAMITRKAAPALAAGCTMVVKPAPQTPFTALALAVLAERAGIPAGVFSVITGDAIAIGNEMCTNPIVRKLSFTGSTNVGIKLMAQCAPTLKKLSLELGGNAPFIVFDDANIDAAVEGAMIAKYRNAGQTCVCANRIYVQAGVYDEFAEKLSMAVAKLKVGEGIIAGVTTGPLINAAAVEKVQSHLEDAIKKGATVLAGGKVHELGGNFFEPTVLTNADKSMRVAREETFGPLAPLFKFNDVDDVIKQANDTEFGLAAYFYGRDISLVWKVAESLEYGMVGVNTGLISTEVAPFGGMKSSGLGREGSKYGIEEYLEIKYICMSV

SEQ ID NO: 12728 - protein, 425 aa, Shewanella oneidensis MR-1
MSTTNDSLMARRQAAVAGGVGQIHPIFTARAENASVWDVEGREFIDFAGGIAVLNTGHLHPKVKAAVAAQLEDFSHTCFMVLGYESYIQVCEKLNQLVPGDFAKKTALFTSGSEAVENAVKVARAYTKRAGVIAFTSGYHGRTMAALALTGKVAPYSKGMGLMSANVFRAEFPCALHGVSDDDAMASIERIFKNDAEPSDIAAIILEPVQGEGGFYAVSPAFMQRLRALCDREGIMLIADEVQTGAGRTGTFFAMEQMGVSADITTFAKSIAGGFPLSGITGRAQVMDAIGPGGLGGTYGGNPLACAAALAVLEVFEEEKLLERANAIGDRIKSALNTMQVEHPQIADVRGLGAMNAIELMEDGKPAPQYCAQILAEARNRGLILLSCGTYGNVLRILVPLTVSDTQLDAGLGILKTSFNAVLKG

SEQ ID NO: 12729 - protein, 171 aa, Brassica napus
  misc_feature (28)..(28): Xaa can be any naturally occurring amino acid
LKGNVACEISSAEELTQTELMFSGVFKXAKVEQLVSLLSCFVWRERLPDAAKPRKELDLLFIQLQDTARRVAEVQLDCKVDIDVESFVHSFRPDIMEAVYAWAKGSKFYEIMEIARVFEGSLIRAIRRMEEVLQQLIVAAKSIGEIQLEAKLEEAVSKIKRDIVFAASLYL

SEQ ID NO: 12730 - protein, 689 aa, Oryza sativa (japonica cultivar-group)
MEVADKIVEPKGPLVATAQLPNNVELLKSVVLNPSREGGSSQEQYEKDLLAEGEESFRSEESSDEGGRSSFSGVSHPPEPIDVDLMSTVYVAIDEEKPEPPECLMRGLSVKGASMEDLSVHAMDAKPDVIVCTVNVNGLVEERKVHCAVVAPDAVEAVSSTQASEEKDCVWDASFPPSGNVSPHSSSDSTGAVAATSIRGRSTSTCRSGVLTSESILTVEKTCESAKDSTRGNSMESTKTSMSRASDSSGVSDDSNWSNITGSANKPHKGNDPRWRAILAVRGRGNVLGMSHFRLLKRLGCGDIGSVYLSELSGTRCYFAMKVMDKASLASRKKLNRAQTEREILQLLDHPFLPTLYTHFETDRFSCLVMEFCPGGDLHTLRQRQPRKHFSEYAARFYAAEVLLALEYLHMLGVVYRDLKPENVLVRDDGHIMLSDFDLSLRCAVSPTLIRASASDSDPRRAGGSFCVQPACMEPSSVCIQPACFMPKLFGQRSKKQGRRPRSELGQGGGAALPELVAEPTSARSMSFVGTHEYLAPEIIKGEGHGSAVDWWTFGIFLHELLYGKTPFKGSGNRATLFNVVGQQLRFPESPSTSYAGRDLIRGLLVKEPQQRLGVKRGAAEIKQHPFFEGVNWALIRCSTPPEVPRHVEAELPAKYGVAEPVASGGGGGKRVVGAEVRSGGKYLDFEFF

SEQ ID NO: 12731 - protein, 362 aa, Haloarcula marismortui ATCC 43049
MWYRHTIRMRAAVLEEYEEPLAIRDVERPDPDPDGVVAKVDACGVCRSDWHGWVGNWDWFDYKPPRGHILGHEPSGTVVEVGENVDTVKEGDTVAIPFNFACGHCHECRVGYENLCENHLGLGFQPGAPGAFAEEVPIPNADINAVKLPDGVDPVEVAGMGCRFMTSYRGMAHQADVSRGEYVVVQGLGGIGLSAVHIADALGGNVIGVDLMDEKLEMAEELGAIDTVNAAEEDDVVQAVRDITDGGAHVSLDALGIEETCQNAIESLRTRGRHVQIGLTTKEQRGYNSLPTDTIVMNEIQVQGSSGLPPSKYGEMFRMVENGKLDPGAVITDKIGLEGVSDELAAMTDYETIGIPVVNEFA

SEQ ID NO: 12732 - protein, 411 aa, Zea mays
MHPSRRRSIHLKASRDMESSPLLQLPAARVEALSLSGLSAIPPEYVRPADERAGLGDAFDLARTHANDHTAPRIPVVDISPFLDSSSQQQQRDECVEAVRAAAADWGVMHIAGHGIPAELMDRLRAAGTAFFALPVQDKEAYANDPAAGRLQGYGSRLATNTCGQREWEDYLFHLVHPDGLADHALWPAYPPDYIAATRDFGRRTRDLASTLLAILSMGLLGTDRGDALEKALTTTTTRTAADDDLLLQLKINYYPRCPQPELAVGVEAHTDVSALSFILHNGVPGLQVLHGARWVTARHEPGTIIVHVGDALEILSNGRYTSVLHRGLVNREAVRISWVVFCEPPPDSVLLHPLPELVTEGHPARFTPRTFKQHLDRKLFKKKQQHKAKAEEEDGGNGDHHRHEPPPQTN

SEQ ID NO: 12733 - protein, 248 aa, Bacteroides fragilis YCH46
MKKIVLLRHGESAWNKENRFTGWTDVDLTEKGIAEACKAGELLKENGFNFDKAYTSYLKRAVKTLNCVLDRMDQDWIPVEKSWRLNEKHYGDLQGLNKSETAAKYGDEQVLIWRRSYDIAPNALSEDDPRNPRFENRYQEVPDAELPRTESLKDTIERIMPYWKCIIFPNLKTADEILVVAHGNSLRGIIKHLKHISDEEIVKLNLPTAVPYVFEFSDELNLEKDYFLGDPEEIRKLMEAVANQGKKK

SEQ ID NO: 12734 - protein, 350 aa, Erythrobacter sp. NAP1
MRLGAAATFHQTRYHKDAFFVTDTRYDVIAIGNAVVDVIASCEEGLIDELSLNRGGMTLIDEARADELYDAMPPARELSGGSAANTLAGLSTLGLQCAFIGQVADDQLGKVFRHDMRATGIDFDTPARDGEPATGRVLIFVTPDGERTMNTFLGAGQFLPAEALDEDLIASAGILYLEGYLWDPEEPRRAMRRAIEVAREAGRKVAFTASESFVIERHGDDFRAMIDDGLIDILFVNESELATLTGEDDFETGFNAVAPKVPVLVATRSAKGAVASAHGERAVTAAAPVAKVVDTTGAGDQFAAGFLSGYAKGEGLEVCLKRGAIAAAEVIAHYGPRPEADMKALMAERL

SEQ ID NO: 12735 - protein, 429 aa, Halobacterium sp. NRC-1
MAQTPPPESAPSTDSEPETALETARRQLQAAAEHVDIADGVIERLTHPTRVVQVSVPVERDDGTVTVYDGYRAQHDDVRGPYKGGLRYHPGVSAEECVGLSMWMTWKCAVMDLPFGGAKGGVVVDPKTLSADEHERLTRRFAAELRDEVGPSQDIPAPDMGTDAQTMAWFMDAYSMQQGETVPGVVTGKPPVAGGSHGRAEAPGRSVAIATREAINYYDIPIDDATVAVQGYGSVGANAALLLDDWGARVVAVSDVNGGVLDTDGLDTHAIPSHGNQPAAVMRHDAPNTLTNEELLELDVDVVIPAAVGNVITAANADRIQADIVVEGANGPTTSAADRILEERAVPVIPDILANAGGVTVSYFEWLQDINRRTWSPERVRDELESEMLSAWNAVRSEVDDGDLSWRDAAYVVALQRIGRAKEARGLWP

SEQ ID NO: 12736 - protein, 600 aa, Halobacterium sp. NRC-1
MERRAQRGGRRRPELAGRCLRCRAATHRPCEGSPWALALICTALGVPTPQTTITDVCDGGGVMHRPLLVTDFIDRARTYYGDETAVVATTGRRYTYSELADRADRFSAVLQAAGIDSGDRVAVLDPNTHYHLEAAYGAMQLGAIHTPLNYRLTPDDYAYILADAGADAIYADAAYADRVEAVRDQIPTTTFITDDPAAVDGDWQDADALLADADPDDYDRPDMAEDDVITINYTSGTTGDPKGVCRTHRNEVVHALLLSTHHTITDTDTYLWTLPMFHANGWGHIFAITGAGATHVCTRGVDAASVFDTIQAEAVSYLCAAPTVLNMLLDYHEAHDVAATGDADVRVATAGSAPPEATIRAVESALDWSLMHVYGATETGPLIATSDADRLLAAGGGSRAAMQKRQGIGLLGTELRVVDEHGNDVPRDNETIGEIVVSGNQVMDRYWNKPDATERAFTDRVDGYFHMGDFAVVDDTGFVSILDRKKDIIISGGENISSIELEDTLFEHDAVGEVAVVPSPHDDWGETPKAFVVPASGDPNNPGVTTTALVEYTRAELASFKTVRRVEFVDELPTTATGKVQKYELRAAEFADEESLVGQG

SEQ ID NO: 12737 - protein, 435 aa, Mesorhizobium loti MAFF303099
MGNDLAAFAKKNGVKYFMISYTDLFGGQRAKLVPAQAIADMQKDGAGFAGFATWLDLTPAHPDMLAVPDPDSVIQLPWKKEVAWVAANCIMDDKEVDQTPRNTLRRLIAEAAGDGMHVKTGVEAEFFLISPDGSVISDQYDTASKPCYDQQAVMRRYDVIAEICDHMLALGWGPYQNDHEDANGQFEMNWAFDDVLATADKHSFFKFMVKSVAEKHGLRATFMPKPFQGLTGNGCHAHISVWDETGKTNVFADNSMELGLSAKGKNFLGGIMKHASALAAITNPTVNSYKRINAPRTISGATWAPNTVTWTGNNRTHMVRVPGPGRFELRLPDGAANPYLLQAVIIAAGLDGIRSKADPGKRYDIDMYQHGHTVKGAPKLPLNLLDALREFDKDKSLKAALGEEFSSAYLKLKHQEWNSYASHFTQWERDHTLDI

SEQ ID NO: 12738 - protein, 142 aa, Oryza sativa
  misc_feature (116)..(116): Xaa can be any naturally occurring amino acid
EFGTRVQRGLIGDIISRFEKKGFYLRGMKFMNVERSFAQQHYADLSDKPFFPGLVEYIISGPVVAMVWEGKDVVVTGGRIIGATRPWEADPGTIRADYAVEVGRNVIHGSDSVDNXQRGIALWFPEGLAEWRSNLHPWIYES

SEQ ID NO: 12739 - protein, 123 aa, Glycine max
  misc_feature (55)..(55): Xaa can be any naturally occurring amino acid
AHVSGGIRYHPEADPDEVNAVAQLMTWTAAVANLPYGGAEGGPGRDPWKVRVSAXEGVTRVYTHALQDVIGSHTNVPPPDTGAGPHNTVWFLDELYKVPGHSAAVYTGKPIDLDDTVKLYADT

SEQ ID NO: 12740 - protein, 259 aa, Triticum aestivum
  misc_feature (207)..(207): Xaa can be any naturally occurring amino acid
MGLGLRLPFFLLLLLLVSLGAAQGRSTVFLDIKEARDPDQILMDQITSSKTPVRVERGSPLCPACEKFTDEALSYLSQKQSQDKMMEVLHEACSQTFSLEKKCVELVDSYATLLFAKIAEIKPEEFCKRNGLCRDNALLSGVRSESTCVFCHHLMDEVLSKLKDPDAEFEIIQILLKECKKIEGHEQQCKRLVLQYIPLILVNGEKXLEENDICTIVQACDAGKRPWSGHLRRGFLRDHEVKRQPNPVTRREIVPSLLV

SEQ ID NO: 12741 - protein, 277 aa, Medicago truncatula
MPLILPQNDDSIQIREVWSDNLEEEFAVIREIVDDYPFIAMDTEFPGIVLRPVGNFKSNYDYHYQTLKDNVDMLKLIQLGLTFSDEHGNLPTCGEDDRFCIWQFNFREFNVNEDVFANDSIELLRQSGIDFKKNNEDGIDARRFGELLMSSGIVLNDNVHWITFHSGYDFGYLLKLLTCQNLPDTQVGFFNLINMYFPMLYDIKHLMKFCNSLHGGLNKLAELLEVKRVGICHQAGSDSLLTSSAFRKLKENFFSGSLEKYAGVLYGLGVENGQSTH

SEQ ID NO: 12742 - protein, 511 aa, Ananas comosus
MTIDFSMPGSSGILDSPAKRDMSFFSNGYVLGLTVTAGIGGLLFGYDTGVISGALLYIRDDFKAVNDNYVLQETIVSMALVGAMIGAAGGGWVNDAYGRKKATLLADVVFTVGSLIMCAAPDPYVLILGRLLVGLGVGIASVTAPVYIAEAAPSEIRGGLVATNVLMITGGQFLSYLVNLAFTEVSGTWRWMLGVAAIPAIIQFILMLFLPESPRWLYRKNEKARAIEVLSKIYDPDRLEEEIDLLAVSSLDDRSKKSVSYLDVFRSKEIRLAFFAGAGLQAFQQFTGINTVMYYSPTIVQMAGFSSNQLALLLSLIVAAMNAVGTVVGILLIDRAGRRRLALTSLSGVTLSLLILSAAFFLQSSDLTSALCGSAALHTSTACGNRLGWFAVAGLALYIAAFSPGMGPIPWAVNSEIYPEAYRGVCGGMSATVNWVSNLIVAQIFLSVVAVLGTAATFLIIAGVAVLAFVFVLLFVPETKGRTFEQVERMWKERAWGSPLGSRESLLDGAA

SEQ ID NO: 12743 - protein, 435 aa, Coxiella burnetii RSA 493
MVDHSAALFNKAQNYMPGGVNSPVRAFGAVGGVPRFIKKASGPYLIDVDEKKYIDYVGSWGPMILGHAHPAVIQAAQEAVQNGLSFGAPCENEIKLAALIGEFMPSIEKVRMVNSGTEATMSALRLARGVTGRSKIIKFEGCYHGHADCLLVNAGSGALTFGMPSSPGVPLGTVQDTLTATFNDLDSVAALFEKYSKDIAAIIVEPIAGNMNLIPAAPDFLTGLRELCNQYGSLLIFDEVITGFRVAKGGAQSLYNIRPDLTALGKIIGGGMPVGAYGGRREIMNQLSPEGPVYQAGTLSGNPVAMAAGLATLKELTAENFYSNLKEKTERLVMGILSRAKAAKIPLTANFSCGIFGLIFTSEERVTRYAQAVNGNVEHFRSFFHKMLDNGVYLAPSAFESGFISAAHTNKEVDNTLDIIENIFSVSETYLRISV

SEQ ID NO: 12744 - protein, 376 aa, Shigella flexneri 2a str. 2457T
MLQRGCDGCKQNQSREPATIDGFMPKAQESIMGQQKQRNRRWVLASRPHGAPVPENFRLEEDDVATPGEGQVLLRTVYLSLDPYMRGRMSDEPSYSPPVDIGGVMVGGTVSRVVESNHPDYQPGDWVLGYSGWQDYDISSGDDLVKLGDHPQNPSWSLGVLGMPGFTAYMGLLDIGQPKEGETLVVAAATEPVGATVGQIGKLKGCRVVGVAGGAEKCRHATEVLGFDVCLDHHADDFAEQLAKACPKGIDIYYENVGGKVFDAVLPLLNTSARIPVCGLVSSYNATELPPGPDRLPLLMATVLKKRIRLQGFIIAQDYGHRIHEFQKEMGQWVKEDKIHYREDITDGLENAPQTFIGLLKGKNFGKVVIRVAGDD

SEQ ID NO: 12745 - protein, 800 aa, Geobacter metallireducens GS-15
MTWIRWFSAITIDDVPLVGGKNASLGEMYRELRPLGVKIPNGFAITAEAYWYLVRSAGVLDEMRRTLAKLHKEDVDDLALRGHRVRELICGAPLPADLAAEITAAYRRLCIEYGENCDVAVRSSATAEDLPTASFAGQQETYLNIRGEVQLLDACRRCFASLFTDRAISYRIDQGFDHFKVGLSIGVMKMVRSDRASSGVIFTLDTETGFRDTVLVTGAWGLGENVVQGAVNPDEFTVFKPPLRQGFRPIVRRKLGEKKIKMIYGTGTSKHLTKNVEVPREERRHYCLADAEVLELARQALLIEEHYSKRAGHDVPMDIEWAKDGVSGELFIVQARPETVESQKRLDFLETYVLERKGEVLVTGTSVGGKIAVGPARVITDVHKLNEFSPGEVLVADTTTPDWEPVMKTAAAIVTNKGGRTCHAAIVSRELGIPSVVGTGDGTGRIAPGREITVSCAEGDVGRIYDGALPFRIERVDLSGMRRPRTRIMMNLGNPEEAFSLCRIPNDGVGLARMEFIITNHIKVHPMALVHPERVEDEASRREIGRLTAGYPDPPAYFVEKLAEGIGTIAAAFHPKPVIVRMSDFKSNEYASLLGGRAFEPAEENPMIGFRGASRYYDERYREGFALECRALKRVRDEMGLVNVIPMIPFCRRIVEAEKVLAEMAANGLVRGENGLGVYVMCEIPNNVIMIDEFSQLFDGFSIGSNDLTQLTLGIDRDSALVAHVFDERDPGVMRLIASVVEGARRNHRHSGICGQAPSDYPEFAAFLVREGIDSISLNPDSILKITLRVLEMEKEIEKP

SEQ ID NO: 12746 - protein, 444 aa, Zea mays
MATTSFRSLLLLFLSVLGASARNEEDARALAALKRALDPAGRVLGSWDPSGDPCAGSFVGLTCGRDGRVTAVSLQGRGLSGTLPPAVAGLRRLQGLYLHYNGIKGPIPREIGKLSELTDLYLDVNHLTGPVPVEIAAIANLQGGAGVGSPGQVVGDSFRFNLEEVECATQYFSDVNLLGKSGFAAATYKGILRDGSVVAVKSLSKTSCKQEESDFLRGLKMLTLLQHDNLVSLRGFCCSRGRGECFLVYDFMVNGCLSRYLDVKDGSSGATVLDWPTRVSIIRGIAKGIEYLHSKKGSKPPVVHQNISADKILLDHHLAPRLSVPGLHKLLADDVVFSALKASAAMGYLAPEYAATGRFTDKSDVFAFGVVVLQVLTGRRDVSQLKVGAAAVSDLGGLVDANLDGAFSRTEAARLAAVAAYCTSETPGQRPTMEAVVQQLSSTQ

SEQ ID NO: 12747 - protein, 395 aa, Candidatus Kuenenia stuttgartiensis
MEIIVSKRLQSIGAYAFAEVDKEVEKLRAMGVTPIDFGVGDPTVPTPEIIRKATQEGITKRKSSGYPSYIGTAEFRQTIAQWTKKRFGVTLDPSTEISSTIGSKEGIFNFHEGFIDPGDYVIIPTPGYPPYTRGTLFAEGTPYYVPLLKENNFLMDLKSIPEEVCKRAKILWLNYPNSPTGAVAPLSYLKEAVEFGKRHNIIVASDEAYSEIYFNEPPHSILEVAKEGVIVFNSLSKRSAMTCYRIGWVAGDKKIVDVFKKVKTNIDSGTPTFIQDGAIAALSDETHVGEMRADYKLKRDLLVTAFKKINLPDCTPEATIYLWQKVPQGMSSVEFAKKLLSPDIAIVTTPGGWISDKTESGINPGEGYVRFALVPGIEDTKKAAKRIEEQLSKII

SEQ ID NO: 12748 - protein, 666 aa, Bacteroides fragilis YCH46
MKMNYLAFIGVTAATAVVSCTPAKKEYASYELYPVRSGSLTEMEYSPESTKFTLWAPTADEVRLMLFDSGEGGHAYETIPMEPGEEGTWMATVSKDLMGKFYTFNVKVNDKWMGDTPGINAKAVGVNGKRAAIINLKSTDPQGWETDQRLPLKSPADAIIYEMHHRDFSVDSTSGIQHKGKFLALTEHGTMNSAKLLTGIDHLIELGVTHVHLLPSYDYASVDETKLDENKYNWGYDPQNYNAPDGSYATDPYDPAVRIREFKQMVQALHKAGIRVVLDVVYNHTYNTDGSNFERTVPGYFYRQKPDGSLANGSACGNETASNRPMMRKYMIESVLHWIREYHIDGFRFDLMGIHDIETMNEIRKAVSAVDPSIIIYGEGWAAEAPQYPGDSLAMKVNTCKMPGIAAFSDEMRDALRGPFNDNHKGAFLAGIPGEEESIKFGIVGAVSHPQVNNDSVNYSKAPWASQPTQMISYVSCHDDMCLVDRLKSSIPGITPEQLVRLDKLAQTAVLTSQGIPFIYAGEEVMRDKKGVHNSFESPDSINAIDWNRKTTHEDVFAYYKRLISIRKAHPAFRMGDAEMVRKHLEFLPVDGGNLVAFRLKDRANGDTWDNIIVALNARSVPAKLAIPEGKYTVVCRDGVIDERGLGSLYGPEVTVPAQSALIIHQ

SEQ ID NO: 12749 - protein, 1131 aa, Arabidopsis thaliana
MEEDRGEAIVLDISPEINNTPAVMMRVPRRIRERLLSDCSNKKTVSSVQDIEDKLLHAHLRRQQFYHNVSRKARAKPRSPSRSSDEELGQRIEARLLAAEQKRLEILAKAQMRLAKLDELRQAAKTSVEIRSERERVKLGTQVESRVQKAEANRMKILKASHQKRACAKERTSQSMMRRMARESKYKERVRASINQKRVAAEKKRLGLLEAEKKKARARVQQVRHVANSVSNQREIERSKMRDKLEDKLQRAKRYRSEFLRQRRRQRDSISLYCDMMQEDADLLSRKLSRCWRCFVRQKRTTLDLAKAYDGLKINESLPFEQLAMLLESLNTLKTVKSLLDRLEIRLEASKNVTTVSQPSILDNIDHLLKRVATPRRKATPSTLRSRKGKKVSSVRNVAGTSVKMSRYPVRVVLSAFMILGHPDAVFNGQGDQEAALNNAAKGFVRELKLLINVIQEGPVQVSGGESKHRTLRSQLDLFDKAWCSFLNSFVIWKVKDARLLEDDLVRAACQLELSMIQKCKLTPEGVDTMLTHDKKAIQMQVTQDQELLTEKVRHLSGVAGVERMESALLETRTKYFQAKEDGSPMANQLAHFFSPSPASSPVQSVSSSSSRSKDSIGVEGSNRVNRSLLKDDTPPSSGPSRVSNGTVDEVSNQNELMVNEFLHDGNLNFPGGSTVKDEEDNLKRRIKETMERAFWDNVMESMKLEKPDYSCISNLMKEVSDELCQMVPDSWKVEITETIDLDILSQLLNSGTLDIDYLGKMLEFALATLRKLSAPANDRENESTHRDLLKELHRLCEAEDESGNFRAVAIVKGIRFILEQIQELKREIGIGRIAIMKPFLQGPAGFDYLTKAFEKRYGPPTQAYESLPVTRRWISTLLSSKEEWEEHNNTLSALNVVERSSMGISLKTGGSFLSPVNTTSKSTVMDTAGQLSECKGERVDLAVRLGLLKLVNQVAGLTPEVLPETFQLNLFRVRDIQAEIQNIIVVTTSLLIWRQMLAKSESETESMAKKLLELLDGKEGAGLTEIIETTMSEEDGEKKKMMRGLLGKSLGEGNTVYERVTSCIYKAARGALLAGNGENGKRMVETEMKKVGGGGGLKERVLETARALGVVACVSVRVHGPWLTQLMPQH

SEQ ID NO: 12750 - protein, 613 aa, Bacillus licheniformis ATCC 14580
MCGITGWVDFKKPLVREQSIMEKMTDTLSKRGPDDTNIWGKRHVLFGHKRLAVVDLEGGRQPMTRTHQGYDYTICYNGELYNTEDLRKELRRRGHQFKSHSDTEVLLHSYMEWKEECIDRLNGIFAFAVWDEKRDLLFAARDRLGVKPFFYTEQGSSFLFGSEIKAILAHPEVKAKVDRSGLAEIFGLGPSRSPGSGVFKGVKEIRPGHAMIFSKDGLTVWRYWNVKSEKHTDSFDETVENVRSLFQDAVTRQLVSDVPVCTFLSGGVDSSAITATAAKHFEREGKAPLHTFSIDYEDNEQYFTSSSFQPNADGPWIKKMSDAFGTVHHNCVISQEELAAYLEEAVLVRDLPGMADVDSSLLWFCREIKKDFVVSLSGECADEIFGGYPWFHSAEDVKGFPWMRSMEERIGLLQDGWQKKLNLSEYVKAKYEETVKETPLLEGETGAEKRRRELFYLNMLWFMTTLLDRKDRMSMGASLEVRVPFADHRLVEYVWNIPWDVKMHGSREKGIFRKALEGILPDEVLYRKKSPYPKTHHPAYTKAVIRWLESLLEQKDSALYAFLEKKKLERLIETEGASFQVPWYGQLMKGPQLIAHLAQIHTWFESYRIDIEE

SEQ ID NO: 12751 - protein, 668 aa, Marinobacter sp. ELB17
MLMPSRKDLANAIRALSMDAVQKAKSGHPGAPMGMADIAELLWNDYLSHNPANPQWANRDRFILSNGHGSMLQYSLLHLSGYDVSIDDIKNFRQLHSKTPGHPEYGYTPGVETTTGPLGQGLANAVGFALAEKTLAAQFNRPGHDIVDHYTYTFVGDGCLMEGLSHEVSSLAGTLGLGKLICFYDDNGISIDGKVDGWFTDNTPQRFEAYGWQVIADVDGHNADALSAAIEVARANTEQPTLICCKTVIGFGSPNKQGSESAHGAPLGEDEIVLTREALGWKHGAFEVPDDIYAQWNGKEKGQTAESAWNDTFAAYQKAEPELAAEFKRRMAGDLPADFSGKAQAYIQSVQDKGETIASRKASQNSLNTYGPMLPELLGGSADLAGSNLTIWSGCNTVTKEDASGNYINYGVREFGMAAIMNGLALHGGFVPYGATFLIFMEYCRNAVRMAALMKQRAIYVFTHDSIGLGEDGPTHQPVEQLASLRTTPNMSTWRPADAVESAVAWKAALERTDGPTALVFSRQNLPHQNRSAQQLADVARGAYVLSDSEGTPELILIATGSEVGLAQDVAAKLREQGKAVRVVSMPSTDTFDAQSADYKQQVLPLDVTNRIAVEASIADYWFKYVGLDGRIVGMTTFGESAPAGELFKEFGFTVDNVLDVAAELLEA

SEQ ID NO: 12752 - protein, 1163 aa, Gibberella zeae PH-1
MSAKVYVGNLGWNTTDDSLRNAFQDYGQILDSIVMRDRDTGRSRGFGFVTFGSSQEAETAIISLNEQELDGRRIKVNLANARPGGGGGGGGYSGGGGYMGGGGYNGGGGYNGAMMNSHMLLIDTYILSIIDFQVICSYMEDILYTHKLRLPYIESHLISRLPPKYCLNVTQENPLVTSVEYSTKANTCSYPMKLYPAIEKLTLNDIESVKSAIMNGLDPNTLWTEEVLVLPVPKSGCVMWSQPFDFDTWPHWNTPLHRAIKFSDFETAAFLLQHGANVDLYNAVGKTPLHEAVWNRKYDAIRFLLGHNAEMNNFTLGACIRYEGENQDIHGIGGQLNIQKALSSSDLTSVQLLVHAGADLCPPSQHPWTTLDLALLYGDRTIVELLRKLGHKLPTTGPTSSRDVYQDSSRDLLRFSRDGNIVPSKDLYEVYCFVLGKVDQVAIIDADILIKRFFEALHETANDTDGNKHIIICTSCQNFQSEARVIFEVENYFTFDFDENREHLGFTFDLHPSRRQLIDSASNGCAICAIIADALDDHERNPRTAFQPFDTEFGPESDSVKLQPARYWSLNCIKVSCSELGTEIPLFDVYDSLTSSFEDGHQMDNSTGSSSAMIMAKNWIRICQENHTECQELEKKRHRKSILPRRLIRVGTSEIQPRIVHVQDTVPYCALSYCWGSKDFFTTTRDNLVQNMRGISMESFPAIMRDAISVVRSLEFEYIWIDALCIVQDDERDWAHEAGIMGDIYSNAELTISTLVSSDCHTGLFQPRSVRISHPVPLGIWQPKTKRKANASSALTPQWLERDVKTSGPVHSRGWTLQEQLLSKRILYFGHEMLHFECLHDYVVEANPGGEYRRSANQHDQELQIRRHTKKALQGARTRESVSSETGCDRQPFELWKQQVKDFTQRNLTRASDRPPAFDAISKSLATAIGCKPLCGIWDGGKLFESLCWQTGNCADAPLNLPNIPSWTWLARTGAISFALASRDGREEVQTSSGATVVSINSEATGLSITLRGTLHRKQRIDDTLLEHWKKLESDKRYNPSVYLDYNMGDDRDVYTFDTLRFPQGHPHKGYGYPVCPNGRNPETLGLLLQKVDNKLNTFQRIGIAKIPPRYEGYEGYEGFKTIPELDPHDGIIPAPCISHEITQIKWLSTDEETFTDQQFTLV

SEQ ID NO: 12753 - protein, 137 aa, Streptomyces coelicolor A3(2)
MTQRSLVLLKPDAVRRGLTGEIISRIERKAGWQITALELRTLDTETLEQHYGEHKGKPFYEPLVEFMASGPVVAMVVEGERVIEGVRALAGPTDPIAAAPGSIRGDYGVIVRENLIHASDSEESAERELKIFFPGRV

SEQ ID NO: 12754 - protein, 286 aa, Zea mays
GASSAAASRTARAQRPRGYRRRRGGWTPPQRRRRRARGERRPKGLRVCVRPPDVMETVHEVAIYIHRFHNLDLFQQGWYQMKISALWEEGGNRTPASPARVVQYEASDVGADDALGIWKIDDVDNSFHTQPFRIKYARQDIYLSVMVSFNIFNSEEEGPADSAVMLKFELMYAPTLENGSELQASSVTSSAAVHEFRIPHRALLGLHSYCPVHFDAFHSVLVDLTLHIVYLKAGATKPSLKVPDQGLGPTSYHIGKALLTSRKLLLEELKKIGAIGKTVEELDVAD

SEQ ID NO: 12755 - protein, 388 aa, Marinobacter sp. ELB17
MAIKKMTNLNLAGKRVLIREDLNVPLKNGRITSDARIRAALPTIKAAASAGAKVMLMSHLGRPEEGVYDQAASLKPVAEHLSDALGQNVRLIKDYLNGEDLHLADGDVVLFENVRFNKGEKKDDEALAKQYAALCDIYVMDAFGTAHRAQASTHGVGKFAPEACAGPLLAGELEALGKALDNPARPVVAIVGGSKVSTKLDVLNALEKVCDQIIVGGGIANTFLAAAGYPVGKSLCEHDLLDVAKNIASRVEIPLPVDVVVASEFSETATATIRNISDVTEDDMILDVGPETAGQFAELLKNAKTILWNGPVGVFEFGPFENGTKVLAHAIADSAAFSLAGGGDTVAAIDKYGVNEKISYISTGGGAFLEFVEGKTLPAVAMLEERGA

SEQ ID NO: 12756 - protein, 923 aa, Vicia hirsuta
MELQALWITRLAVACVLCLCIFIRSGSSATGGFESIACCADSNYTDPKTNLNYTTDYKWFSDKSSCRQIPEILLSHRSNVNFRLFDIDEGKRCYSLPTIKDQVYLIRGTFPFDSVNSSFYVSIGATELGEVTSSRLEDLEIEGVFKATKDSVDFCLLKEDVNPFISQLELRPLPEEYLRDFSTDVLKLISRNNLCGIEDDIRFPVDQNDRIWKATSTPSYALPLSLNVSNVDLKGKVTPPLQVLQTALTHPERLEFVHDGLETDDYEYSVLLYFLELNNTLTAGQRVFDIYLNSEIKKENFDVLEGGSKYSYTALNITANGSLNMTLVKASGSKFGPLLNAYEILQARPWIDETSQPDVEVIQKMRKELLLQNQDNEALESWSGDPCMIFPWKGVACDGSNGSSVITKLDLSFNDLKGTIPSSVTEMTNLQILNLSHNHFDGYIPSFPSSSLLISVDLSYNDLTGQLPESIISLPHLKSLYFGCNQHMSDDDEAKLNSSLIITDYGRCKAKKNKFGQVFVIGAITSGSILITLAVGILCFCRYRHRTITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDNSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRVLPSTTTMAESTITTQNVSHPQPR

SEQ ID NO: 12757 - protein, 923 aa, Melilotus alba
  misc_feature (64)..(64): Xaa can be any naturally occurring amino acid
MELQIIWILRLVVACVLCLCIFIRSASSATKGFESIACCADSSYKDLKTTLNYTTDYIWFSDKXSCRQIPEILFSHRSNKNVRLFDIDEGKRCYDLPTIKDQVYLIRGTFPFDSLNSSFYVSIGATELGEVRSSRLDDFEIEGVFRATKDYIDFCLLKKDVNPFISQLELRPLPEEYLHGLATSVLKLISRNNLGGTEDDIRFPVDQNDRIWKATSTPSSALPLPSNVSNVDLKGSVTPPLQVLQTALTHPERLEFVHDGLETDDYEYSVFLYFLELNGTLKAGQRVFDIYLNNEIKKEKLDVLAGGSKNSYTVLNISANGSLNITLVKASGSEFGPLLNAYEILQARPWIEETNQIDLEVVQMMREKLLLHNQDNEALESWSGDPCMLFPWKGIACDDSNGSSIITKLDLSSNNLKGTIPSTVTEMTNLQILNLSHNHFDGYIPSFPPSSVLISVDLSYNDLTGQLPESIISLPHLKSLYFGCNQHMSDEDTAKLNSSLINTDYGRCKAKKPKFGQVFVIGAITSGSLLITLAVGILFFCRYRHKSISLEGFGGKTYPMATNIIFSLPSKDDFFIKSVSVKPFTLEYIEQATEQYKTLIGEGGFGSVYRGTLDDGQEVAVKVRSSTSTQGTREFDNELNLLSAIQHENLVPLLGYCNEYDQQILVYPFMSNGSLLDRLYGEAAKRKILDWPTRLSIALGAARGLAYLHTFPGRSVIHRDVKSSNILLDNSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESAITIQTLSHPQPR

SEQ ID NO: 12758 - protein, 776 aa, Halobacterium sp. NRC-1
MIGAGIFVLPKIAAEQAGPASMVSFFVGGMVSLFAALSLSELATGMPKAGGSYYYVNRALGPFFGSIVGWGMWAGLTFASAFYMIGFGQYLLPGLGEYVGVLAGWGDLGITVAALAMAALLTAVNYYGVKETSALQNVIVLTLVGLVLAFLGLGAVTGPTITEFNPNGWPAVAATIGTVYVTFIGFEVIATSAEEIKNPSRNLPLAMIAAVVTPTLMYVGVMFVSTGTIDIPVLAGSDVPVALVAREIFQPLAGAVSWLPFVSVQPATAGSVGALAMIVGAVLATVSSANASILSAARVNFAMGRDKILVNWLNEVHDRFRTPYRAIAATGVITLLLIGIGVGVGTLAEVASFMYLVTYALVHVSVVVLRRANPDTYDPAFRIPAVLYPVVPVLGAAACVAVLVQMSVTFSPMTIGVASVAVVLPVTPTPVGAIGTVLVAFGIAWYYCYARARAPSQSLVGDALAPSSSPDTDTPDTYTVVVPVANPDTEHDLLRMAAASAHAHTDAHAEVIAVNVIEVPRQTSLSQDLAFEEERVERQQELLDAASAAAADLDVRLRTRAVASHDTGAAILDVIEDTAADHVLLGWGGTRRRDHVLGSTIDPVVGHASCDATLVRLGPAAAGDASDIMVLAGEGPHAPVAARRAAEFVAADETDASLTLLNVQPPADDDDDADASATERGAAVIDALAERAGIKYMTYDTEVVVSTDTEAAVIDAAADFDMVYAGATRSGPVSQAVFGSIPEAVGAGVDQTVVMARGPDNTPMSVRDAITRRFGG

SEQ ID NO: 12759 - protein, 329 aa, Anabaena variabilis ATCC 29413
MAQDRKSTVIVTGASSGVGLYAAKALAKRGWHVVMACRNLEKAEQAAQEVGIPKDSYTIIHIDLGSLDSVRQFVNDFRATGKSLDALLCNAAIYMPLIKEPLRSPEGYELTMTTNHLGHFLLCKLMLEDLQKSSAADKRLVILGTVTHNPDELGGKIPPRPDLGNLEGFAQGFKPPISMIDGKKFEPVKAYKDSKVCNVLTMRELHRRYHESTGITFTSLYPGCVAETPLFRNHYPLFQKIFPLFQKYITGGYVSQELAGERVADVIAAPEYKQSGAYWSWGNRQKKDGKSFVQKVSPQARDDEKAERLWDLSEKLVGLESQKPVALNS

SEQ ID NO: 12760 - protein, 400 aa, Prosthecochloris aestuarii DSM 271
MQELEQAVNRSVRVIPQGEGRVTIEKDLSSEEMILNMGPQHPSTHGVLRLECKTDGEVVTEAEPYLGYLHRCFEKHAEVVDYPGIVPFVDRMDYLAAMNSEFAYCIAVEKLLDVEIPRRVEFMRVIVSELNRIASHLVAIGTYAIDLGAFTPFLFCFRDREHIMSLLEWASGARMLYNYIWIGGASFDFPPGFKERTAEFVNYFRPKALELQRLLTENEIFVKRTKGIGMMPPDVAVNYGWSGPMLRGSGVEWDLRKHDPYSIYPELDFKVCVPDGKHSDIGDSLSRHLVRAYEMVESLSMIEQCLDKMPDANGFDPRSAIAKRIRPKAGEVYGRAENPRGELGFYIVSDGKSTKPVRCKARSSCFVNLSAMKELSMGQLIPDLVAIIGSIDIVLGEVDR

SEQ ID NO: 12761 - protein, 387 aa, Oryza sativa
MLPAVKLSPGPVAFAGTNLRSRSASVSSVSSLKPSKFVVSPLRPLYLAPLDGPRAAGQKAQRQPLEFRCAASAADDKESKTEVVPVRSEAAQKLKISIYFATWWALNVIFNIYNKKVLNAFPYPWLTSTLSLACGSAMMLVSWATRLVEAPKTDLDFWKVLFPVAVAHTIGHVAATVSMSKVAVSFTHIIKSAEPAFSVLVSRFLLGETFPVPVYLSLLPIIGGCGLAAVTELNFNMVGFMGAMISNLAFVFRNIFSKRGMKGKSVSGMNYYACLSIMSLVILTPFAIAMEGPQMWAAGWQKALAEVGPDVVWWVAAQSVFYHLYNQVSYMSLDEISPLTFSIGNTMKRISVIVSSIIIFHTPVRPVNALGAAIAILGTFLYSQAKQ

SEQ ID NO: 12762 - protein, 178 aa, Arabidopsis thaliana
MFSDRSEDHRSGRSSAGIETGTKLYISNLDYGVMNEDIKELFAEVGELKRYTVHFDRSGRSKGTAEVVYSRRGDALAAVKKYNDVQLDGKPMKIEIVGTNLQTAAAPSGRPANGNSNGAPWRGGQGRGGQQRGGGRGGGGRGGGGRGRRPGKGPAEKISAEDLDADLDKYHSGDMETN

SEQ ID NO: 12763 - protein, 970 aa, Arabidopsis thaliana
MEATDPSAEIELYTIPAQSSWFLWDDIHEIERREFAEFFTESSITRTPKVYKEYRDFIINKFREDTCRRLTFTSVRKFLVGDVNLLQKVFLFLEKWGLINFSSSLKKNDHLLSVDNAKIEQGTPAGIRVTATPNSLRPITAPPLVEERVETGIKVPPLTSYSDVFSDLKKPDHVLVCAHCGERCDSPFYQHNKGIVNICEKCFKNGNYGENNTADDFKLIGNSAAAVWTEEEILLLLESVLKHGDDWELISQSVSTKSRLDCISKLIELPFGEFLMGSASGRLNPSILTEDENTEQVQTDGQEHEETETREEKEDRVNEDEPPAKRKRVALISEGDSSLMKQVAAMASKVGPSVATAAAKAALAALCDEASCPKEIFDTDDYSNFTVDRANGEKDTDMEEQQEEKDGPQGLPVALRIRASVATALGAAAAQAKILADQEEREMEQLAATVIEQQLKKLQSKLKFLDDLESIMDEEEKVIEGVKETIIQEREYVRNSRGVELFACRWIPSSSSSPKALVFLCHGYGMECSDSMKECGIRLASAGYAVFGMDYEGHGRSMGSRCYIKKFANVVNDCYDYYTSICAQEEYMDKGRFLYGESMGGAVTLLLHKKDPLFWNGAILVAPMCKISEKVKPHPIVINLLTRVEEIIPKWKIVPTKDVIDAAFKDLVKREEVRNNKLIYQDKPRLKTALEMLRTSMNLEDTLHEITMPFFVLHGEADTVTDPEVSKALYEKASTRDKTLKLYPGMWHALTSGEPDCNVDLVFADIINWLDLRTADPASLTVTPIRVGNTTSVQRVTTVNGVSNGHRRPKRPFFNLLCGLNRGRLVPRSTVAGPPSTFEYRVVVLLLPLRERSAENESEIYQVSKPMEEDTNGKTEEEEFNTGPLSVLMMSVKNNTQVLINCRNNRKLLGRVRAFDRHCNMVLENVREMWTEVPKTGKGKKKALPVNRDRFISKMFLRGDSVIIVLRNPK

SEQ ID NO: 12764 - protein, 344 aa, Prochlorococcus marinus str. MIT 9301
MNFLACDLGGTKVLLGIFKKEINNNPPKLIFKKKYISSDWGSFELILEDFIKKECKNITHPSSACFAVAGPLSKNNAKIVNLSWNISGNDLQNKFNLKNCELINDFAVQIYGIPFLKKNQYSTIQNGSNSEDTNNDLHVIVGAGTGLGIARGIISGEKVKVLASEGGHVEYSPKSKLEWDLKIWLKNYLKVERISCERIVSGTGLSRIAEWRLSKPDAQNHPLQKYLKKIKIFDAARKELPEKICNLSKEGDQLMIEVERIWLGAYASLLGDVALQELCFGGLWISGGTASKHFKNFKSDLFLKQFFDKGRLKDILKTIPIKVILDEEFGLFSAACRAKMLLKT

SEQ ID NO: 12765 - protein, 461 aa, Pseudomonas putida GB-1
MSGNNSNDLAQGLKQRHVTMLSIAGVIGAGLFVGSGHAIAAAGPAVLLAYAAAGTLVVLVMRMLGEMAVASPDTGSFSTYADRAIGRWAGFTIGWLYWWFWVLVIPLEANAAAAILHAWFPAVDLWAFSLIITLALTLTNLCSVKNYGEFEFWFALLKVLAIIGFIAVGCAALFGFVPNSQVSGASHLFDTQGFMPNGLGAVLAAMLTTMFSFMGTEIVTIAAAESKDPGKQISRATNSVIWRICLFYLVSIFLVVALVPWNDPALAETGSYQTVLSRIGVPNAKLIVDIVVLIAVTSCLNSALYTSSRMLFSLSKRGDAPAIAQRTTKAATPHVAVLLSTAAAFLCVFANFVAPAQVFEFLLASSGAIALLVYLVIAVSQLRMRAQREARGEKITFKMWLFPGLTWATIAFIVAILVVMALREDHRAEIIATALLSIGVVAAGLLVHRKREAAGRVALDN

SEQ ID NO: 12766 - protein, 480 aa, Solanum lycopersicum
MKEDIEHSENRVNEEITTPLIIQTNKRVKEENGCYEKKQDRCMVYLSTLVAVRGSYSLGSCAGYSSPTQSAIREDLNLSIAQISLFGSIWTFGAMIGAITSGPIADYIGRKGAMRMSSGFCVAGWLAIFFAQGALALDIGRLATGYGMGVFSYVVPVFIAEIAPKDLRGALTTINQLMICCGVSVSFIIGTMMTWRTLALTGLIPCAILLFGLFIIPESPRWLAKIGHQKEFELALRKLRGKDADISEEAAEIKDYIETLEKLPKVNLFDLFQRRYSSSLIVGVGLMVFQQFGGINGICFYTGSIFESSGFSSDIGTIIYAIIQVPITALGAALIDRTGRKPLLLVSGTGLVIGCILTGISFYMKGHEMAIKAAPILAVTGILVYIGSFSVGMGAVPWVVMSEIYPINIKGAAGSLATLVNWFGAWACSYTFNFLMTWNSFGTFVLYAAVNALSILFVIKIVPETKGRTLEQIQAAINAS

SEQ ID NO: 12767 - protein, 361 aa, Glycine max
MAPSFDFASSLLCTEDSTVFDESHNNGGTIMTAMGVYEDTRSPRRPHFDEEPDDLPLLSDESLVMMVEKECQHWSGLRYLNKFQTGDLDFGARMEAIDWIHKVRSHFGFGPLCGYLSINYLDRFLFAYELPKGRVWTMQLLAVACVSLAAKLDETEVPLSLDLQVGESKFLFEAKTIQRMELLVLSTLKWRMQAITPFTFLDYFLCKINDDQSPLRSSIMRSIQLISSTARGIDFLEFKPSEIAAAVKPSEIAAAVAMYVMGETQTVDTGKAISVLIQHVEKERLLKCVQMIQELSCNSGSAKDSSASVTCLPQSPIGVLDALCFNYKSDDTNASSCVNSSHNSPVAKRRKLNKTCGAEQL

SEQ ID NO: 12768 - protein, 430 aa, Shewanella oneidensis MR-1
MTRSEALFEQAKKTIPGGVNSPVRAFNGVGGSPLFIEKADGAYIYDADGKAYIDYVGSWGPMILGHNHPKIREAVLAAVHNGLSFGAPTELEVQMAEKVIAMVPSIEQVRMVSSGTEATMSAIRLARGFTNRDKILKFEGCYHGHADCLLVKAGSGALTLGQPSSPGIPEDFAKHTLTAVYNDLDSVRSLFEQYPTEISCIIIEPVAGNMNCIPPIPGFLEGLRSLCDEFGALLIIDEVMTGFRVSKSGAQGHYGVTPDLTTLGKVIGGGMPVGAFGGRKDVMQFIAPTGPVYQAGTLSGNPIAMSAGLAQMEALCEEGLYEALSAKTKRIAEGFKAAADKHGIPMAINYVGGMFGFFFTEQEHITRFDQVTKCNIEHFRTFYHGMLDEGVYLAPSAYEAGFLSMAHGEEELRLTLEAADRVLARMKAAN

SEQ ID NO: 12769 - protein, 429 aa, Oryza sativa
MKKLEKELKHQELLKNEQYQMKLQKCNERRLALIKSSLDIVVAIGLLQLAPKKVPRALLYPSPPSPSPLVVGNALASWDLAPPSLQPCAAAVPVVAVAREGRHRGRRRVSVLVRPFAVAEDRRSTVAAVNPKSVAASSSSSSPSVDLPPLFWSPATASHLDHGHVSVALYTCELPLPPSAETNTKGNGEAVRRSDERRRVGTPATAPAAATHTTDMEYYEQEEYATVTSAPPKRPAGRTKFRETRHPVYRGVRRRGPAGRWVCEVREPNKKSRIWLGTFATAEAAARAHDVAALALRGRGACLNFADSARLLRVDPATLATPDDIRRAAIELAESCPHDAAAAAASSSAAAVEASAAAAPAMMMQYQDDMAATPSSYDYAYYGNMDFDQPSYYYDGMGGGGEYQSWQMDGDDDGGAGGYGGGDVTLWSY

SEQ ID NO: 12770 - protein, 402 aa, Zea mays
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFNEALDTTKTVIWNGPMGVFEFQKFAAGTEAIAKKLAELTTTKGVTTIIGGGDSVAAVEKAGLADKMSHISTGGGASLELLEGKTLPGVLALDDA

SEQ ID NO: 12771 - protein, 187 aa, Triticum aestivum
MDPTDQSPEEVYSVWALPPEPVRDRLRGLMAGLRAAHGGPPFEPHATVVGAVRMRRPAAIQALRAAAAAADVAPYTARVTGVARGDFFYQCVYLLLEPTPEVIHTSDHFCAHFGFQRSTPYMPHVSLLYGDLTDEEKEAARKKVEEMDSEISGLQFEISELALYRTDTEDKSLESWELVEVCHLGKK

SEQ ID NO: 12772 - protein, 483 aa, Xylella fastidiosa 9a5c
MLKKHLFIVKPIEPTNHTGTGKGETQLKRSLTAGQLVMLGIGAVIGAGIFVLSGHAAAEYAGPAVVLSYILAGIACALAGLCYAEFAAMLPVSGSAYSYAYATLGEFTAWFIGWNLVLEYMFSASTVAVGWSGYLNSFLSSFGYGLPASLSSAPLDVVDGRLIYSGGLINLPAVAIVAAISGLCYVGITQSAFVNSITVAIKVSVIVLFIAFAARYVNPDNWVPFVPDNAAPGKYGMEGVIRGAAVVFFSYIGFDAVSTTAGEAKNPQRDMPIGILGSLAICTVIYIAFSGVLTGLMHYSQLDTPKPVATALETYPTLSWLKHVVEIGAIAGLSSTMLMMLMAQPRIFYAMSQDGLLPKLLSKVHPKFQTPHVGTLLVGACACTLAGLFPISLLGDLVSMGTLLAFATVCIGIVVLRRTRPDLPRPFRVPMYWVIAPAGAAACLYLFWQPFTEHWPLMVGWTVLGLVMYGLYGYHHSKLRRGG

SEQ ID NO: 12773 - protein, 419 aa, Bacteroides fragilis YCH46
MQTIDNFNFAGKKAFVRVDFNVPLDENFNITDDTRIRAALPTLKKILADGGSIIIGSHLGRPKGVADKFSLKHIVKHVSELLGVEVQFANDCMGEEAAVKAAALQPGEVLLLENLRFYAEEEGKPRGLAEDATDEEKAAAKKAVKESQKEFTKKLASYADCYVNDAFGTAHRAHASTALIAKYFDTNNKMFGYLMEKEVKAVDKILNDIKRPFTAIMGGSKVSSKIEIIENLLNKVDNLIITGGMTYTFTKAMGGQIGLSICEDDKLDLARELMQKAKDKGVNLVLAVDAKIADAFSNDANTKFCPVNEIPDGWEGLDIGPKSEEIFAEVIKNSKTILWNGPTGVFEFENFTHGSRSVGEAIVEATKNGAFSLVGGGDSVACVNKFGLADGVSYVSTGGGALLEAIEGKVLPGIAAIQE

SEQ ID NO: 12774 - protein, 477 aa, Xylella fastidiosa 9a5c
MFKQLWATKLSQPSQDSAEGLSLQRVLGVWGLTALGIGAVIGGGIFVITGQAAANHAGPAIMLSFALAAICCTFCALAYAEFAAMVPVSGSAYTYTYATFGELAAWFIGWMLVLEYGVSAAAVAVSWSGYFLSLLQHLGIDLPAALVNAPLDGTLHATGAIANLPAATIVLLLTWLCYFGIRKSSKINIAMVALKSGLILLIIGVGWKYVNPDYWQPFIPPNQGPGKYGWDGVLHGASMVFFAYIGFEAVSVAAQESHRPQRDLPISMMSALAICTVLYIMMAAVMTGLVPYTQLGTDEPVVTAVAAHPQLGWLRVVVEIGALVGLSSVVLVMLIGQPRIFMIMAGDGLLPPIFSTIHSKHRTPHINTVITGLGIALLAAVFPLDVLGELTSMGTLIAFAAVCAGVLILRCTRPDLPRPFRMPAAWLFCSAGVLSCITLLSAMTRHNWMLMSVWTVLGFALYFGYGYRHSKLHREST

SEQ ID NO: 12775 - protein, 643 aa, Haloarcula marismortui ATCC 43049
MLPNLDFATATVRPALGSENYSRKPRYMMWLSGSATVSRTHPIPVVSASLTLLRRCREMLVEMSSQDEQSATEETQEPIPTDYDIAQSTDMEPIWELVEPWGLGLDDLQYFGEYTAKVKQHAIERLREQAENREQNLVLVTGMTPTPKGEGKTVTTVGLGQTLNHVGEEAMIAIREPSLGPVFGVKGGAAGGGRSQVLPMEDINLHFTGDLHALTSAHNLIAAMLDAKISQGDDLNIDINNVSWPRAIDMNDRALRETVVGLGGKTGGTPREDSFILTAASELMAVLCLASDIGDLKERVSRIIVAYDEDGDPVTVEDIEATGPATMLLRDAIKPNVVQTIEGTPALVHGGPFANIAHGTNSLVADKTAFGMGDYLVTEAGFGSDLGAEKFMDVVCRKGDMTPNAVVLVASVRALKYHGLNQWPVDYDEIGEAGVEAVEAGFSNLDKHARNLQKFGVPVVVSVNRFPDDTDEEVQAVLDHCREDLGVRAAESNVFSDGSEGGVDLAENVIEATEESNEEDFRMLYDDDDSIKEKIHTVATEIYGADDVKYTGGALDDIEQMNDLDFDDYPVVMSKTFHSLSDDASQKGAPEGWELEISEVYPSAGAGFLVALTADALTMPGLPARPAAADMDIDGDGNISGLF

SEQ ID NO: 12776 - protein, 448 aa, Bacillus licheniformis ATCC 14580
MPVQTSSKNQVFLEQQNRRESNARSYPRRFPLAMQTAEGVLVTDADGKQYYDCLAGAGTLALGHNHPVVIEAIQKMIEEKRPLHTLDITSEIKEEFVNEVFASLPEAFAKRAKIQFCGPTGGDAIEAALKLVKTATGKRTILSFHGAYHGATHGTMALSGNLSPKENVQGLMPDVHFLPYPYEYRCPFGKGGEASHKLSSAYIENMLDDPESGVLQPAGMIFEAVQGEGGSVPARAEWIREMRRITKERGIPLIIDEVQTGIGRTGKMFAFEHAGIIPDVIVLSKAIGGSLPLSVVIYDQDLDQWGPGAHIGTFRGNQMAMAAGSATLKYIKEHDVLSHVEKVGAKLMRELQDIQEHVPEIGDVRGRGLMIGAEIVAPHKKQNANGSYPADAELASTIQRKCFEKGLIVETGGRHGSVIRFLPPLIVTEAQIDDIITIFREAVYEAVK

SEQ ID NO: 12777 - protein, 469 aa, Shewanella sp. ANA-3
MSVESVLKQLEELEVKFVDLRFTDTKGKEQHVSIPAHQVDADFFEDGKMFDGSSIAGWKGINESDMVLMPDPTTFVLDPFTEETTALIRCDILEPGTMTGYDRDPRSIAKKAEEYLRSTGIADTVLVGPEPEFFLFDDVRFGTDMSGCFVKIDAKEAAWNSGTSYEGGNTGHRPFVKGGYFPVAPVDSSQDLRSAMCLVLEEMGQVVEAHHHEVATAGQNEIATRFNTLTKKADEIQILKYVVHNMAHAYGKTATFMPKPIVGDNGSGMHVHQSLSKDGVNLFAGDKYAGLSETALYYIGGIIKHARALNAFTNPSTNSYKRLVPHFEAPVMLAYSARNRSASIRIPVVPSPKGRRIETRFPDPHANPYLGFAALLMAGIDGIQNKIHPGEAMDKDLYDLPAEEAAEIPQVATSLENALENLQADHEFLTRGGVFSEDFIQSYIALKSAEAERVSRTTHPLEFEMYYSL

SEQ ID NO: 12778 - protein, 484 aa, Streptomyces peucetius ATCC 27952
MSPSTRSETADPQPPGERGTMSPTLSGHLRRPPGPAGYPVVGCGPDLVRDLVGTFTRAWREYGDIVSFRLPGKRNLFLIVHPDHIKHVLDDRQPNYPKDPLSVGKFEPWVGQGLFTSNGDFHFRQRRLAQPAFKGSRISGFGPAMVEATSDLVRDWHGRATREETFDITPEMFRLALTIVMQTLFSTDVSNRAGELARAVRICNAYTNVRLQRFVELPQALPSKARSRFLRARATLDSFVYGLIAERRRDPAPPDDLLTRFLNAQDEQTGERMSDKQLRDEVVTMFLGGYETTALSLVWAFSLLSRHPEAERKVRSEVAEVCGDREPAASDLPRLRYLRAFYQEVLRLYPSVWTLSRSPLEDDEIGGYHIPAGSQVFISPYLMHRHPGFWENPEGFRPERFEKSATGGAPLYAYIPFSRGPRLCPGSSVAVLEAPLVIARMLQDYRLTLAGGHVCEPTSNVFLYPRAGMPMRLQHFKSTGEGAA

SEQ ID NO: 12779 - protein, 345 aa, Arabidopsis thaliana
MTATNKQVVLKNYVSGFPKESDFDFKTTTVEFKLPGGSNSVLVKNLYLSCDPYMRIRMGKPDPSTAALAQAYAPGKPIFGYGVSRVIESGHPDYKKGDLLWGIVGWEEYSVITPMTHMHFKIQHTDIPLSYYTGLLGMPGMTAYAGFYEVCSPKEGETVYVSAASGAVGQLVGQFAKMMGCYVVGSAGSTEKVDLLKTKFGFDDAFNYKEEPDLSAALKRCFPTGIDIYFENVGGKMLDAVLLNMNPHGRIAVCGMISQYNLENQEGVHNLSNIIYKRIRIQGFAVFDFYEKYSKFLDFVLPHIKEGKITYVEDVADGLEKGPEALVGLFHGKNVGKQVVVIARE

SEQ ID NO: 12780 - protein, 439 aa, Glycine max
MGEENEETKTFKDLGLSESLVEACEKLGWKNPLKIQTEAIPLALEGKDVIGLAQTGSGKTGAFALPILHALLEAPRPKDFFACVLSPTRELAIQIAEQFEALGSEIGVKCAVLVGGIDMVQQSIKIAKQPRIIVGTPGRVIDHLKHTKGFSLSRLKYLVLDEADRLLNEDFEESLNEILQMIPRERRTFLFSATMTKKVQKLQRVCLRNPVKIEASSKYSTVDTLKQQYRFLPAKHKDCYLVYILTEMAGSTSMVFTRTCDATRLLALILRNLGLKAIPINGHMSQSKRLGALNKFKSGECNILLCTDVASRGLDIPTVDMVINYDIPTNSKDYIHRVGRTARAGRSGVAISLVNQYELEWYIQIEKLIGKKLPEYPAQEEEVLLLEERVGEAKRLAVMKMKETGGKKKRRGEEDYDGEDIDKYLGLKEGKSSKKFRRR

SEQ ID NO: 12781 - protein, 448 aa, Enterococcus faecalis V583
MDAKQYVKNIQEKIHQLDQGQTEYLQAVDEFLPTVEGFLEKNPQYIEANVLGVLIEPERIFQFRVPWQDDQGNWHVNRGYRVQYNSAIGPYKGGLRFHPSVNLSVMKFLAFEQIFKNSLTGLPIGGGKGGSDFDPKGKSDAEVMRFCQSFMTELQKHIGPSTDVPAGDIGVGAREIGYLFGMYKRLRNYDAGVLTGKPLGYWGSQARTEATGYGTVYFVKHLLADKNDTFEGKKVAVSGSGNVAIYAMEKATELGATVITCSDSSGFVYDPEGIDVALVKELKEKNRERISKYVETRKGATYYDKESVWNFETAYDIALPCATQNEINEKQAAILVKNGVKVVAEGANMPCTLEAVAVFAKSAVIYCPGKAANAGGVAVSALEMSQNAERLAWSFEKVDGMLDQIMQNIYETCRDTANEYQARDNFVLGANIAGFEKVAAAMLSQGLV

SEQ ID NO: 12782 - protein, 422 aa, Streptomyces coelicolor A3(2)
MTSQPTLTKPEEGPAGPSGPDTGLQAGLKNRHLSMIAIGGVIGAGLFVGSSSGIATAGPGILLSYALVGTLVVLVMRMLGEMSAANPTSGSFSAHADRALGPWAGFSIGWLYWFFWVVVLAVEATAGAKILEGWIPAVPQWGWALIVMVVLTATNLASVGSYGEFEFWFAGIKVVAIAAFIVVGGLAVFGVLPGVDSDRAGLGNLTEHGGFLPHGAGAVLTGVLLVVFSFMGSEIPTLAAGESEDPQRAVTKATNSIIWRIAVFYLGSIFVVVALLPWDSQSIVDQGSYVAALDSLGIPNAGEIMNFIVLTSVLSCLNSGLYTASRMAFSLGRRGDAPKAFARTTRRGVPQAAILSSVVFGFVAVFFNYKFPDTVFLFLLNSSGAVASSSGWPSASRSCGCGRSSRPRRRRSWSCGCGCTRI

SEQ ID NO: 12783 - protein, 461 aa, Streptomyces coelicolor A3(2)
MSNSTTAKAPRQPADASLSHGLKQRHLSMIALGGVIGAGLFVGSGAGIAAAGPSIVVAYTVSGLLVMLVMRMLGEMSAAYPSSGSFSAHAERAIGPWAGFTAGWAFWVLLCTAVGLEGIGAAQIVHGWLPGTPEWAWVALFMVVFCGTNLAAVKNFGEFEFWFAALKVGAISLFLVLGVLAICGVLPGTDSPGTSHLGDFLPHGGNGLIIGLLASVFAYGGLETVTIAAAESENPVRGVASAVRTAMWRIALFYIGSMAVIVTLVPWDSPEVVEKGPYVAALDELGIPGAGQLMNIVVLVALLSAMNANIYGASRIGYSLVERGQGPKVLGRVSGGVPRVAVLVSSLFGFGCVLLSYWRPDDVFSWLLNMIGAVILVVWIFIAAAQLRLRRRLEREAPEKLVVRMWAFPWLTWVALAGMAAVFVLMAREPDTRVQLYSTGGMTLVLAAVGYARQRRGAARD

SEQ ID NO: 12784 - protein, 135 aa, Zea mays
  misc_feature (87)..(87): Xaa can be any naturally occurring amino acid
RRRGGQGGGGSKNGVLHCLCFLASIPPLSASCSSGSSCFLMIKRVSSAPSLSRWTIQYKQLGHTIYRRSHVLAFASADAPQGKRSSXRRRQAEAINGALAVIGLTAGLLVEAQTGKDILGQLAGYLTAISSLFGQ

SEQ ID NO: 12785 - protein, 831 aa, Streptomyces coelicolor A3(2)
MKAVVMAGGEGTRLRPMTSSMPKPLLPVVNRPIMEHVLRLLKRHGLNETVVTVQFLASLVKNYFGDGEELGMELTYANEEKPLGTAGSVKNAEEALKDDAFLVISGDALTDFDLTDLINFHKEKGSLVTVCLTRVPNPLEFGITIVDEEGKVERFLEKPTWGQVFSDTVNTGIYVMEPEVFNYVDPDVPVDWSGDVFPQLMKEGKPIYGYVAEGYWEDVGTHESYVKAQADVLERKVDVDIDGFEISPGVWVAEGAEVHPDAVLRGPLYVGDYAKVEAGAEIREHTVIGSNVVVKSGAFLHKAVVADNVYVGPHSNLRGCVVGKNTDIMRAARIEDGAVIGDECLVGEESIIQGNVRVYPFKTIEAGAFVNTSVIWESRGQAHLFGARGVSGILNVEITPELAVRLAGAYATTLKKGSTVTTARDHSRGARALKRAVISALQASAIDVRDLENVPLPVARQQTARGSAGGIMIRTTLGVPDSVDIMFFDGQGADLSQGSQRKLDRVFARQEYRRAFPGEIGDLHFPSSVFDSYTGSLLRNVDITGIAESGLKVVVDASNGSAGLVLPSLLGKLGVDSLTINPGLDEARPTESADMRRSGLVRLGEIVASSRAAFGVRFDPVGERLSLVDEKGRIIEDDRALLVMLDLIAAERRSGRVALPVTTTRIAEQVAAYHGTQVEWTTTSPDDLTRVGGEEGAIFGGDGKGGFIVPEFSSVYDGTAAFVRLIGLVARTQLTLSQIDARIPRAHVLKRDLATPWAVKGLVMRRVVEAAGDRFVDTTDGVRVVETDGRWVMVLPDPAEAVTHLWAEGPDDASAQALLDEWAAVVDSAGR

SEQ ID NO: 12786 - protein, 317 aa, Salmonella enterica subsp. enterica serovar Typhi str. CT18
MTDKLTSLRQFTTVVADTGDIAAMKLYQPQDATTNPSLILNAAQIPEYRKLIDDAVAWAKQQSSDRAQQVVDATDKLAVNIGLEILKLVPGRISTEVDARLSYDTEASIAKAKRIIKLYNDAGISNDRILIKLASTWQGIRAAEQLEKEGINCNLTLLFSFAQARACAEAGVYLISPFVGRILDWYKANTDKKDYAPAEDPGVVSVTEIYEYYKQHGYETVVMGASFRNVGEILELAGCDRLTIAPALLKELAESEGAIERKLSFSGEVKARPERITEAEFLWQHHQDPMAVDKLADGIRKFAVDQEKLEKMIGDLL

SEQ ID NO: 12787 - protein, 269 aa, Zea mays
  misc_feature (124)..(124): Xaa can be any naturally occurring amino acid
  misc_feature (191)..(191): Xaa can be any naturally occurring amino acid
MSPVGVSALSSPAKFHRRREKAQTFTPTHFPNPNGFPSPWIKSRPFAPKLSQSLNFASPSPHLPLIRSSTSPSSKDFLQILARKAAIFLVGSFVFLGFCSSKPALALPTATASSQSELEDEAMXQKVLESEPENMEAMKAVLYKKMRRGKPEDAVKYVEKLMKLEPREVEWKLLEALCYETMGQLSKAKRXFKDFSEITSSDKSLHGLAMVMHKSHDSSVFDMLNEAMEVARQGNRVTEGRNIQVLIGQMHIVKGQLGEALLFPWDGEG

SEQ ID NO: 12788 - protein, 556 aa, Streptomyces coelicolor A3(2)
METTLRGVGVSHGVAIGEVRHMGTAVLEPPAKQIPAEDAEREQGRARKAVEAVAADLMARGNLAGGEAQAVLEAQAMMAQDPELLADVERRITVGSTAERAVYDAFAAYRALLAGAGEYLAGRVADLDDVRNRIVARLLGVPMPGVPDSDEPYVLIARDLAPADTALLDPTLVLGFVTEEGGPTSHSAILARALGVPAVVALPGAGEIPEGTVVAVDGSTGEIFVNPAEEKKARLAAEAAERKAALAAATGPGATSDGHKVPLLANIGGPADVPAAVEAGAEGVGLFRTEFLFLDDSANAPSEEKQITAYRQVLEAFPEGRVVVRVLDAGADKPLDFLTPGDEPNPALGVRGLRTLLDHPDVLRTQLTALAKAAEGLPVYLEVMAPMVADRADAKAFADACREAGLRAKFGAMVEIPSAALRARSVLQEVEFLSLGTNDLAQYTFAADRQVGAVSRLQDPWQPALLDLVALSAEAAKAEGKSCGVCGEAAADPLLACVLTGLGVTSLSMGAASLPYVRATLAKFTLAQCERAAAAARAADSAEEARTAAQAVLSGE

SEQ ID NO: 12789 - protein, 395 aa, Helicobacter hepaticus ATCC 51449
MKKTTYAKRVELLGESTTIAISTLARELKAAGQDILSFSAGEPDFDTPEIIKDEAIRALKSGFTKYTAVAGIPELLEAIKDKLLRENTLAYERNEILVSNGAKHSLFNVFQALVDKDDEVIIPSPYWVTYPELVTFSGGKSVIVQTTQANNFKITPKQLREAITPKTKVFVLNTPSNPTGMVYTKEELESLAEVLKDTNIWVVSDEMYEKLVYGVKFFSVAAVNEDMMQRTITINGLSKSVAMTGWRIGYLACKDKKLVKLMNNLQSQCTSNINSITQKAAIVALKGEANNDIEDMRKAFEERMRFACDAINNIQNLNVCEPQGAFYLFINISTLPRYGTDSMGFCQALLKEQGVALVPGVAFGMEGFVRLSFACSLEQLKEGITRISQFVKTLF

SEQ ID NO: 12790 - protein, 560 aa, Haloarcula marismortui ATCC 43049
MAERTLHGTGATPRSGVGTVVWYGRDISLPDPDDVEVNPETERRRFADAVDTARAELESEREATAERVGEDEAAVFDAHIQFLEDPTIEDTVETMIADGGLAPNAVDAAFGEHIEQFEGMDGRMAERADDLRDVRDRLLRLLTDGERVGLGDLPADSVVLAERLTPSDTAQLDPERVAGFATVTGGRTSHAAIFARSLALPAVVGIGTDLDTLEDGAEVVVDGDNGTLLVSPDDSERAAAANESGAAVVNDSVKTTDGRHVEVAANIGQPAELEPAAKRGADGVGLYRTEFLFLDRETPPSEDEQYEAIRQALDTFPDGRVVVRTLDIGGDKRIPYLDLPDEENPFLGERGIRRSLAPDSDLFATQLRALLRAAADGAGDLAIMFPLVATIEELDAALDALEAAAGLDDYDADAVDPEVGVMIETPSAVFMADELAARVDFLSIGTNDLTQYVMAADRENERVGDLHDPTHPGVLRAIQQTVTAAHAEDIWVGMCGEMAGDPDLTELLVGLGLDELSMSAVTIPEVKTAVSETSYSSASERGDRAQLAATRSEVHTTLDT

SEQ ID NO: 12791 - protein, 822 aa, Yarrowia lipolytica CLIB122
MEVDGAEPARRRSTRATRGRHSKYEEAVEEPGKVKSDKKDPKTSDKNPKTTKLKTPTKAKTTTRSKARKKSKNDEEGVVRCPCGATEDDPSDGKIMIECEDCLEWQHSQCVLQTNDLEQVPDHYVCNECTEKKTQEKETTEAQEESEDKGKGEEEKDSNDKDEKYDSTYVPNNETAEKEPVARVSKSTHKRVGHIDDITEKVRKSAASALKGIFVSVPTSKYSPGAGVSPEQFCETLALTIEQELYDAYGTVEPEIGSNYRDKFRTLSFNLRDSKNETLRIRVMTGQVTPQTLVAMSSEEMMNPELQKLAEEVRAEAIRDTVLVVDEAPRLRRTHKGEEIVGEYEEYIDNVDQALKMERQRDGDGKEAAESRNQIERAVRDIEGANGEADSKTSNSPKESSNSPIVPKWKRDIDLAQGESDHEHDHDHNSDHEDKVNGILGDVSREAREAETDDWTTISEAPFVWTGTVPMAGLDKTSCAAFSLGSSSVHFNPNVSWGSVFYASKPLTIEGRLDKSKADPYLSKVLGAGTRDVAAFCLLPSDSSESDREAYYKLYEYFHSRSKYGVIHNRSTLVKDAYLIPLAPDDAPPYTLGSLVKPSVELSSLKRSRPLLVALYIVGKLSPKRGAAVSVESHVASSEKHPPKRQSMRDRVKQNAGNAGNASRRASDARKSTPPVTATPVTPAAPTLVAPVNAPVGPAPVVPPYAGFQGGVYGAPVGIQRVPGAPMGVPGVPIAPAGMPGVPVAPLGMHGAPAHHMAQSGTPIAPAAHPRKPTGAPPPDLDALKTLLNDPNLRNAPAAPAQNDLLQNPALLMSIIDQAKKR

SEQ ID NO: 12792 - protein, 379 aa, Salmonella enterica subsp. enterica serovar Typhi str. CT18
MAKRDYYEILGVSKTAEEREIKKAYKRLAMKYHPDRNQGDKEAEAKFKEIKEAYEVLTDAQKRAAYDQYGHAAFEQGGMGGGFGGGFNGGADFSDIFGDVFGDIFGGGRGRQRAARGADLRYNMDLTLEEAVRGVTKEIRIPTLEECDVCHGSGAKAGTQPQTCPTCHGSGQVQMRQGFFAVQQTCPHCQGRGTLIKDPCHKCHGHGRVEKSKTLSVKIPAGVDTGDRIRLAGEGEAGEHGAPAGDLYVQVQVKQHPIFEREGNNLYCEVPINFAMAALGGEIEVPTLDGRVMLKVPSETQTGKLFRMRGKGVKSVRGGAQGDLLCRVVVETPVGLSEKQKQLLKDLQESFGGPTGEKNSPRSKSFFDGVKKFFDDLTR

SEQ ID NO: 12793 - protein, 477 aa, Streptomyces peucetius ATCC 27952
MCPPSSPTTYPSSPCDPPPLRKGLVRMTTTLVPPGPRGHPVLGSIREIQRDNVSAFMEAFRHHGDIVNFRGPLRINLLAHPDYVQHVLRDQHKRYPRPRKVQGCLSTIVGDGLVAAEGTSWLRSRRLTQPAFHRDILRRFGDSFTASTAELLDGWERRARDGEPLDIKSEMMHLSLANLARALFRTEWTDEVSRIEPAVQEALGFTHRRMTSPVDPLKFPSAARTRFRGALETINSLLYPMVAERRRDGGGDDLVSLLIDAVDPESGGMFTDEQIRDEVSGFFVAGHETVSTALSWTWYLLSLNPESRRRLQAEVDEVLAGRVPTVDDLPKLTYTTMVLQESMRLYPPIFVYMRCAAEDDVIGGYHIPEGRWVVVCPYVTHRHPEFWDNPEGFEPERFTPENSANRHRMAYLPFGAGPRKCIGDSFAMLQMPLVVAMIAQRFRLDLVEGQQVFPEPAISLRPRDPLMMWLRPNEETP

SEQ ID NO: 12794 - protein, 258 aa, Arabidopsis thaliana
MGRGKVELKRIENKINRQVTFAKRRNGLLKKAYELSVLCDAEIALLIFSNRGKLYEFCSSPSGMARTVDKYRKHSYATMDPNQSAKDLQDKYQDYLKLKSRVEILQHSQRHLLGEELSEMDVNELEHLERQVDASLRQIRSTKARSMLDQLSDLKTKEEMLLETNRDLRRKLEDSDAALTQSFWGSSAAEQQQQHQQQQQGMSSYQSNPPIQEAGFFKPLQGNVALQMSSHYNHNPANATNSATTSQNVNGFFPGWMV

SEQ ID NO: 12795 - protein, 425 aa, Ralstonia metallidurans CH34
MSKVAEIRGLEVLDSRGNPTVEVEVVLDDGAVGRAIVPSGASTGAREAVELRDADPRRYLGRGVLRAVQAVNTELCEALLGRDAGDQPEIDTIMIDLDGTPDKRRLGANALLGVSLAVAHAAAMSNGLPLFAYLGGERASLLPVPLINVINGGAHADNALDFQEFMIVPAGAPTFTEAVRASAEVFHTLRAMLKAAGYTTNVGDEGGFAPEFHAAEEALDILVAAIAKAGYRPGEDIALAIDPAASELYVNGSYVYQGEGVERSREEQVAYLVRLADRYPIVSIEDGMAEDDAMGWQLLTRQLGKRCQLVGDDVFCTHPTLLRQGVEQGMANAILVKANQIGTLSEMRETVRVAHGYAYSAVMSHRSGETEDVTIADLAVALRCGQIKTGSMSRADRTAKYNRLLRIERELGSRAEYAGALLRRR

SEQ ID NO: 12796 - protein, 756 aa, Aspergillus nidulans FGSC A4
MVQSSHDRDDDVPVQFNPTEFGMTEEDLEAAKHRIDEVSDSQVREVVQNVLQFHRNDFNFPSAILHRFSEFSRTPEVSQSDRPETVLLRAQVRLLVALILTNSPYPEVRAIVGNKDDPQTPCSTIRSWAIGLLFVVGGSAVNQLFSIRQPPIGIAPMAIQLLSYPLGKAAEQLLPDVGFSFCGVRHSLNPGPFSPKEHLLITIMANVLPQYYGQSYASAFSYQVLLSLSSDLMGYGLAGLVRKFLVYPSFCLFPQCLTTLALTKALHGAFGPFRRTYNMSRSRFFMYAFVGMFCYAWFPGYLFERLSIFNWLSWISPSNVNLAAITGIQTGLGLNPFPTFDWNMVTAALDPLVVPLLATLNVFAGAIVSGVLIAIFWFTNIYWASYLPINTNRLFNRWGTAYNVSEILDSHALLDQARYEQYSTAFLAPSSLVRYAFFFATYSATISYSIFYHGQAIMAGFRNLVRKTGGVTASATDIHSRLMRTYKEGDHAISKQLADTQVANRLLHPVSEIWYAALNVLALTLAVVIITAWPTSTNVGVIFVAFCVSAAFLVPVGQIYALTGIAINLKGPMDARKSPFSQLFQAIRSTDVTAPFLTTRYTTLANALPFISDLKLAHYAKLPPWHTFSAQVIATVVSAVHWPSQDVWPWRSLLGFTRCVPDRSHPASDTLLRTTTIILLAAHKSSDAAARGNHLVAAFSSAIAIASLLIYFSLQSNNIELPWWGNYADSGCEEHACTRLSLTGEEYFGPREGEWA

SEQ ID NO: 12797 - protein, 540 aa, Yarrowia lipolytica CLIB122
MSLDKNRQITTSESSSGSSADEGTHIMRGLTSTSTQDETTGSISEGNLEAEKISPFVFVLVALASISGFLFGYDTGYVSGALVVIKEDLGRALSNGDKELITASTSLGALLGGVIAGAMCDFFGRKWVITFANILFLVGAAIQCGAHAVWTMIGGRFVMGWGVGIASLCAPLYISELAPTRIRGRLVVLNVLAITGGQLVAYGIGAGMAHVHQGWRILVGLSMVPAFVQMVIFVFMPETPRYLVRKNKIAEAKKVLAKTYATDDDNLLDRKLHELMLHNAYKESGLSTMARARNTMKELYCVPSNLRALIIACGLQGIQQFCGFNSLMYFSATIFEVVGFDNATAVSIIVAGTNFVFTIVAFMVIDRIGRRRILLGTIWGMSLGLVVNAIAFHFLDKQKEKNPNHELDKEHISGWAYVVLVAQLVYVAFYATGIGNVPWQQSELFPISVRGVGTGMATATNWAGSLIVSSTFLTMLENITPTGTFSFYAGLCALGEVFVFFLYPETSGMDLEQIQQLLTGGFNIKESMRLSDEAKRGYKK

SEQ ID NO: 12798 - protein, 419 aa, Arabidopsis thaliana
MGSLRRSTSNRSRKKGTAVKMNRMPSSLSPPTPPCSAIVGGTGKSKKRRGGVCLWTRFDRTGFMEVAGCDKSTIIERSSVSAKDLRTAFSHSSKILDNNKSMSCYDAAREKAIVLNLEVIKAVITSEQVMLLDSLRPEVLTLTDRLKHHFPRKDGPENILQASSHGHQEGGEEGLKSKLPFEFRVLEIAFEVFCSFVDSNVVDLETQAWSILDELTKKVSNENLKDLRSLKTSLTHLLARVQKVRDEIEHFLDDKEDMEDLYLTRKWIQNQQTEAASNSIVSQPNLQRHTSNRISTSMVTEEDDIDDMEMLLEAYFMQLEGMRNKILLMKEHIDSTEAYVKILQNSRRNGLIHLMMLVNIGNYAITAGTVVVNLFGMNIPIGLYSTPDIFGYVVWAVVALCIVLFIVTVGYAKWKKLLD

SEQ ID NO: 12799 - protein, 118 aa, Campylobacter upsaliensis RM3195
MKNKYIEQFEAKQIEGKNVPDFRAGDTLKLAIRIKEGDKTRIQNFEGVCIARRGSGVSETFMVRKIGANNVGVERIFPIYSESLENISVLRRGRVRRARLFYLRDRRGKAARIKELKK

SEQ ID NO: 12800 - protein, 556 aa, Pyrococcus furiosus DSM 3638
MPKFDVAKSDLERLVGREFSVEEWEDLVLYAKCELDDVWEEDGKIYFKLDSKDTNRPDLWSAEGVARQIRWALGLAKGLPKYEVEESDVVVYVDKKLRNIRPYGVYAVVEGLKLDEEALSQLIQLQEKVALTYGRRRREVAIGIFDFDKVKPPIYYRAAEKTEKFVPLGYSEEMTLEEILEKHEKGREYGHLIRDKPYYPLLVDSEGNVLSMPPIINSELTGRVTTETKNVFVDVTGWDLRKVMLALNVIVTALAERGGKIKRVKVIYPDFEITTPDLTPKEFEVSFEYIRKLSGLELSNEEIKELLERMMYEVEILSENKAKVKYPAFRDDIMHTRDVLEDVLIAYGYNNIDPEEPKLAVQGRGDPFKDFEDAIRDLMVGFGLQEVMTFNLTSKEVQFDKMNIPEEEIVEIANPISSRWSALRKWLLPSLMEFLSNNTHEEYPQRIFEVGLATLIDESRETKTVSEPKLAVALAGSGYTFTNAKEILDSLMRHLGIEYDIEETVHGSFIPGRVGKILVDGKEIGIIGEIHPQVLENWNIQVPVVAFEIFLKPLYR

SEQ ID NO: 12801 - protein, 348 aa, Pyrococcus furiosus DSM 3638
MSEKMVAIMKTKPEYGAELVEVDVPKPGPGEVLIKILATSICGTDLHIYEWNEWAQTRIRPPQIMGHEVAGEVVEVGPGVEGIEVGDYVSVETHIVCGKCYACKRGQYHVCQNTKIFGVDTDGVFAEYAVVPAQNVWKNPKNIPPEYATLQEPLGNAVDTVLAGPIAGKSVLITGAGPLGLLGIAVAKASGAYPVIVSEPSEFRRNLAKKVGADYVINPFEEDVVKEVMDITDGNGVDVFLEFSGAPKALEQGLQAVTPAGRVSLLGLFPGKVSIDFNNLIIFKALTVYGITGRHLWETWYTVSRLLQSGKLNIDPIITHKYKGFDKYEEAFELMRAGKTGKVVFMLK

SEQ ID NO: 12802 - protein, 203 aa, Chlamydomonas reinhardtii
MNPEYDYLFKLLLIGDSGVGKSCLLLRFADDTYTESYISTIGVDFKIRTVELDGKVIKLQIWDTAGQERFRTITSSYYRGAHGIIVVYDVTDQESFNNVKQWLNEIDRYASENVNKLLVGNKSDLTSKKVVEYSVAKAFADEIGIPFLETSAKNATNVEQAFMTMAAEIKNRMASQPIPTKAGGPVVRPQEGKPINSKSSSCC

SEQ ID NO: 12803 - protein, 126 aa, Glycine max
MNARRDGRNNRVALFDGIEEGGIRASSLYSSSSSHEIDEHDNEQALDGLQDRVNLLKRLSGDINEEVDSHNRMLDRMGNDMDSSRGVLSGTMDKFKMVFETKSSRRMFSLVASFVVLFLIIYYLTR

SEQ ID NO: 12804 - protein, 213 aa, Chlamydomonas reinhardtii
MSYAYLFKYIIIGDTGVGKSCLLLQFTDKRFQPVHDLTIGVEFGARMINIDGKQIKLQIWDTAGQESFRSITRSYYRGAAGALLVYDITRRETFNHLASWLEDARQHANPNMTIMLIGNKCDLTHRRAVTTEEGEQFAKEHGLIFLETSARTAHNVEEAFINTAKEIYKKIQDGVFDVSNESYGIKVGYGGGNAGPQTVKPGEGGAAKSSSCC

SEQ ID NO: 12805 - protein, 233 aa, Solanum torvum
SFVSRGNNDSWDVEDENDEEFLLKEDSRSGPATTLGCAIPPPPARQIVPVAPPQPVMSMAEKPAPLVTPAASEEDEEIIKSVVQGKMPSYSLESKLGDCKRAASIRREALQRITGKSLEGLPLEGFNYESILGQCCEMPIGYVQIPVGIVGPLLLNGREFTVPMATTEGCLVASTNRGCKAIYASGGATSILLRDGMTRAPCVRFGTAKRAAELKLFVEDPTKFETLANVFNQ

SEQ ID NO: 12806 - protein, 201 aa, Phytophthora infestans
MNPEYDYLFKLLLIGDSGVGKSCLLLRFADDTYTESYISTIGVDFKIRTIELDGKTIKLQIWDTAGQERFRTITSSYYRGAHGIIVVYDVTDQESFNNVKQWLHEIDRYACENVNKLLVGNKSDLTAKRVVSTDAAKEFAESLGIEFLETSAKNAANVEKAFMMMAAQIKKRMANAPVAPKAGVKLTPGQQVPSNGGSKCC

SEQ ID NO: 12807 - protein, 323 aa, Prochlorococcus marinus str. MIT 9301
MNTVTELLQPVENDLDDLILELKNLIGAGHPILQAAAEHLFSAGGKRLRPGIVLLISKAISPEFCLTTKHKRLAEITEMIHTASLVHDDVVDEASTRRGVDTVHSRFNTRVAVLAGDFLFAQASWHLANLDNVNVVKLLSRVIMDLAEGEIKQNLNRFDSAQSFPKYINKSYCKTASLIANSCKAAGVLSGINDENLTSLYDFGKNIGLAFQVVDDILDFTGNDKQLGKPAVSDLASGYLTAPVLYALEENKQLSVLINRELAEKDDLDNALNIIMNSKAIESSRKLAEDFAMLSKEAIVWLPDSEYKRALMALPEFVLSRIY

SEQ ID NO: 12808 - protein, 240 aa, Prochlorococcus marinus str. MIT 9301
MTFTKYQFNNFCYWPSNPKKIVEFIGGSYLASKPDLTYKRFIDSLINKNYAVHAYKYTPQFDHQQLAIKAWRDFKNCRISLSKRIGTSIPSIRIGHSLGCKLHLISPDGGRNCEKFISISFNNFSANKSIPLLKQISRKLEFNSEFSPSPERTLRLIEKTYNQKNNFLIKFNSDELDQTDKLFSCLKARKEDNSKGVMLKGTHTIIASAGLRENFLGDWADDEFKRNTIKKISNLIDESD

SEQ ID NO: 12809 - protein, 455 aa, Oryza sativa (japonica cultivar-group)
MEVFYYLVFGGLAAVVAGLELGKSGKDRVATTPAFNAFKNNYILVYSLMMSGDWLQGPYVYYLYSQYGFDKGDIGRLFIAGFGSSMLFGTIVGSLADKQGRKRACITYCISYILSCITKHSPEYKILMIGRVLGGIATSLLFSAFESWLVAEHNKRGFDPQWLSITFSKAIFLGNGLVAIIAGLFANLLADNLGFGPVAPFDAAACFLAIGMAIILSSWSENYGDTSDNKDLIAQFKVAAKAIASDEKIALLGAIQSLFEGSMYTFVFLWTPALSPNDEEIPHGFIFATFMLSSMLGSSIASRLLARKLKVEGYMQIVFSISAFTLFLPVVTNFLVPPSSVKGGGISFGGCLQLLGFCIFESCVGIFWPSIMKMRSQYIPEEARSTIMNFFRIPLNLFVCVVLYNVNAFPITVMFGMCAIFLFMAAILQRRLMVVSDLHRSTTVEMTGEDEPLNP

SEQ ID NO: 12810 - protein, 464 aa, Oryza sativa (japonica cultivar-group)
MAASPAAGAAAATVSSFVSPSSFSSVKASKPDRLRPARRAAAVNVRCVSSPPATETSFKTKVPRNANMAKLQAGYLFPEIARRRAAHLLKFPDAKIISLGIGDTTEPIPDVITNAMAKRAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 12811 - protein, 226 aa, Arabidopsis thaliana
MGYWNSKVVPKFKKLFEKNSAKKAAAAEATKTFDESKETINKEIEEKKTELQPKVVETYEATSAEVKQALVRDPKVAGLKKNSAAVQKYLEELVKIEFPGSKAVSEASSSFGAGYVAGPVTFIFEKVSVFLPEEVKTKEIPVEEVKAEEPAKTEEPAKTEGTSGEKEEIVEETKKGETPETAVVEEKKPEVEEKKEEATPAPAVVETPVKEPETTTTAPVAEPPKP

SEQ ID NO: 12812 - protein, 1117 aa, Helicobacter hepaticus ATCC 51449
MPKRTDIHTILLIGSGPIIIGQACEFDYSGTQAVKTLKNLGYRVVLINSNPATIMTDPDFADRTYIEPITEEIIANIITKEKVDAILPTMGGQTALNVAMKMFEKGMLENITFLGANPEAIKKGEDRQAFKEAMLKIGMDLPKSRYAYTEKEALEAAKEIGFPLIIRASYTLAGGGSGVAYNIDEFKVVAKNGLETSPINEILIEESLLGWKEYEMEVIRDKNDNCIIVCSIENLDPMGVHTGDSITIAPALTLTDKEYQRMRDASFKILREIGVDTGGSNVQFAINPQNGRMTVIEMNPRVSRSSALASKATGYPIAKVATMLAVGFSLDEIKNDITGTPASFEPSIDYIVTKIPRFTFEKFPKADSTLTTSMKSIGEVMAIGGTFKESLQKALCSLETGIFGFNHISTDIDLIKKEIRRPNANRLLYIAEGFRKDMNIDEVYELCKIDKWFLNQIYEIIVAEKYISAEILNDNSLMKRIKSYGFSDKMIAHWLKVNENLELSESEVYQAREHLGITPRYNEVDTCAAEFPSLTPYLYSSIGNFEYINNSSSSLDSHQSNPRKKVMIIGGGPNRIGQGIEFDYCCVHSSFALADLNVQSIMYNCNPETVSTDYDTSDVLYFEPIDFEHVRAVISKEKPDGIIVHLGGQTPLKLAHSLTKINAHIIGTSAKVIDIAEDREKFAQFVNDLGLKQPQNGIAFEKEQAYLVAHKIGFPVLVRPSYVLGGRAMRIVYDDDELKNYMDEVIAVSDSSPVLIDKFLEYAIELDVDCISDGKSVYIGGIMEHIEEAGIHSGDSASSLPSINISKILIDEIEQTTAKIALKLGVVGLMNVQYAIYNENLYLIEVNPRASRTVPFVSKATGIPLAKVATRVMWNHFVYHTSHNADSVQNSSIPTQNAQQDILYEALCFYDKYNKIDFTSHIFKPKALHYVCLKESVFPFNKLVGAELSLGPEMKSTGEVMGIGKSFGLSFAKSQLACKNTLPTQGEIFLSLANIDKKEGIILARGFIELGFSICATEGTYRILRENNIEATHILKVSEGRPNIIDSMTNNQISLAINTSDHHSHKEDTHLIRTQIIKNSIPYFTTLSAARVAIEAIKEMQNSNMNEAYALQDYLQN

SEQ ID NO: 12813 - protein, 517 aa, Oryza sativa (japonica cultivar-group)
MLLFGRKRLLAVLGSCCTILSLLTPTQCASSSPDSLNQSYKIVQPLELTPKLSLQLKLHAFLLWSSVGFLMPIGVLLIRVTSNVKSTRSIRILFYCHVASQIVAVILATAGAVLSISNFENAFNNTHQRIGLALYGFIWLQPLIGFLRPDRGVRFRSIWYLTHWLLGIAICVVGVANVYIGMHTYHERTGRSVRPWTVLLTVEVSAMAFVYLFQDRWNHVVRQQQQQEAAALGDDDDDDDEQSEEHVYPANDHKEVAVVPDGSHGGGGGSWVGEDGRVWHSHDGLAPHSHEPIYSPGDFSKRAPPLISRRFAERAFTVGIGGPVGTGKTALMLALCRSLREKYSLAAVTNDIFTKEDGEFLIKHGALPEERIRAVETGGCPHAAIREDISINLGPLEELSNLCKADLLLCESGGDNLAANFSRELADYIIYIIDVSGGDKIPRKGGPGITQADLLIINKTDLAPAVGADLAVMERDALRMREGGPFVFAQVKHGVGVEEIVNHILQAWEIATGNKRR

SEQ ID NO: 12814 - protein, 441 aa, Oryza sativa (indica cultivar-group)
MAHDGAAAAATLLASSGDNDDKPRRRRNMYAFGCATLASMTTILMGYNLALMSGAQLFVREDMALRDAEIEVLTGSMNVFMLVSILAAGWAADVLGRRGTLVLANAFLMAGALAMSLGATYAALMAARFVTSVGVGFSLVVAPVYNAEISPASARGVVSTLFEMFVNIGILLGYSPRWLAMRGRHADARAVLVRTSDSVEEAELRLEEIKHAAEAPPQEDGGGVWRELLLRPTAMVRQILTCVVGLQFFQQASGVNVVVLYSPVVFKKAGMASNTSVLAAIVAVGVAKTCSILVATLFSDRLGCRPLLLASTGGMAVTLTSLALTLRVAPPSAASAAACVASVVAFVAAFSAGLGPMTAAYTAEVLPLRLRAQGASLGIAVNWLTCGVMSMTFISVAGGITMAGFFFLYAGVAAAACVFVHARLPETRGRSLEDMDALFHK

SEQ ID NO: 12815 - protein, 411 aa, Oryza sativa (indica cultivar-group)
MASDGDAAAPLLTPSGDNDDEPRRRRNMFAFGCATLASMTTILMGYNLALMSGAQLFVREDMGLSDAEIEVLAGSMNVFMLASILAAGWAADTLGRRGTIVLANAFLMAGALAMSLGATYAALMAARFVTSVGVGFARVVAPVYNAEISPASTRGVLTSLLDMFVNVGILLSYVSNYAFAGLPVHLGWRVMFAIGAVPPVFLAAAVLAMPESPRWLAMRGRHADARVVLARTSDSAEEADLRLEEIKHAVAEPHDAGGGVWRELLFRPSAMVRRILATVIGLQFFQQASGIDAIVLYSPLVFKKAGMASNTSVLGATIAIGVVKTCFILVATLLSDRLGRRPLLLASTGGMAVTLTSLALTLLVASPPSTASAAACVASVMAFVAAFSVGLGPTTATALKINLYMVVLNLI

SEQ ID NO: 12816 - protein, 125 aa, Brassica napus
HHPTTTPPQQPPPATHTHREAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 12817 - protein, 387 aa, Triticum aestivum
  misc_feature (23)..(23): Xaa can be any naturally occurring amino acid
MPYLQPPRPHPHPTSRLSRASPXPSPFPFFPAGTSRSGRLHPVPVSGHSASRVSKGKFAVAAVTLDDYLPMRSTEVKNRTSTDGIKSLRLITAVKTPYLPDGRFDLEAYDSLINTQINGGAEGVIVGGTTGEGHLMSWDEHIMLIGHTVNCFGANIKVIGNTGSNSTREAVHATEQGFAVGMHAALHVNPYYGKTSTEGLISHFKEVLPMGPTIIYNVPSRTSQDIPPPVIEALSCYSNMAGVKECVGHERVKCYTDKGITIWSGNDDECHDSRWKYGATGVISVASNLVPGLMHSLMFEGENAALNEKLLPLMKWLFCEPNPIGLNTALAQLGVVRPVFRLPYTPLPLEKRVEFVRIVEAIGRENFVGQKEARVLDDDDFVLISRY

SEQ ID NO: 12818 - protein, 377 aa, Nicotiana sylvestris
MTVDCMITRNKFTMQRTSKEPLIFDASVMKNESNIPSQFIWPDNEKPCANARELHVPHIDLGGVLSGDPFATKQAATLVNEACQKHGFFLVINHGIDTNLISNAHRYMDLFFELPLNEKQKAQRKIGEHCGYASSFTGRFSSKLPWKETLSFQYSAEEGSSHIVEDYFQRTMGENFCHLGKVYQDYSIAMSTLSLGIMELLGLSLGVSRNHFKEFFQENESIMRLNYYPPCQKPELTFGTGPHCDPTSFTILHQDSVGGLQVFVDNEWRSITPNFNAFVVNIGDTFMALSNGRYKSGLHRAVVNTKIPRKSLAFFLCPKKDKVVSPPIELVDSNNPRIYPEFTWPALLEFTQKQYRVDMNTLQTFSNWVQQTTTQAL

SEQ ID NO: 12819 - protein, 360 aa, Nicotiana sylvestris
  misc_feature (194)..(194): Xaa can be any naturally occurring amino acid
MPSRISDDVHQKQLDLYTIKELPESHAWRSSLDHDYQCNDSLESIPVIDLNDEKFAIENIGHACKTWGAFQIINHNISQRLLDNMEEAGKRLFSLPMQQKLKAARSADGIAGYGVARISSFFSKLMWSEGFTIVGSPFDHARQLWPHDYKKFCDVIEEYEKEMEKLAGRLMWLMLGSLGISKDDMKWACCGPRXECSALQLNSYPACPDPDRAMGLAAHTDSTILTILHQNNTSGLQVFKEGNGWVTVPPLSGALVINVGDLLHILSNGLYPSVLHRAVVNRTRHRLSVAYLYGPPSGVKISPLSKLVDQGHPPLYRSVTWSEYLGTKAKHFDKALSSFQLCAPRIGFANPKDRNSVQVG

SEQ ID NO: 12820 - protein, 401 aa, Mesorhizobium sp. BNC1
MSGSALFDTFARLPLSFERGEGSWLITADGTRYLDFAAGIAVNSLGHAHPHLVAALTEQAGKLWHVSNLYEIPGQRRLGERLAEHSFADKVFFTNSGAEALECAIKTARRYHYVNGQENRFRIITFEGAFHGRTLATIAAGGQKKYLEGFGPKVEGFDQLPFGDLRAVENAITPETAAILIEPIQGEGGIRMPPAQFIQGLRELCDKHGLLLIFDEVQTGIGRTGKLFAYEWTGVAPDIAAIAKGIGGGFPMGACLATEEAAKGMTPGVHGTTFGGNPLAMAVGNAVLDVVLEPGFLDEVSRRGLLLKQGLAAIADTFPDIVDEIRGTGLLLGIRCKSPTSALQQALREEGILVAPAGENVLRLLPPLNVTDEDIQEGLERIHRAMESLVSASSIATATKV

SEQ ID NO: 12821 - protein, 370 aa, Nicotiana sylvestris
MPFRISDSFRTHSQKHLDLNSIKELPESHAWTSSNDYPSENSCNFESIPVIDLNNNNHNNINVLEHIGQACKKWGAFQIINHNISERLLQDIELAGKNLFSLPMQQKLKAARSPDGVTGYGVARISSFFSKLMWSEGFTIVGSPLEHARQIWPQDYKKFCDAIEEYEREMEKLAGRLMWLMLGSLGITKEDVNWAVGPKGESKGGSAALQLNSYPACPDPDRAMGLAAHTDSTILTILHQNNTSGLQVFKEGSGWVTVPPFLGALVVNVGDLLHILSNGSYPSVLHRAVVNRTRHRLSVAYLYGPPSGVKISPLAKLVDQRHPPLYRAITWSEYLGTKAKHFDKALSSVRLCAPLTGFADAKDHNGVQVG

SEQ ID NO: 12822 - protein, 555 aa, Ashbya gossypii ATCC 10895
MSSVNKENYRGVPSGRGMKNPVLAGAKRAVLNNVTNTTLSQEAANSNAHSGSGYTNSFGKVLRQAKSKLQSARVAGSLIPQMKREGLASSQEDKENVVPTGVAPAAVAAAAAAAQMAPAIAKPILQSISEESHQECQSLLKDGGSDEGASTVSTKSSDTELAPSSSSSLQSAPANSEEPVVLESGTQLVERRRPQTLNTTLTGSVASSSDCTTSTGQLTESTAGELTTTQNQLRPSVAVAESKKKRPISTIVEPEELKKFKISDQGNQCEWEDLDAEDINDPFMVSEYVNDIFEYLHKLEVMTLPNRHDLFKHANIQQNRDILVNWMVKIHNKFGLLPETLYLALNIMDRFLGKELVQLEKLQLVGTACLFIASKYEEVYSPSVKHFAYETDGACDEEEIKEGEKFILKTLQFNLNYPNPMNFLRRISKADDYDIQSRTLAKYLLEISVVDFKFIGILPSLCAAASMFLSRKMLGKGKWDGNLIHYSGGYSTTELAPICNMLMDYLVQPVVHDELFKKYASRRFMKASVISRQWAKKVMTRSYDIMTLHETQTEY

SEQ ID NO: 12823 - protein, 126 aa, Helicobacter hepaticus ATCC 51449
MQTISSVSTLKAPQAIGPYSQAQIYNGIIYTSGQIALNAQGDFVNGDITAQSTQVLENLKAILESAGSSLQKVIKTSVFLSDINHFNALNEVYAKYFGSHKPARSTIAVKSLPKNALVEIECIAIL

SEQ ID NO: 12824 - protein, 404 aa, Ashbya gossypii ATCC 10895
MSPVGETRRVSDENEAAGARRRGELAKKRGNTVLGVPRKALGAVGVNTRKQERDGAATGSGAGGARGAGTKRMVYHDSEGEETQEPEEKRVSKKAKAERQCPSPAAQTESPEAARGALVREPHPHRDLDALEADDLTMCVDYTNEIFAHLLQREQETTCVVNYVQERQCAFYIRPSMRAILVDWLIEVHLKFQLLPEALYLAINIMDRYLSTNKVSLSKLQLVAITSLLIAAKFEEVNLPKLSNYVYITDNAYTVEEVKQSECNILNALEFNIGWPNPMNFLRRISKADNYNHNTRNYAKVFLEYAMCCPKFVAITPSVLAAMSMRCAMMLNYGAEGFEWDDTMEWYSSMATTSAKFDFQKLCDDLIKDIQEPSTQLNALIYKYKKLGLWVAVKTWCDEQKIVR

SEQ ID NO: 12825 - protein, 375 aa, Sinorhizobium meliloti 1021
MDVRAAVALEAGKPLEVMTVQLEGPRAGEVLVEVKATGICHTDDFTLSGADPEGLFPAILGHEGAGIVVDVGPGVTSVKKGDHVIPLYTPECRSCPSCLSRKTNLCTAIRATQGQGLMPDGSSRFSINGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIVPYLVNLTKRGADQIGGADYTFDCTGNTKVMRQALEASHRGWGKSVIIGVAGAGQEISTRPFQLVTGRTWMGTAFGGARGRTDVPKIVDWYMEGKIEIDPMITHTMPLEDINKGFELMHSGESIRSVVLY

SEQ ID NO: 12826 - protein, 669 aa, Candidatus Kuenenia stuttgartiensis
MKISYSWLKEYVCFDLSPKMLADKLTSAGLVAAGIEPFGDDYCIDLEVTANRSDCMGIIGIAREVAAITKGSLQLPCTDISREGDGDISQNVKVDVKEPLLCSQYTARVIRNIMVKPSPEWLQKRLKCIGLRPVNNIVDITNYVMMESGQPLHAFDLDKVSGGQIQVRKAESGEEIVAINGARRVLFHDMLIIADEKRPIAIAGVIGGKETEVTDVTRNILIECARFEPRQVRRTSKSLGIVSDSSCRFERGVDPLGLDFASKRAAKLIIEHAGGEMCKGIIDVSANRIEAKKVVLRIERVKKILGVDINRDVILDILRSLQFKILNCADTFIDVEIPGFRGDVSREIDLIEEVSRIYDYNNIPAKTSIGIRGSKKSKYEIVENLIRNNLTGLGFYETKTFSIVNHAFLKGVNLWSGEDVVEIANPLRQEESILRTSLLPSLAKVKIHNANHACEKVKLFEIAKIYLKGEKLPHEKVGLSLLDSAGFFEGKGIVQSLLKNLKIHEKCEWVAFHEKTRLFNNEKAAKILMDGKTLGYIGEASKELGFKTLCTLIELDVDALVEKAHFDKKYCEPSPYPMVKRDFAIVVDEEKTWASIEDCINGANISIVKEVNYFDIYRGKQIPEGKKSIAFNLCFQSYERTLKSEEVDDASAVILDALYKKLGAELRTQ

SEQ ID NO: 12827 - protein, 895 aa, Ralstonia metallidurans CH34
MSAVPEQILGASSANDADPQETHEWLDALQGVLNAEGTERAAFLIDKQIEYARVNGVTQPFHAETPYINTIPVEQQARIPGDQDIEHRIRSYTRWNAMAMVLRANKHTNVGGHISSFASAATLYDVGYNHFWRAPSEQSGGDLVFVQGHSAPGVYSRAFLLGRLTPEQLDSFRQEVDGKGISSYPHPWLMPDFWQFPTVSMGLGPIMAIYQARFMKYLASRGLVNAGDRKVWAFLGDGETDEPESLGAIGMAGREKLDNLVFVINCNLQRLDGPVRGNGKIIQELESEFRGSGWNVIKLIWGSRWDPLLQRDTKGLLMKRMMECVDGEYQTFKAKDGAYVREHFFNTPELKAMVADWSDDDIWRLNRGGHDPHKVYAAYKAASEHKGQPTLILAKTIKGYGMGDAGQAMNVAHQQKKMPVDAIRAFRDQFNIPVADDKLEEVPYLTFPEGSKELEYMRKARMDLGGYLPARRMKAEALKVPELSAFEALIKATGEGREVSTTMAFVRILNTLLKDKQVGKHVVPIVPDESRTFGMEGLFRQVGIWNQEGQKYVPEDHDQLMFYKESQTGQVLQEGINEAGAMCDWIAAATSYSTHGVQMIPFYIYYSMFGIQRIGDLCWAAADMRSRGFLLGGTAGRTTLNGEGLQHEDGHSHVFHAVIPNCISYDPTFQYELAVIMQDGLRRMYAEQEDVYYYLTVMNENYEHPEMPAGVERDIVQGMYQFRKGVENSNAPRVQLLGSGTIFREVIAAADLLKKDWGVESDLWSCPSFTELAREGQEVERHNLLNPTGTQRESFVAQKLKGVRGPVIASTDYIRAFAEQIRPFVPRRYVVLGTDGFGRSDTREKLRHFFEVDRYWVTVAALKALADEGAIGREKVAEAIKKYNLDPNKPNPMSV

SEQ ID NO: 12828 - protein, 351 aa, Bacillus clausii KSM-K16
MKIVNIASIPGDGVGREVVPEAERVLKAIAELHGGLTFEFTSFPWSCEYYLENGSMMPEDGLEQIKDFDSIFLGAVGNQRLVPDHISLWGLLIKIRREFEQVINVRPAKLIKGINSPLSNPKDFDLLVVRENSEGEYSSIGGRIYNEDEELAIQNAVFSRRGTERAMRYAFELAKTRRGHVTSATKSNGIVYSMPFWDDVFKEISKDYPSVEVDSQHIDALAAFFVTQPERFDVIVASNLFGDILTDIGAAIMGSIGIAPAANININGKYPSMFEPVHGSAPDIIGKGIANPIGQIWTAKMMLDHHGETELGDHLLDSIEEVTSRGIRTPDIGGTSSTTEVTSEIIKTLLR

SEQ ID NO: 12829 - protein, 554 aa, Ralstonia metallidurans CH34
MSQAIEIKVPDIGDYDAVPVIEVHVKPGDTINAEDALVTLESDKATMDVPSPQAGTVKEVRIKVGDSVSEGSVLVMLEPAGAAAAAPAPAAAAAPAAPAPAAAAPAPAAPAAPAPAAAPAGGGTVEVKVPDIGDYDAVPVIEIHVKVGDQINAEDALVTLESDKATMDVPSPQAGTVKEIKVKVGDNVAQGTLILILEAAGGAAAAAPAPAAAPAPAAAAPAPAPAAAAPAPVAAPAVAPAVQGTTGKAAHASPTVRKFARELGVDVSRVPGTAPKGRITQEDVQNYVKSVMSGQTATPSAPAAAAGTGVGLDLLPWPKVDFTRFGEVESKPLSRIKKISGANLHRNWVMIPHVTNCDEADITELEAFRVQLNKENEKAGIKVTMLAFMIKATVAALKKFPNFNASLDGDNLVLKKYFNIGFAADTPNGLVVPVIKDADKKGVLEISQEMSDLAKLARDGKLKPDQMQGGCFSISSLGGLGGTYFTPIINAPEVAIMGVCKSYMKPVWDGKQFAPRLTLPLSLSWDHRVIDGAEAARFNTYFAALLADFRRILL

SEQ ID NO: 12830 - protein, 476 aa, Oryza sativa (indica cultivar-group)
MASGGDDAAAPLLASKHGGEPRRNTFAFACATLASMTTILMGYNLALMSGAELFIREDLGLADEQVEVLSGSMNVFMLASILAAGTVADAAGRRGTLVLANALLMAGALAMSLGGSYAALMAARFVTSVGVGFAVVVAPVYAVEISPASSRGVLSSLPEIFINAGILLSYVSNYALAGLPLRLGWRVMFAAGVVPPVFLAAGVLAMPESPRWLAMRGRDAEARAVLARTSDTPAEADLRLEEITRAVAAQAGVADGVWRQLLVRPTPTVRRIMTNVLSLHFFQQASGIDVIVLYSPLVFKQAGMASNTSVLAATVAVGVVKTCSILVATLLSDRVGRRPLLLWSAAGMAVALASLALTLCVGAGAPSPARAAAGVASAAAYVAAFSVGLGPLAPSYGSEIMPLWLRAQGAGVGVAVNRVTCGVLSMTFISVAGGITMAGCFFVYAGAAVAAWVFVYVRLPETRGRSLEDMDVLFTK

SEQ ID NO: 12831 - protein, 1409 aa, Ustilago maydis 521
MEAVQKALEQVVKRAPGLHSNSTSAKTAATQPSVHDSIDKLIAQVEAAKAGIASSSSSPDPAVLLAELKSSVEVAQKSILERQKEFHAALSKSTKALDKKFTIAIEGVADPSLFSSAEAQNALERVIFDHLQRNGDWSTSYKFAAEAKLPLSPQSEALYVQLHNVAAAMSRGDLRPAISWTEQEREWLLKRKSPLEFALHRSQFIRIATGAILPGSDENLANRDPDGENVEMMSASMDQLNTIPASSNTMSVTGFASTATADLAHASLANTNVERALAYGREHFKRFRSTHLDEIQRLFTLLAFLPAFIPAPAYGPEGSDSVPVEHLIPTVPLVYRPLLDAKRVHAPLLEPMFRLEFCARNRIAKDAPLSIGVEVGAGGALNKIIKVKAVMKERGNEWSQADELPIEIPLPTRLRFHSIFACPVSKEQGTEQNPPMMLACGHVLCLETLTRLAKGNGRFKCPVEIAHCVSAMERERVAVTDDGAERAGWAGGQGTAGRGGQGRKEFARSFDARARTSQLRTCVEVKRSVLLYLLALMDQVIARHSVIATQDWGGSRTTVGLQRTMETAIPVSRQGTRVYTEYDVASPPRTPGPEWVRFVLISDTHSQTTHIPDGDVLLHAGDLTTLGQPDDLGAQVEWLKSLAHEHKIFICGNHDFSACTDQDFYETRGRQLNAQLHVQDSAHDVARAKQILNRDSLCEKALTYLNNQPHQFTVQRAQTSHYQWTVWGSPWSPQFHDWAWNYKRGVQARHIYKDIPKHVDVLITHTPPHKLGALDTIHDGSSVGCEELTRRLTAPASEHDSLRPKLHVFGHIHEARGVHLLEQPAFHHGDLDESLLVNAALVEYDQHMWNNHRIFSYTVVCNREPLVSASDADTARAAIPFDFIVHSSLLRTTLGEYLESSGLTSESTLTIEYVRSTLPPTRLAAFEHDDWVASIDCSFALANVYMTSSYDGSVRLFSPSNPTQAEHTWSTINKATVQGGKNTSLCSAKWTPPADGLVTGGMDGRVQLWSVEQVEHEWTTRLKWQGEAHNAPVAAVDTAQGPQGSSVLSAGWDGIVAVWDDLIGTTGVDSDQDVEQQDDDDDDDDPTSKRRKTSSNGRKAVKTSSSATKRGIIDATMILYHAQPTAHAVTGAKNVLTATSRVTSVEFERSSSAKNSNRAWSIGYNGVLKGWDLGSGGIAHTSLSLPSSTAESRPMLSLTQLSASTLAVGSMDRAIHLFDTRSSSSAGTLGVSISNAHRGPIDALAAHPLDSNLFASASGLECGVKVWDARSSKKALFTLDTAAVGGDKRDDKGVLALDWSRDGQEVVAGGKDKRITVFRGSAIGQSDQLVPPERFGATFAGEIADGMDACEQVAIFLGAERGVQRGAEQSSIDTIGAAQDDDGGMDDQLDDDDEAGDETDDMEQCRILD

SEQ ID NO: 12832 - protein, 280 aa, Candida glabrata CBS 138
MSPGSGEESPLRDIVRSTSSLKIDDLIKNESDIIRILNQQEDLLMDNGRVRNVHHLVDEDNLLREEFDKVLKQFHGNEDNELKIKGNEEDIDDLFDEEEHKKSSTGLLLSCDSEVTPPENFSHVVGEIYRSSFPRTENFAFLQKRLKLKSILVLIPEEYPQENLDFMEKANIKLFQVGMSGNKEPFVNIPSDLLTKALEVVLNPENQPILIHCNRGKHRTGCLIGCIRKLQSWSLTMIFDEYRRFAFPKARALDQQFIEMYDDDKIKSIATQNKWLPLQW

SEQ ID NO: 12833 - protein, 592 aa, Ralstonia metallidurans CH34
MSVIEVKVPDIGDFDAVEVIEVLVKAGDTVEEEQSLIVLESDKASMEVPSSAAGKVVDVKVKVGDKVAKGTLICTVEGGAAAAPAPAPAAAPKPAAAPAPAPAAAPAAATHAGGADIQCEMLVLGAGPGGYSAAFRSADLGMNTVLVERYGTLGGVCLNVGCIPSKALLHNAAVIDEAKALAAHGILFGEAKIDLDGLRHYKESVVGKLTGGLSGMAKARKVQVVRGIGTFLDPHHLEVQETEGDSKATNGKKTVIRFEKAIIAAGSQAVKLPFVPEDPRIFDSTGALELRDIPNKMLVIGGGIIGLEMATVYSTLGARLDVVEMLDGLMQGADRDLVKVWDKVNKHRFDNVMLKTKTVGVEAKPDGIYVKFEGESAPAEPQRYDAVLVSVGRSPNGKKIGAEKAGVAVTDRGFIDVDKQMRTNVPHIYAIGDIVGQPMLAHKAVHEAHVAAEAAHGEKAYFDAKQIPSVAFTDPEVAWAGKTEDQCKAEGIKYSKGVFPWAASGRAIANGRDEGFTKLIFDEETHRIIGGGIVGTHAGDLISEVCLAIEMGADAVDIGKTIHPHPTLGESIGMAAEIYEGVCTDVPPPRKR

SEQ ID NO: 12834 - protein, 458 aa, Caulobacter crescentus CB15
MDADVRSAPLIPPAPKVHPRQLGGSFVGELRIALEMSRNLMGAWCEEDFDNLFTPYVFMGQPGMVVSDPAAARRILSSPNYVRPVKAARSVRPIAGDGLLLSEGETWRRQRKSLAPVFTPMAVEGLLPHFVAAGASLAEALSGHARADLSEAFHHATLDAVLSALFSRRADAQGDQLAYMVRRYMEGPAHFNLMDFVSRGADDLTFLDVERRRQGAAWFQAVEHLIAQRQAHPHAEARDLLDRLLAARDEDGAPLSNQEIRDQCGTMLVAGFETTSRLLFWATYLLALDPATQDRLRAEVLAAPAAAVRTLDDLQAWPLMRSVLFETLRLYPTAPLLAREAIGPDTVMGHAVVPGQIITISPWLIHRHRKLWDAPTAFVPDRFIDQPHPWGIEAFLPFGAGPRVCIGASFALAEAQIVLASLLERFEIGLVSDRPVIPIASITLGPDHAPAFTLTPVS

SEQ ID NO: 12835 - protein, 711 aa, Salinibacter ruber DSM 13855
MASGSSDLQKTLTLYDVYSISTGAMFSSGFFLLPGIAAAETGPSVILAYLVAGLLILPSMYSMAELSTAMPKAGGTYYFLDRALGPLAGTVGGLGTWLALVFKSAFALIGMGAYLAIYADVPIKPLAAALTLAFGVLNVVGAKESSLLQRVLVTILVGVLGFYAAQGVLSVWGGQSAVGGAAGEFTPFFTEGARGFLATIGIVFVSYAGLTKVASVAEEVKNPDRNIPLGMGLSLLTATGIYVVGVAIMVAILPATDLHADLTPVYTSGEVFFNWLPYTLGPILIVVAAVAAFASTGNAGIMSASRYPLAMARDRLLPDGFARIGRFNTPTRSIVVTVALMLVIIFVLSEEGVAKLASAFQLLIFALLNFAVIVMRESEIPSYAPGYRSPLYPWVQVAGIAIPFFLISEMGTLAIVFTGVVVLVGVGWYFYYASDVPREGAIFHLFARLGKQRYDGLDRELQTILEEKGVGHDTAFDRLVAESDVIHLDEPVPYADVVEDVSGRLAEELGLSTETLEHGFLEGAPYSAVSVSHGAALPYCRLDGISESKMVMVHCQSGICVDLEDEIEELDRSEPVYAFFFLVSPKDDEGEHLRTLATLANRTDEEQFLVEWRAAADEQEVKESLLHHERYLTLNLLSGTNTDEFIGQTVTDLNLPAGVLVALVRRDGQITVPSGATRLEEGDRVTIIGNPAGIDRLYELYRAGEQEGVVQ

SEQ ID NO: 12836 - protein, 108 aa, Aspergillus fumigatus
MSHGKVIAVDNPIIYKALTSSGPVVVDFFATWCGPCRAVAPKVGELSEKYSNVRFIQVDVDKVRSVAHEMNIRAMPTFVLYKDGQPLEKRVVGGNVRELEEMIKSISA

SEQ ID NO: 12837 - protein, 219 aa, Triticum aestivum
MAGAAAAAAAVASGISIRTVAAPKISRAPRSRSVVRAAVSLGEKAYTVQKSEEIFNAAKELMPGGVNSPVRAFKSVGGQPIVFDSVKGSHMWDVDGNEYIDYVGSWGPAIIGHADDEVNAALIETLKKGTSFGAPCALENVLAQMVISAVPSIEMVRFVNSRTEACMGALRLGRAFTGREKILKVEGCYHGHGEFLPSVKPGVGVATPRALPDTPLEWP

SEQ ID NO: 12838 - protein, 493 aa, Pseudomonas fluorescens PfO-1
MTLARFQMCIGGEWVDALSGKTFESLNPALAEPWAELPDADEADVERAVQAAQTAFDSPAWRGLTATARGKLLRRLGDLIAENKEQLAQLESRDNGKLIRETRGQVGYLPEFFHYTAGLADKLEGGTLPLDKPDLFAYTVHEAMGVVAAIIPWNSPLYLTAIKLAPALAAGNTIVIKPSEHASATILELARLALEAGIPPGVVNVVTGYGPSTGAALTRHPLVRKIAFTGGAATARHVVRSSAENFAKLSLELGGKSPNIIFADADLDSAINGAIAGIYAASGQSCVSGSRLLVQDDIYDEFVSRLVERAQRIRIGNPQDDSSEMGPMATAQQLAVVEGLVADAIAEGARLRLGGKRPSGVGDGWFYEPTLFECDRNSMKIMQEEVFGPVASVIRFKDEAEALAIANDSQFGLAAGIWTRDLGRAHRLARDVRSGIIWVNTYRAVSAMAPIGGFKNSGYGRESGIDSVLAYTELKTVWINLSQAPMPDPFVMR

SEQ ID NO: 12839 - protein, 336 aa, Coleochaete scutata
MGRGKIEIRRIENATSRQVTFSKRRNGLLKKAYELSVLCDVDIAVIVFSPTGKLFQYASSSMKEILERYEQVPPEQKEKGSQRLDNMDYLNREVAKLRNEVEHKYHEARQLEGEDLDRLGVYELEQLEQKLSNSMRRIRGRKDELMKAELEGLRKQVADMETALVGAASFDGRPLSGSSNYLLQSIPGIRTMPPSSLGGMNPASTSLQLGSDRLFGNRGVELHDRSASDESPVMTNRMSVDFAQAPREMSGVDLSGSPVPPWKSQAAAAAQQEWKNQASSPTDWKVTNTEHLDSWPKAPAPTPEWKSTSVQPEWKNQSSPSSEWKPLDWMYHGPQD

SEQ ID NO: 12840 - protein, 294 aa, Oryza sativa (japonica cultivar-group)
MAGAGAGESLDLPVVDLASSDLAAAAKSVRKACVEYGFFYVVNHGAEGLAEKVFGESSKFFEQPLGEKMALLRNRNYLGYTPLGADKLDASSKFKGDLNENYCIGPIRKEGYQNDANQWPSEENFPCWKETMKLYHETALATGKRILSLIALSLNLDVEFFDCPVAFLRLLHYPGEANESDDGNYGASAHSDYGVLTLVATDGTPGLQICREKDRCPQLWEDVHHIEGALIVNIGDLLQRWTNCVFRSTLHRVVAVGKERYSVAFFLHTNPDLVVQCLESCCSEACPPRSSSSC

SEQ ID NO: 12841 - protein, 544 aa, Oryza sativa (japonica cultivar-group)
MWGPHIILYLQPFFLLPSSHMSCVLGRPSAPSLDHPQQPNPPPVAPEKPPAVAKKAAEEEEEKKPPKQARRERHAWSSRSAAAEAVGLGLGGSFANRARGEQVAAGWPAWLSAVVGEAIDGWTLRRADSFEKIDKVRTPALALAIVGGGGRELSSSVLSVAQIGQGTYINVYKARDTVTGKIVALKKMGQVCFLLCKPSYRGDTAAGGRGGRRRQQQQTAALAEEESGMAGGGGGGNRLDLPVVDLASSDPRAAAESIRKACVESGFFYVVNHGVEEGLLKRLFAESSKFFELPMEEKIALRRNSNHRGYTPPYAEKLDPSSKFEGDLKESFYIGPIGDEGLQNDANQWPSEERLPSRRETIKMYHASALSTGKRILSLIALSLNLDAEFFENIGAFSCPSAFLRLLHYPGEVDDSDDGNYGASAHSDYGMITLLATDGTPGLQICREKNRNPQLWEDVHHIDGALIVNIGDLLERWTNCIYRSTVHRVVAVGKERYSAAFFLDPNPDLVVQCLESCCSESCPPRFSPIKSGDYLKERLSATYK

SEQ ID NO: 12842 - protein, 532 aa, Triticum aestivum
  misc_feature (381)..(381): Xaa can be any naturally occurring amino acid
MQASSRSSSMERTSQWVSSQDVPTDLVVRVAGAAFPLHKAVMVPKCGYIRKAVAMATRPDPAATVEIELDGLPGGADAFEKAARYCYGANFEISARNAAALLCAAAFLDMQPADGGLARRVEEFLAQAGLRTLPNAIAVLRSCEGPLLTAAEELGVARRAADAVALRICNEVLFPTRSPPEWWASELAALSPVSFHRVFTALRCRRAGPEVLVAAATAYAELLLADGKASDHRALLESVVAVLPSADDAPLPAAFLCRLLHDAVTTEASAKTCRDLELRLAAVLDQATAGDLLAFAFDGAGERVINTESLRRVIAAFVERESGAGRNRRASLSGAAALGAGALQKVAKMVDEVAAEIATDESLPISKFVGVAGAVPKDARXPPHDCLYRAVDIYLKAHPKLDEIEREKVCSVMDTLKLSYTARIHASQNKRLPLQAVLSALYYDQLKLRSAGVGHDDEDSDARSEAGSARMQAKADAALARENEALRSELARMRAHMSSGVQQSKGSGSRTAARRRRWRGRKRASSGRCRAR

SEQ ID NO: 12843 - protein, 339 aa, Candida glabrata CBS 138
MSGSYWTSMQRQKWQHTKPSLARERQRLWVMECQLFPQGLNIIVDSKPNSADSSNGNAANNGGGNGRSQLVATTKNIPITHRDLHYDKDYNLRIYCYFLIMKLGRRLNIRQYALATAHIYLSRFLLKASVREVNLYLLVTTCVYLACKVEECPQYIRTLVSEARSLWPEFIPPDPTKVTEFEFYLIEELQCYLIVHHPYKSMEQIVEALKEEPFKLTFTSDELQNCWSLINDSFINDVHLTYAPHIIAMACLFITVSIQGSNTKELSLTSAVTETLTSQSSLTPQQQTFFRFLAESHVDLEEVMDTIQQQIILYDHWDRYHEPWIKYLLHTLYLRPLSA

SEQ ID NO: 12844 - protein, 492 aa, Candida glabrata CBS 138
MEFYRDSTWVLEYLEGQIEKTGRVSGSLQTIVLRCCKQYRIKTNPKHIYAIVSSCWKYKPYLDKIMKKSGLLDAIPRKKGKPAFSKLTLLLLCHDLLLSKAKRIQMGKHPIKNYVLKYKNALNAEFVKLKIKLKITDLSQVVDKDDAADDMTPVRWIRINPLRISNHDTDQVLNELKKKFPTRVNTWKDIIPGSIYYDEFIPNLYGIHISDKITSHELYKQGKIIIQDRASCFPAHILNPSADDVVIDACSAPGNKTTHVAAHIFGDPENPRNDNVQIYAFEKDPERAQILQKMIKTAGCHKNIDVNVGDFTQIATPSKYSDVTGFILDPSCSGSGIFGRKSVDILNNHGKKSNDEVPDENDAEETTDSKNEQLKERLSKLASFQFQIVRHAMSFPNAKKIVYSTCSIHAEENERVVIDLLLDKKVQSWGWRVAKKELVLPTWYRRGFKEEFQEVFTDKTEQECQELADGCVRALPKEDGGIGFFAVCFVRD

SEQ ID NO: 12845 - protein, 123 aa, Ureaplasma parvum serovar 3 str. ATCC 700970
MALFKINKGEIMNFVNSTQLKTDIPNFDSGDTIIVHNRIVEGKKSRIQKFEGVVLRRRGSGSSETVIVRKESSGIGVEQSFNIHSPLVEKIEVIKYGKVRRAYISYMRNRSGKSARIKELNKQ

SEQ ID NO: 12846 - protein, 560 aa, Oryza sativa (japonica cultivar-group)
MSATMDAVMPGAAGAHNATAAAAAGRRGGGIVAGMMALPEVQTVELLVAVSIFVAIHSLRQRRSQGLPSWPLVGMLPSLLLGLRGDMYEWLTGVLASRGGTFTFHGPWLTNLHCVVTSDPRNLEHMLKTKFGSFPKGPYFRDTVRDLLGDGIFGADDEVWRRQRKAASLEFHSAEFRALTASSLVELVHRRLLRVLGDAEEAGDAVDLQDVLLRLTFDNVCMIAFGVDPGCLRPGLPEIPFAKAFEDATEATIVRFVTPTAVWRAMRALGVGHERVLQRSLAGVDRFAYDVIRQRKEEVAAGGGGGGGGRSDLLTIFTKMRDADTGAAAYSDKFLRDICVNFILAGRDTSSVALAWFFWLLNKNPAVEAKILEEIDDIVAARRSSPPAPAVAANGADEDDLVFHPEEVKKMEYLHAALSEALRLYPSVPVDHKEVVEDEVFPDGTVLKKGTKVIYAMYTMGRMESIWGEDCREYKPERWLRDGRFMGESAYKFTAFNGGPRLCLGKDFAYYQMKFAAASILRRYHVRVVDGHPVAPKMALTMYMKHGLKVKLTKRDKSKL

SEQ ID NO: 12847 - protein, 303 aa, Coprinopsis cinerea okayama7#130
MTVPDILNQTFQAVDDALSKMCAESDGKIHSGCTAVTAFLRIEDEDGQQSFVVPVESSSSSNESPVSSLDDIAPPTPSGTQSSAALDSGDESKEIKTDKKTKKKSASLSGKRIRKALRSLGGSKAPTPRSTSPVDARDFTNTGITVTIPPDSHRRVLYSANAGDARGVLCRAGKAIRLTYDHKGSDKQEAKRITDAGGFVMSGRVNGVLAVTRSLGDASMKEFVVGAPYTTETELCEEDEFLILACDGLWDITNDQAAVELVRDIEDAQVASETLLKHALSQHTTDNVTVIVVRFKHGQPKTA

SEQ ID NO: 12848 - protein, 274 aa, Salinibacter ruber DSM 13855
MRGPSTRHDVRADQGPRRRCQNAIDGCPPQHISDTLPSLTRSSMDRDTAKQAAAEAAAQLVRDGMCVGLGSGSTTAYALEFLGRRIQAEDLDVQGVPTSFATERRARTHGIPLTSLDDTPSLDLALDGADEVDDAFRLIKGAGGAHAREKVVAHQADRFVVLVDPTKEVSRLGTQFPVPVEVLPMAATPVMNALDAAGATPTLRTADAKDGPVVTDQGLWIIDARFPDGIENPDALNRRLCDRPGVLDHGLFLDMATDVLVGRPDESVDHRSAS

SEQ ID NO: 12849 - protein, 435 aa, Pyrococcus furiosus DSM 3638
MARITEEQRRKLAQDALEYHRNNFPGNGKIEVIPKVPLRDFYDLSLAYTPGVAEPCKVIAKKGNYEDYTIIPNTVAVVTDGSAILGLGNIGVLAGMPVMEGKCVLFKALAGIDAFPILIDTQDVEKIVETIKLISKGFGGINLEDISAPRCFEIEMRLKRELDIPVFHDDQHGTAVVTLAGLINALKLVGKKFNEIKVAISGAGAAGIAIAKLLHHVGVKEILLVDRAGIIYEGRKENMNPYKEEVARFNIHGVQGDLAKAMEGADVFIGVSVGGIVKPWMIKKMADDPIVFAMANPIPEIMPEDAKKAGAKIVATGRSDYPNQINNVLGFPGIFRGALDVRATDITLNMNIAAAEAIASVVSDEELSEDYIIPSPLHPDVYPKEARAVAEQAIRDGVARRKLSGEWVEEHTRKLREFYAALIEPLNERRKQYIT

SEQ ID NO: 12850 - protein, 141 aa, Photorhabdus luminescens subsp. laumondii TTO1
MTVERTFSIIKPNAVKKNAIGAIYARFESAGFKIIAAKMLHLTREQAEGFYAEHKGRPFFDGLVEFMTSGPIVVQVLEGENAVQRHRDLMGATNPDNALAGTLRADYADSFTENAVHGSDAVESANREIAYFFTEDEICPR

SEQ ID NO: 12851 - protein, 392 aa, Photorhabdus luminescens subsp. laumondii TTO1
MSQPNTAAQFAASVVSETPEKKGGKINLLDLNRKQMRQFFIDMGEKPFRADQVMKWIYHYCYDDFEQMTDINKILRAKLQQVAEIRAPEVAEEQRSADGTIKWAITVGDQQVETVYIPEDDRATLCVSSQVGCALECKFCSTAQQGFNRNLRVSEIIGQVWRAAKIIGSLKSSGRRPITNVVMMGMGEPLLNLNNVVPAMEIMMDDFGFGLSKRRVTLSTSGVVPALDKLGDMIDVALAISLHAPTDDVRDDIVPINRKYNIEQFLAGVRRYLTKSNANQGRVTVEYVMLDHINDSVEQAHQLAECLKETPSKINLIPWNPFPGAPYGRSSNSRIDRFAKVLMEYGFTTIVRKTRGDDIDAACGQLAGDVIDRTKRTLKKRQAGEPIQIRSV

SEQ ID NO: 12852 - protein, 476 aa, Oryza sativa (japonica cultivar-group)
MGKAAAMEVSASAAAEAGMMVGHGEWRDDDGRARRMGTVWTASAHIITAVIGSGVLSLAWAIAQLGWVAGPAVMLLFAFVIYYTSTLLAECYRSGDPCTGKRNYTYMDAVRANLGGSKVRLCGVIQYANLFGVAIGYTIAASISMLAIKRADCFHEKGHKNPCRSSSNPYMILFGVVQIVFSQIPDFDQIWWLSIVAAIMSFTYSTIGLSLGIAQTVANGGFMGSLTGISVGTGVTSMQKVWRSLQAFGDIAFAYSYSIILIEIQDTIKAPPPSEAKVMKRATMVSVATTTVFYMLCGCMGYAAFGDKSPDNLLTGFGFYEPFWLLDVANAAIVVHLVGAYQVFVQPIFAFVERWAAARWPDGGFISRELRVGPFSLSVFRLTWRTAFVCATTVVSMLLPFFGDVVGLLGAVSFWPLTVYFPVEMYIAQRGVRRGSARWLCLKVLSAACLVVSVAAAAGSIADVVDALKVYRPFSG

SEQ ID NO: 12853 - protein, 146 aa, Ralstonia metallidurans CH34
MKTARQVLESKANQAIFSIPPTATVYAALQLMAEKGIGALLVMEQQKIVGIISERDYARKVILMQRTSRETLVREIMTTAVIYVRADQTTDECMALMTRHRLRHLPVMNSDQLLGMISIGDLVNDIISEQRFTIEQLEHYIHGGSR

SEQ ID NO: 12854 - protein, 475 aa, Oryza sativa (japonica cultivar-group)
MASGQKVVKPMEVSVEAGNAGEAAWLDDDGRARRTGTFWTASAHIITAVIGSGVLSLAWAIAQLGWVAGPAVMLLFAFVIYYTSTLLAECYRTGDPATGKRNYTYMDAVRANLGGAKVTFCGVIQYANLVGVAIGYTIASSISMRAIRRAGCFHHNGHGDPCRSSSNPYMILFGAVQIVFSQIPDFDQIWWLSIVAAVMSFTYSGIGLSLGIVQTISNGGIQGSLTGISIGVGVSSTQKVWRSLQAFGDIAFAYSFSNILIEIQDTIKAPPPSEAKVMKSATRLSVATTTVFYMLCGCMGYAAFGDAAPDNLLTGFGFYEPFWLLDVANVAIVVHLVGAYQVFVQPIFAFVERWASRRWPDSAFIAKELRVGPFALSLFRLTWRSAFVCLTTVVAMLLPFFGNVVGLLGAVSFWPLTVYFPVEMYIAQRGVPRGSARWVSLKTLSACCLVVSIAAAAGSIADVIDALKVYRPFSG

SEQ ID NO: 12855 - protein, 546 aa, Triticum aestivum
MAATAVARGAASRSPLLLHHHRLPQVPAGGGGSLRVGALGAGRDWRRRVRVGVRVFARYSSQPQDFSSRLQDRAGELPKLVEDLLQTSISTGPRGAFRMAQGIQALLGVGGEWLNDFSKTANTSEGIPAQMRLGLLSPLYLRRLFERMGATYIKLGQFIASAPTSFPAEYVEEFQNCFDRAPPVPYSEIESILREELQRPLDSVYEYIDPVPIASASIAQVHGARLKSSQKDVVIKVLKPGIEDTLVADLNFIYLVARVLEFLSPELERTSLVAIIKDIKESMLEEVDFRKEAVNMEAFQRYIEAMGFDRQAKSPFVYQHCSTKRVLTMERLYGVPLTDLDSIRSLVPDPELTLVTALNVWFGSLISCESFHADVHAGNLWLLRDGRVGFIDFGIVGRISPRTWAAMEIFLASFATEDYNAMASALSEMGATGNDIDVDSFAKDLQNIFSSLQELDTEIIVAAARSSDATAVSANVVVDERQMNALFLDLVRVSESYGLKFPREFALLMKQLLYFDRYTRLLAPSMNMLRDERINITSNKHTRRMN

SEQ ID NO: 12856 - protein, 595 aa, Listeria monocytogenes str. 1/2a F6854
MGKRDRLIFSAGHGIVLQYVLLYLNGYISLEELKTFRTMYSKLPGLSEYKSLPYIESTTGSLGQGIANAVGMAISLKRAHETKKVENKEAIQSNVYCIVGDGCLMEGISYEASSLAGTLALSNLIVLYDSNNITIDGPTDKTFNENIEKRFTSMNWDYLLVKDGDDVEAINDSIQEAKLRDKPVLIEVGTRIARSSLNKENSADAHGKPLGKEEVELIKQQFKLLKPFEICEASVKEFTKIENQRKQYQRDLSYVNNENRGVNKNILEWNTIKDIKIPDNLTMIEKFSHIINRIKENGTDILVGSADLAASTKLWIEKGGYISKGSYLGANIAFGIRESAMAAIATGIYQGTCLKTLISTYFAFSDIMKNPIRMSALMNIPNIYVFTHDGFSLGLDGGTHIPVEQINMLRDIPNLNVYRPGNDDELKVACYESILNPSTPSAIILTRDVINIQSDIPISSIKKGGYLFKSKKNAKLKIFSTGSELAIAIEVQDMLNKEGIYADVISIPCHEKLMEQSDEYISNLFLKDTKKVFIEIGGKSIWPIYGDKDSIYICLDNYVSPGPPESLKEKYGYTPKKVFERIRNHYNIGDEDKLK

SEQ ID NO: 12857 - protein, 319 aa, Vibrio cholerae
MGWDTETKMSTYEKETEVMKKFSGIIPPVSSTFHRDGTLDKKAMREVADFLINKGVDGLFYLGTGGEFSQMNTAQRMALAEEAVTIVDGRVPVLIGVGSPSTDEAVKLAQHAQAYGADGIVAINPYYWKVAPRNLDDYYQQIARSVTLPVILYNFPNLTGQDLTPETVTRLALQNENIVGIKDTIDSVGHLRTMINTVKSVRPSFSVFCGYDDHLLNTMLLSGDGAITASANFAPELSVGIYRAWREGDLATAATLNKKLLQLPAIYALETPFVSLIKYSMQCVGLPVETYCLPPILEASEEAKDKVHVLLTAQGILPV

SEQ ID NO: 12858 - protein, 565 aa, Streptomyces peucetius ATCC 27952
MAASPEKPASVTPRRKAGRHRGEGQWAMGHHTPLNGNEQTKKDDDGLNVRTRIETIYAHRGFDSIDGADLRGRMRWWGLYTQRKPGIDGGKTAILEPEELDDEYFMLRVRIDGGRLTTEQLRVIGEISQEFARGTADLTDRQNVQFHWIRIEDVPEIWRRLEGVGLSTTEACGDTPRTILGSPVAGIAADEIVDGTPAIDEIHRRYIGNKDFSNLPRKFKTAVSGSPLLDVAHEINDVAFVGVDHPEHGPGFDLWVGGGLSTNPKLGVRLGAWVPVDEVPDAWEGVISIFRDYGYRRLRNRARLKFLVADWGAEKFRRVLEDEYLKRPLLDGPAPQQPAQQWRDHVGVHRQNDGRFYVGFAPRVGRVDGATLTKIAELAESHGSGRVRTTVEQKMIVLDVAEDRVDSLVSGLEALDLRVTPSPFRRGTMACTGIEFCKLAIVETKGRGSALIDELERRLPRFDEPITININGCPNACARIQTADIGLKGQLMLDDEGNQVEGYQVHLGGALGLDPAFGRKVRGLKVTSAELPDYVERVLGRFQAEREDGERFATWAARASEEALS

SEQ ID NO: 12859 - protein, 231 aa, Oryza sativa (japonica cultivar-group)
MADADGDRGVAAAAAAAAVVHDDVLESDEEDFTFAAAAAVTCVVGGGRIGAVVYPVFGRPRSPPPVQEVEEPDTATVRVPLGQLLLEERASAPPSGEQADEDGVLDGVPAETYCLWSPGSPAPAVSNSPARCQKSGSTGSVLRWRQRLIGRSHSDGKEKFVFLSSGSDVRSKGRTTTTSRGDAGGRGGGWRYYASGGGNGGGRRPSFLPYKQDLVGLFANAGAFRRSYHPF

SEQ ID NO: 12860 - protein, 449 aa, Streptomyces peucetius ATCC 27952
MKDDSPAPCVADRDRIARRTASTCGPPGQRRESMATNAAFVIVGASLAGAKAAQTLREENFDGPVVLLGEESEHPYERPPLSKGYLLGKDERDTVYVHPAQWYPEHDVDLRLGATVTAIDPAGHEVTLADGSRIGYEKLLLTTGSSPRRLTVPGADLEAVHYLRRLADSDRIKESFASATRIVVIGAGWIGLETAAAARAAGVEVTVLEMAELPLLRVLGREVSQIFADLHTEHGVDLRFGVQVAEITGADGRANGVMLADGSRIDADAVIVGVGITPNTQLADAAGLEVDNGIRVDAHLRTSHPDIYAAGDVANAFHPLLGKHIRVEHWANAVNQPHVAAKAMLGQDVAYDRVPYFFTDQYDLGMEYTGYVEPGGYDQVVFRGRTDTREFIAFWLAEGRVLAGMNVNVWDVTDPIRDLVTSRRPVDAKRLADSDVPLAHLLGRPDTTA

SEQ ID NO: 12861 - protein, 329 aa, Propionibacterium acnes KPA171202
MVSSRRRDLDVLTMGRIGVDIYPLQYGVGLEDVTSFGKFLGGSPTNVAVAAARLRHSAAVVTAVGDDPFGRFCRREMARLGVYDNYVLVNSELPTPVTFCEIFPPDDFPLYFYRRPTAPDLRITPDDVPEDAVRNAQILWLSVTGLCQQPSYDAHCRALEVRGKAEHTVLDLDYRSMFWQSAAKAHEAVSAVLPHVTVAIGNREECEMAVGESDPDRAAHALLDAGVQLAVVKQGPKGTLAMTREERVEVAPTPIDVTNGLGAGDSFGGSLCHGLLEGWSLAETIQAASAAGALVATRLECSTAMPSEPELFAMMAKHPDIAIKEEHLS

SEQ ID NO: 12862 - protein, 1027 aa, Bacillus subtilis
MPKDTSISSILVIGSGPIIIGQAAEFDYSGTQGCIALKEEGYRVILVNSNPATIMTDEAFADEIYFEPLTAESLTAIIKKERPDGLLANLGGQTALNLAVELEETGVLKEHGVKLLGTSVETIQKGEDREKFRSLMNELKQPVPESEIVDNEADALHFAESIGFPVIIRPAYTLGGKGGGIAPDKEAFTAMIKQALLASPINQCLVEKSIAGFKEIEYEVMRDSNNTCITVCNMENIDPVGVHTGDSIVVAPSQTLTDEDYQMLRTASLTIISALDVVGGCNIQFALDPFSKQYYVIEVNPRVSRSSALASKATGYPIAKMAAKLAVGYTLDELKNPLTGSTYASFEPALDYVIVKFPRWPFDKFKNADRKLGTKMKATGEVMAIERNLEAAIQKAGASLELKNIGTHLPELSGLSIDTLWDLAITPDDRRFFVVMELLSRSVSIDDIHEKTKIDPFFLHTFDNIIKLENRLMEAGSDLSFELLKKAKEKGFSDATIASLISKTEEEVRRLRKEMGITPSFKIVDTCAAEFDAKTNYFYSTYFGETDGDISRKEKKRALIIGSGPIRIGQGVEFDYSAVHGVLTLQELGFETIMINNNPETVSTDYEIADRLYFEPMTTEHIVNVREQENIDFAIVQFGGQTAINAAEALEKAGITLLGTSFQTLDVLEDRDQFYQLLDELGLKHAKGEIAYTKEEAASKASEIGYPVLIRPSYVIGGMGMIIVDSQAQLSQLLNDEDSMPYPILIDQYVSGKEVEIDLISDGEEVFIPTYTEHIERAGVHSGDSFAILPGPSITSGLQQGMKDAAQKIARKLSFKGIMNIQFVIDNGNILVLEVNPRASRTVPVVSKVMGVPRATRLLAGASLKDLNPAVQNHHGVAVKFPVFSSHAIQDVDVKLGPEMKSTGEGMCVAYDSNSALKKIYTRVWSQKGSIYLQNVPEDVKELAENAGFTIHEGTFASWMEQEGNSLHINLSGSEEARKERLEAMTHGIPVFTEEETVRAFLQSGSGHPQPVSLKDLYKKEVASCTQ

SEQ ID NO: 12863 - protein, 729 aa, Thiocapsa roseopersicina
MTPDLSSSPAFGYADLSNCEREQIQLAASIQPHGALIVLSEPDLVVIQVSENAGSLLRIDRDLIGARLDELVPVLAARVRPRLGDNLAQIPLVLRTPVGVRPERDFDAIVHRPPAGGLVVELEPSGAAVDLSARINAALQTIIASASLRSLCDEAARIFKSIAGYDRVMVYRFDDEGHGEVLSEQREPELEAYLGNRYPDSDIPRIARRLYERNRIRLLVDVDYEPVRIHPRTSPVTGEDLDMSLCSLRSMSPIHIQYLKNMGVGATLVASLLVGGRLWGLIACHHRGPRFVQYEIRAVCELLAEAVATRIAALESFVQAQAELSVRRLEQRMVEAISREGDWTSALFDDPRTLLQTVDAAGAALICDGRILTTGEVPGTRDLREIGAWLDTQPRSAVMATASLRRDEPRLADLTPVASGILAAPVSSCMGEYLIWCRPERVRTVTWGGNPFKPVFSGNDPAQLSPRRSFAQWHQVVEGTSDPWTSANLATARLIGESVADVIQQFRSVRVLIAQAQLAQVRSQVRVSEQPILIADADGVFLLTTQSFERLLHPDQPPPQCLDDLLALFSEPAEARRRLNELVNHRRAWRGEVELNTRDIGLRPFLVRADPVFSSPGSVLGFVILLTDLSERKSAEDARHRVQAGLLEQQKLMRQQLQWSANPMYRELLSAIVGNAQLAALEVTDGVDLGRVPALVDAVQSSVHRTTQLLEHLAWYSAQNTKDDPPIGN

SEQ ID NO: 12864 - protein, 989 aa, Methylobacterium extorquens
MSNGPEPHGNKIEQPEIRADERQDAGGPANGAPSTSGGAYSQGAKSGGQAAPDPSGSYGIKDAPVAPATIAFEFDGQQVEAQPGETIWAVAKRLGTHIPHLCHKPDPGYRPDGNCRACMVEIEGERVLAASCKRTPAIGMKVKSATERATKARAMVLELLVADQPERATSHDPSSHFWVQADVLDVTESRFPAAERWTSDVSHPAMSVNLDACIQCNLCVRACREVQVNDVIGMAYRAAGSKVVFDFDDPMGGSTCVACGECVQACPTGALMPAAYLDANQTRTVYPDREVKSLCPYCGVGCQVSYKVKDERIVYAEGVNGPANQNRLCVKGRFGFDYVHHPHRLTVPLIRLENVPKDANDQVDPANPWTHFREATWEEALDRAAGGLKAIRDTNGRKALAGFGSAKGSNEEAYLFQKLVRLGFGTNNVDHCTRLCHASSVAALMEGLNSGAVTAPFSAALDAEVIVVIGANPTVNHPVAATFLKNAVKQRGAKLIIMDPRRQTLSRHAYRHLAFRPGSDVAMLNAMLNVIVTEGLYDEQYIAGYTENFEALREKIVDFTPEKMASVCGIDAETLREVARLYARAKSSLIFWGMGVSQHVHGTDNSRCLIALALITGQIGRPGTGLHPLRGQNNVQGASDAGLIPMVYPDYQSVEKDAVRELFEEFWGQSLDPQKGLTVVEIMRAIHAGEIRGMFVEGENPAMSDPDLNHARHALAMLDHLVVQDLFLTETAFHADVVLPASAFAEKAGTFTNTDRRVQIAQPVVAPPGDARQDWWIIQELARRLDLDWNYGGPADIFAEMAQVMPSLNNITWERLEREGAVTYPVDAPDQPGNEIIFYAGFPTESGRAKIVPAAIVPPDEVPDDEFPMVLSTGRVLEHWHTGSMTRRAGVLDALEPEAVAFMAPKELYRLGLRPGGSMRLETRRGAVVLKVRSDRDVPIGMIFMPFCYAEAAANLLTNPALDPLGKIPEFKFCAARVVPAEAAPMAAE

SEQ ID NO: 12865 - protein, 142 aa, Sinorhizobium meliloti 1021
MSVKAILNEKGSNVITVTAQVTVQQAASLLHENHIGAVVVVDPEEHIVGIMTERDIVASIARYGAACLDKPVSSVMWQNVYCCREEMSVDSLMEMMSKFRARHLPVEREGRLAGIISIGDVVKYHIRAIENEAEQIKAYIAG

SEQ ID NO: 12866 - protein, 425 aa, Pseudomonas putida GB-1
MSKTNESLMQRRVAAVPRGVGQIHPIFVDTAKNSTVIDVEGRELIDFAGGIAVLNTGHLHPKVVAAVQEQLTKVSHTCFQVLAYEPYVELCEKINKLVPGDFDKKTLLVTTGSEAVENAVKIARAATGRAGVIAFTGGYHGRTMMTLGLTGKVVPYSAGMGLMPGGIFRALFPSELHGISVDDAIASVERIFKNDAEPRDIAAIILEPVQGEGGFLPAPKELMKRLRALCDQHGILLIADEVQTGAGRTGTFFAMEQMGVAPDLTTFAKSIAGGFPLAGVCGKAEYMDAIAPGGLGGTYAGSPIACAAALAVIEVFEEEKLLDRSKAVGERLTTGLREIQKKHPIIGDVRGLGSMIAVEVFEKGTHTPNAAAVGQVVAKAREKGLILLSCGTYGNVLRILVPLTAEDALLDKGLAIIEECFAELA

SEQ ID NO: 12867 - protein, 480 aa, Pseudomonas putida GB-1
MQLKDAQLFRQQAYINGEWLDADNGQTIKVTNPATGEVIGTVPKMGTAETRRAIEAADKALPAWRALTAKERSAKLRRWFELMIENQDDLARLMTTEQGKPLAEAKGEIAYAASFIEWFAEEAKRIYGDTIPGHQPDKRLIVIKQPIGVTAAITPWNFPAAMITRKAGPALAAGCTMVLKPASQTPYSALALVELAHRAGIPAGVLSVVTGSAGEVGGELTGNSLVRKLSFTGSTEIGRQLMEECAKDIKKVSLELGGNAPFIVFDDADLDKAVEGAIISKYRNNGQTCVCANRIYVQDGVYDAFAQKLAAAVAKLKIGNGLEEGTTTGPLIDGKAVAKVQEHIEDAVGKGAKVLSGGKLIEGNFFEPTILVDVPKTAAVAKEETFGPLAPLFRFKDEAEVIAMSNDTEFGLASYFYARDMSRVFRVAEALEYGMVGINTGLISNEVAPFGGIKASGLGREGSKYGIEDYLEIKYLCISV

SEQ ID NO: 12868 - protein, 150 aa, Sinorhizobium meliloti 1021
MTLTFASPPQDKAELESGPAFTPRFDEKGLITAVVTDARDGELLMVAHMNAEALSLTLETGFAHYYSRSRDRLWKKGESSGNLQTVREIRTDCDQDAVWLKVSVAGHDATCHTGRRSCFYRTVGVADGEAKVAITDDHRHFDPAQIYAGN

SEQ ID NO: 12869 - protein, 487 aa, Aspergillus oryzae
MPPPVGRYGPTGLSGPYTHLQQAHLQQQQQPQHHPAHAQSANTALPPPSLGGHPGFAAGNPNTNINPFTLSGTGIANGMSVAGFGGAADAGGTGLASHAAQMGFARGAQMQQQQLHQTHDGRLALEAKAGAVKTRIRDVWKHNLAQEMAVLRQLVEKYPYISMDTEFPGIVARPIGAFTNKADYHYQTLRCNVDLLKMIQLGITLFSAEGEVPPPNATDANGQPLGNSLVPAPCTWQFNFRFSLEDDMYAQESTAMLAKAGIDFSMHDKNGIDPFEFGALLISSGLVLLDDVHWVSFHSGYDFGYLMKIMLCKPLPENEEEFHKLLNIFFPSLYDIKYLMKHAGRNQAVNDTPLTPAAAQILTNLGQKSGLQDIADELGVKRVGIAHQAGSDSLVTGEIYWKMRQLVFNGSIDESKYSGQIWGLNGQMPALLYQMPHQTPNLNGATIYSAAGTPSTPNAGTPQHQGLGTLTPGAVGGVLGQFQVGKA

SEQ ID NO: 12870 - protein, 457 aa, Anabaena variabilis ATCC 29413
MRTEWVAKRRGQGNVTQMHYARQGVITEEMQYVAQRENLPADLIREEVARGRMIIPANINHTNLEPMAIGIASKCKVNANIGASPNSSNLQEEVDKLNLAVKYGADTVMDLSTGGGNLDEIRTAIINASPVPIGTVPVYQALESVHGTIENLTPEDFLHIIEKHAQQGVDYQTIHAGILIEHLPLVRSRITGIVSRGGGILARWMLHHHKQNPLYTHFRDIIEIFKRYDVSFSLGDSLRPGCTHDASDDAQLAELKTLGQLTRKAWEHDVQVMVEGPGHVPMDQIEFNVKKQMEECSEAPFYVLGPLVTDIAPGYDHITSAIGAAMAGWYGTAMLCYVTPKEHLGLPNAEDVRNGLIAYKIAAHAADIARHRPGARDRDDELSKARYNFDWNRQFELSLDPERAKEYHDETLPADIYKTAEFCSMCGPKFCPMQTKVDADALTELEKFLAKEKEVMI

SEQ ID NO: 12871 - protein, 229 aa, Oryza sativa (japonica cultivar-group)
MSAHYAFGLQEDDAIIKRRLLTRTTTTRGEPPLKKLQKKFMSFATEVEKDADNISDCERLYKAFLQEINAFVLPLLKSKAVVDANLREKESFNELQDEIQRQILQAQTDIEELKKKLEQSRIERLYKEECEAIRKMISLQPPRSETEKLIAGLEKEIANLEAENTACIRTLELRKKQLSLLLHVVEELQISIEDEQRSIADELRAGAEEQQNMSTDEGSGDASDAMALD

SEQ ID NO: 12872 - protein, 287 aa, Brassica napus
MEEEDGEFRQWDELIPDALGLIFSHLPLQEILTVVPRVCKAWNRAVTGPYCWQEIDIELWSNRCHQSDHLDRMLQMLILRSSGSLRKLSVTGLQNDSIFSFIAQHAGSLKTLKVPRSGLSNSGVVNVAEKLSSLTFLDLSYCCKLGPEAIQAIGRHCKSLIEFSRNMHPLDVASVDSHDDEADAIASTMPKLKRLEIAYHRVSTEGVLKILSSCVSLEFLELRGCWDVQLDNKFFKEKFPDMKVLGPRVIGFYDMINDWEDCCSDYFSDGSDYLAWEFLEDGEMGEF

SEQ ID NO: 12873 - protein, 653 aa, Ureaplasma parvum serovar 3 str. ATCC 700970
MNRYVNAMRSLALQAINKAKQGHSGMSISAAPIVYTLYKGLMTISKSHPKWFNRDRLVLSAGHGSMALYPVFYFSSLLTLDDIKNFRNDNYLTPGHPEVLANNYIDASTGPLGQGVANAVGMAITESYLRTEFATLKGVIDHYTYCIVGDGDLQEGICYEAMSIAGKLKLSKLIILHDSNDYQLDSAVSDVNIEDLKMRVESMGWNYLKTDNNPENIFKAIAEAKWKKNVKPTFIEVKTIIGEGTSFENSNEAHAAAISNDELEKFSKRFHIKTNNFEFHQEIFDHFFFNVVARGESAYNQWQQLVDQYMQTNPEQMQRLLNYINGNYEDLNKLLDENKITNLNDSTRSYLKQYFNQLKDLKSALVLSADLAKSTFTKIGEGAFNDNHKNPYIKFGIREFAMAGAMNGISLHQGVKAIGGTFLAFSDYMKPAIRLAAISNLANLFIFSHDSYAVGGDGPTHQPVDQLPMLRAIPNVEVIRPADHYEVKYALSYSFKQKQKPICLITSRQTIKQINDQKPQDFSKGAYIINSPFSFCKDVDYTIIASGSEVSLANDAAKELFEKHKLKIKVISAFNLNLFLRQKPEDIKSLLASKNGLLAIEASSEMLWWKLSIYTNKFIQIAANQFGRSADGDKLMNEFGFSVKNIINQLLNQ

SEQ ID NO: 12874 - protein, 555 aa, Triticum aestivum
SQKPSFFPLSTSCLPTGSLPAMESVGVAPAPAAVAVAEQKMKLLEPRKEPLASAAAAAAKAPCKWAMKKKLVGGDAGYVLEDVPHLTDYMPELPTYPNPLQDNPAYSVVKQYFVNTDDTVTQKIVVRKNSARGTHFRRAGPRQRVYFQPDDVNAAIVTCGGLCPGLNTVIRELVCGLYDMYGVTSVVGIEGGYKGFYSRNTVTLTPKSVNDIHKRGGTILGTSRGGHDTAKIVDSLQDRGINQVYIIGGDGTQQGASVIYEEVRRRGLKCAVVGVPKTIDNDIAVIDKSFGFDTAVEEAQRAINAAHVEAESAENGIGVVKLMGRNSGFIAMYATLASRDVDCCLIPESPFYLEGKGGLLEFVERRLKDSGHMVIVVAEGAGQDLIAQSMNFVDTQDASGNKLLLDVGLWLSQKIKDHFKKKTNFPITLKYIDPTYMIRAVRSNASDNVYCTLLAHSALHGAMAGYSGFTVAPVNGRHAYIPFYRITEKQNKVVITDRMWARVLCSTNQPCFLSHEDVENMKHDDDERHHLHNTQLLDGSPAKCSPNCNGSAGAE

SEQ ID NO: 12875 - protein, 543 aa, Silicibacter sp. TM1040
MSANPYNTDLDRTPANYQPLTPLMFLERAATVFPEHTAIIHGPLRRSYAAFYARARQLGSALSHRGITRGDTVSALLPNTSAMLECHYGVPMCGAVLHSINTRLDAAIIAFQLDHAMSKVVIVDSEFMPLMQEALALCSVQPLLIEVDDPVYEGARIKTEAVDYDSFIADGDAEFAWLMPEDEWDAISINYTSGTTGDPKGVVSHHRGAYLLAQGNALTTTMGKHAVYLWTLPMFHCNGWCFPWTLSAIIGTHVCLRQVRADQIWNALADEGVTHLCGAPIVMSLMISAPADVQRPLDQTVQFFTAAAPPPEKLLADMKTAGFEVTHLYGLTETYGPAVVNDWHQSWSELPHDEQSRLKSRQGVRYLPLEGLNVLDPETLEPVPHDGETMGEVMFRGNVVMKGYFRNPDATRKAFEGGWFHSGDLGVVHPDGYIQLKDRSKDVIISGGENISSIEVEEALYRHPAIAVTAVVAMPDEKWGETPCAFIELAEGAEIDTDALRQWCRDQLAPYKVPRKFVLTEIPRTSTGKIQKFALREQAKSLC

SEQ ID NO: 12876 - protein, 366 aa, Caulobacter crescentus CB15
MKAAVLREVGKPLQIETVAIGKPGPREVLIRTKAAGVCHSDLHFVEGSYTHALPAVLGHESAGIVEAVGSEVRTVKVGDHVITCLNPYCGHCEVCLTGHMNLCISPETRRSKSDAPRLFKEDLNGATGPMAQFLNLSSFAEMMLVHEHACVAIRKDMPFDRAALIGCSVMTGVGAVMHTSNVRPGETVAVIGCGGVGLATINGAAIAGAGRIIAIDRLAGKLELAKTFGATDVVDASQVDDIAKAVVELTGGGVHHSFEAIGLKATAEASFKMLRRGGTANVIGMIPVGTKIELHGVDFLGERRIQGSYMGSNRFPVDMPRLVDFYMSGKLKLDELISRRIKLEDVNSAFDELKRGELARSVIVFD

SEQ ID NO: 12877 - protein, 410 aa, Arabidopsis thaliana
MMTRRKKRSCSNQKKEEEKSERIPFDLVIEILLRLPVKSIARFRYVSKLWQSTLRGQHFTESYLTISSSRPKILFTCLKDCETFFFSSPHPQDLSPIAANLHMSFPISCPSNICRPVRGWLCGLHQRTTKGTTVTEPLICNPSTGESVVLRKVKTRRKGVISFLGFDPIDKNFKVLCMTRSCIGRADSEEHQVHTLETGKKPSRKMIECDILHYPVPVEHTNGFSQYDGVCINGVLYYLAIVHGVSDDRYPDVVCFEFGSDKFKYIKKVAGHDMEILYLGRRLNSILVNYKGKLAKLQPNMPNNVCTGIQLWVLEDAEKHEWSSHIYVLPPPWRNVYEETKLCFVGTTRKGEIVLSPNTISDFFYLLYYNPDRNTITIVKIKGMETFQSHKAYTFLDHLEDVNLVPIWRM

SEQ ID NO: 12878 - protein, 348 aa, Triticum aestivum
  misc_feature (66)..(66): Xaa can be any naturally occurring amino acid
LCPGLNDVIRQVVFTLATYGVKNIVGIPFGFRGFFEKCLKEMPLSRNLLENINLAGGSFLRVSRGXAKTSEIVHSIQATRIDMLFVLGGNGTHAGANAIHDECRKRKLKVSVVAVPKTIDNDIPLMDKTFGFDTAVEEAQRAINSAYIEARSAYHGIGLVKLMGRSSGFIAMHASLSSGQVDVCLIPEVSFALDGEYGVLQHLEQLIKNKGFCVVCVAEAAGQELLQNSGATDASGNTILSDIGVHMQQKIKTHFKGIGVHADIKYIDPTYMVRACRANASDAILCTVLGQNAVHGAFAGFSGITSCICNTHYVYLPVTQVITAPKRVNHKGRMWHRCLTSTGQPDFR

SEQ ID NO: 12879 - protein, 588 aa, Zea mays
  misc_feature (229)..(229): Xaa can be any naturally occurring amino acid
MAMIDEPLYPIAVLIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKETDIVDWFIPVVKRLAAGEWFTARVSSCGLFHIAYPSASDQLKTELRTIYGQLCQDDMPMVRRAAASNLGKFAATVEQNHLKTEIMSIFDDLTQDDQDSVRLLAVEGCAAXLGKLLEPQDCVAHILPVIVNFSQDKSWRVRYMVANQLYELCEAVGPEPTRADLVPAYVRLLRDNEAEVRIAAAGKVTKFCRILNPQLSVQHILPCVKELSSDSSQHVRSALASVIMGMAPVLGKDATIEQLVPIFLSLLKDEFPDVRLNIISKLDQVNQVIGIDLLSQSLLPAIVELAEDRHWRVRLAIIEYIPLLASQLGVGFFDDKLGALCMQWLEDKVFSIRDAAANNLKRLAEEFGPEWAMQHIIPQVLEKINNPHYLYRMTILQAISLLAPVMGAEITCQKLLPVVINSSKDRVPNIKFNVAKVLQSLVPILDQSVVEKTVKPCLVELSEDPDVDVRYYANQALQACDQMMVSS

SEQ ID NO: 12880 - protein, 575 aa, Photorhabdus luminescens subsp. laumondii TTO1
MISGILVSPGIAFGKALLLKEDSIIINQKKISQEQIEQEISYFKQGREKASSQLEIIKNIAAKNLGEEKAEIFEGHIMLLEDEELEQEIIALIKNDLKTSDAAVYSVIETQAQALEELDDEYLKERATDVRDIGKRLLKNILGIPIVDLGSISEEVILVANDLTPSETAQLNLEKVLGFITDLGGRTSHTSIMARSLELPAIVGTTQATTTIQNGDYLILDAVNNHIYINPSDAEIEQLKKTKNEYLSEKAELAKLKDLPAMTLDGHQVEVCANIGTVRDVIGAERNGAEGVGLYRTEFLFMDRDALPTEEEQFQAYKAVAEAIGSQAVIIRTMDIGGDKNLPYMNLPKEENPFLGWRAIRICLDRKEILHSQLRAILRASAFGKLRIMFPMIISVEEVQELKVELELLKGQLREEGKKFDEAIEVGVMIETPASAVIAHHLAKEVDFFSIGTNDLTQYTLAVDRGNELISHLYNPMLPAVLSLIKQTIDASHAEGKWTGMCGELAGDERATLLLLGMGLDEFSMSAISIPRIKKIIRNTRYEDAKALAEQALSQSTAKGLIALVDTFIKEKTLC

SEQ ID NO: 12881 - protein, 177 aa, uncultured bacterium
MTFDLKDTIRTIPDYPKQGIMFRDITTLLGDARAFRRAIDELVQPWAGTKIDKVAGIEARGFILGGAVAHQLSAGFVPIRKKGKLPYTKVSIAYSLEYGLDEMEMHKDAVAPGERVILVDDLIATGGSAEGAVGLLKKIGADVVAACFVIDLPDLDGAKKIKALGVPVRTLMSFGGH

SEQ ID NO: 12882 - protein, 263 aa, Hordeum vulgare
MSAPGELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKHDSSEGQ

SEQ ID NO: 12883 - protein, 581 aa, Aspergillus oryzae
MVFTPQKGAGELPAIPDNIPISEFMLNDQYGRNPLQKSRDPFTCGITGKSYSGAQVAERVDYLARALAKEFNWAPNQGTEWDKTLAVFSVNTIDTLPLSWATHQLGGIVSPANAAYSAPELKHQLVDSQAKALFTCAPLLSTALEAASLAGFPKDRIYLLEVPAELTGGASIPAQYKTVSQLIEAGRSLPKLERLNWGPGDGARRTAFLCYSSGTSGLPKGVMISHKNVIANVLQISAFEKTHRDALAAPGGPQHTEVVLGLLPQSHIYALVVMCHTGPYRGDQVIVLPKFELKSYLASIQHFKIGSLFLVPPIIITMLRNHEVCKKYDLSSVKSLFTGAAPLGMETAEDFQKMYPGVTVRQGYGLTETCTVVASTHPNDIFLGSSGTLIPGVEARIVSPEGQEITSYDTPGELVVRSPSVVLGYLNNEKANKETFENGWMRTGDEAVFRLSPKGTEHVFIVDRIKELIKVKGLQVAPAELEAHLLTHPAVADCAVIAIPDEAAGEVPKAIVVKSASADKDDEKTIQSIKKYVEEYKARHKWLKGGIRFVEAVPKSPSGKILRRLLRDQEKEERRRAGAKL

SEQ ID NO: 12884 - protein, 459 aa, uncultured bacterium
MLRRIIHIALEPTCMAHKARHNEPKDSSPMSATTGSFSIGNSTVQMPVKTGTVGPSVVDIGKFYAQTGMFTYDPGFTSTASCESEITYIDGDQGVLLYRGYPIEQLAEHGDYLETCYLLLYGQLPTAVQKKDFDHRVTRHTMVHEQMARFFSGLRRDSHPMAVLVASVGALSAFYHDSTDISDPKQRMVASFRLIGKMPTLAAMAYKYSLGQPFIYPRNELDYASNFLRMCFAVPCEDYKISPVLARALDRIFILHADHEQNASTSTVRLAGSSGANPFACIAAGVACLWGPAHGGANEAALKMLMEIGTVENIPKFIARAKDKNDPFRLMGFGHRVYKNYDPRAKIMQKTCHDVLNELGIKDSPLLDVAMALEKIALSDEYFIEKQLYPNIDFYSGITLKAMGFPVSMFCALFAVARTAGWIAQWKEMIEDPSQKIGRPRQLYIGSPRRDYVSIDKRS

SEQ ID NO: 12885 - protein, 1075 aa, Salmonella enterica subsp. enterica serovar Typhi str. CT18
MPKRTDIKSILILGAGPIVIGQACEFDYSGAQACKALREEGYRVILVNSNPATIMTDPEMADATYIEPIHWEVVRKIIEKERPDAVLPTMGGQTALNCALELERQGVLEEFGVTMIGATADAIDKAEDRRRFDIAMKKIGLDTARSGIAHTMEEALAVAADVGFPCIIRPSFTMGGTGGGIAYNREEFEEICERGLDLSPTNELLIDESLIGWKEYEMEVVRDKNDNCIIVCSIENFDAMGIHTGDSITVAPAQTLTDKEYQIMRNASMAVLREIGVETGGSNVQFAVNPKNGRLIVIEMNPRVSRSSALASKATGFPIAKVAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKDAGADRIWYIADAFRAGLSVDGVFNLTNIDRWFLVQIEELVRLEEKVTEVGITGLNADFLRQLKRKGFADARLAKLAGVREGEIRKLRDQYDLHPVYKRVDTCAAEFATDTAYMYSTYEDECEANPSVDRDKIMVLGGGPNRIGQGIEFDYCCVHASLALREDGYETIMVNCNPETVSTDYDTSDRLYFEPVTLEDVLEIVRIEKPKGVIVQYGGQTPLKLARALEAAGVPVIGTSPDAIDRAEDRERFQHAVDRLKLKQPANATVTAIEQAVEKAKEIGYPLVVRPSYVLGGRAMEIVYDEADLRRYFQTAVSVSNDAPVLLDRFLDDAVEVDVDAICDGEMVLIGGIMEHIEQAGVHSGDSACSLPAYTLSQEIQDVMRQQVQKLAFELQVRGLMNVQFAVKDNEVYLIEVNPRAARTVPFVSKATGVPLAKVAARVMAGKSLTEQGVTQEIIPPYYSVKEVVLPFNKFPGVDPLLGPEMRSTGEVMGVGRTFAEAFAKAQLGSNSTMKKQGRALLSVREGDKERVVDLAAKLLKQGFELDATHGTAIVLGEAGINPRLVNKVHEGRPHIQDRIKNGEYTYIINTTAGRRAIEDSRVIRRSALQYKVHYDTTLNGGFATTMALNADATEKVTSVQEMHAQIKKS

SEQ ID NO: 12886 - protein, 145 aa, Pseudomonas putida GB-1
MKTVEQILKTKSQHQTVYTIGPDDSVLDALKMLAEKNVGALPVVEGNQVVGIVSERDYARKLVLKGRSSAATPVREIMSAPVVTVEPKQKLDFCMNLMTDRHLRHLPVVDNGKLLGLLSIGDLVKETIAEQASLIQQMEQYIRGE

SEQ ID NO: 12887 - protein, 337 aa, Zymomonas mobilis
MLSDIEIARAATLKPITEIAGRLNIPDESVLSYGHTIAKLDGEYLNSLSSKPRGKLVLVSAITPTPAGEGKTTTTVGLGDAFNRIGKKAVICLREPALGPSFSIKGGAAGGYAQVVPMERINLHFTGDFHAITSAHDLLDAMIDNHVHWGNEPVMDRNSITFRRVIDMNDRMLRNMVIGLGGKANGYPREGGFDISVASEVMAILCLASDLKDLRSRLERIIIGADNDHNPVRPPRLKAQGSMALLKDALQPNLVQTLEGNPALIHGGPFANIAHGCNSLIATKAALHLGDIAITEAGFGADLGAEKFFDIKCRQANLEPDAVVLVATIRALKIQAW

SEQ ID NO: 12888 - protein, 277 aa, Candidatus Protochlamydia amoebophila UWE25
MSRSGSLMMKQRLVLITGATAGIGQALVHLAAQKELKLLITGRNQEELKKLTDTFGSLIVQAVAADLSQEEGVKTIIDLIHKHCPDIIINNAGFGLYGEALSYSTVQQKHIVDVNVNAVLQLSLEGARALISQVKQGVILNVSSAISFQVAPNMAVYAATKAFINQFSQSLDEELKPLGIRVLVACPGMVKTEFSQNAGMTRTRKFTAVMSSKFVARAIWKQIESLTPLTIIDWKYRLLTWLSYLIPKKIVTAIIKNNIAKRIAPRNVIRLPSCKNK

SEQ ID NO: 12889 - protein, 123 aa, Triticum aestivum
MAARSENESDGDVGTNPAEGGSSLSLPPLAAGPAVCVLRSAGDFAGGAFVGSIFGYGQGLLSKKGLKGSLGNAGSSAKSFAVLSAGRFVVAAFRGMRGLALLMGMSRIDFVDPEDKMSWKILA

SEQ ID NO: 12890 - protein, 495 aa, Aspergillus oryzae
MASITVTGAAGRQIQVPTGLFIHNEFVPSTTSQTLTVENPSTGESLGTISAASPEDVNKAVESATIGFNVWKNTSGPARAKLLLKLADLIERDADDFASLEAVDAGVLYTDSKGMNIPQAVGNLRYYAGWADKIDGKTLAMEGGVAFTYREPLGVCGAIVPWNAPLMITIWKLAPALAAGNSLIIKPSELSPLYAQKLALLIQEAGFPAGVVNIISGDGASAGRALAEHMTVRKISFTGSSATGRQILKTAASTNLKRVNLELGGKGPSIVFDDCDLDNAVLWTRIGITANNGQICAAGSRIYVQKTIYEKFLEAYKKMAEGSPSVIGNPLDPATTKGPIVSAAQHNKILSYIEQGKQCGARLLFGGEKVGDKGYFVENTAFADVSENATIMKEEIFGPVASIAPFETEAEVIAKANDTLHGLSAAVFTNDISRAHRVTAALESGQVTVNAWAMLSPNAPFGGVKESGFGRDMGEEALEGWTSVKSVNWTLDFLG

SEQ ID NO: 12891 - protein, 491 aa, Shigella flexneri 2a str. 301
MNTQYNSSYIFSITLVATLGGLLFGYDTAVISGTVESLNTVFVAPQNLSESAANSLLGFCVASALIGCIIGGALGGYCSNRFGRRDSLKISAVLFFISGVGSAWPELGFTSINPDNTVPIYLAGYVPEFVIYRIIGGIGVGLASMLSPMYIAELAPAHIRGKLVSFNQFAIIFGQLLVYCVNYFIARSGDASWLNTDGRRYMFASECIPALLFLMLLYTVPESPRWLMSRGKQEQTESILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQASGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 12892 - protein, 571 aa, Leuconostoc mesenteroides
MTKNFKGIAASNGVAIAKAYLLVDPDLSFEKTTVTNVAAEQARVDDALKASSDDVKLIKAKATESLGATEAEVFEAHLMVLADPEMSGAIKQKIEDDKVNAEQAVKEVTDMYISMFDAMTDNEYMQERAADIRDVTKRILSHLLNISLPNPALIDEEVVLVSKDLTPSDTAQLDRQFVKGILTDLGGRTAHASIMARTLEIPAVVGSEKATVEVSSGDLVIVDGLTGDVIVNPDADTLATYQKKAADYFAQRAEWAKLKDEKSVSADGKEFIVGANIGAPKDMQAVLDNGSEGVGLYRTEFLYMESDHLPTEDEQFEAYKSVVEQMGDKPVTVRTMDIGGDKHLDYWKLPEEENPFLGYRAIRISLDQTDIFRTQLRALIRASAFGNLWIMFPMIATLSEFRAAKKIYLEEREKLEKAGVATGEVKLGIMIEIPAAAILADKFAKEVDFFSIGTNDLIAYTMAADRGNDRVAYLYQPYNPSILRLINTVISAAHKEGKFVAMCGEMAGDPVAVPLLVGMGLDEFSMSAPSVLQTRSLMKKLNTADMKVLAEKALDVETNDEVIELVKEATK

SEQ ID NO: 12893 - protein, 116 aa, Arabidopsis thaliana
  misc_feature (69)..(69): Xaa can be any naturally occurring amino acid
  misc_feature (75)..(75): Xaa can be any naturally occurring amino acid
  misc_feature (95)..(95): Xaa can be any naturally occurring amino acid
MAPCATTRMTSRISGTRPRVARPFPTDAEVESGYKRCAIRKVSGIAKDQLSRKVTRDSPAITATQSGSXNPGHGXINFVSTLQWENPLMGWTSTXGDPNGIVGYSAHAFESEQTAK

SEQ ID NO: 12894 - protein, 364 aa, Streptomyces avermitilis MA-4680
MSAVSDRLPTFPWDKLEPYKARAAAHPDGIVDLSVGTPVDPVPELIQKALVAAADSPGYPTVWGTPELRDALTGWVERRLGARGVTHHHVLPIVGSKELVAWLPTQLGLGPGDKVAHPRLAYPTYEVGARLARADHVVYDDPTELDPTGLKLLWLNSPSNPTGKVLSKAELTRIVAWAREHGILVFSDECYLELGWEADPVSVLHPDVCGGSYEGIVSVHSLSKRSNLAGYRAAFLAGDPAVLGPLLQIRKHGGMMTSAPTQAAVVAALGDDAHVREQRERYAARRTALRDALLSHGFRIEHSEASLYLWATRGESCWDTVAHLADLGILVAPGDFYGSAGEQFVRVALTATDERVAAAVRRLA

SEQ ID NO: 12895 - protein, 239 aa, Triticum aestivum
  misc_feature (64)..(64): Xaa can be any naturally occurring amino acid
  misc_feature (95)..(95): Xaa can be any naturally occurring amino acid
NNFPPAGKRGGSHPGGARSKRDGASPHLFFPPFSQCGAAQKVLPPGIPPRIAGAGKEFPPKLLXEIRPPLADPGGKVTIEALEKMDLTKSAVWEXLRLDPPVKFQYGRAKADMNIESHDAVFAVKKGEMLFGYQPCATRDPRVFGSTAREFVGDRFFGEEGRKLLQYVYWSNGRETESPSVDNKQCPGKNLVVLVGRLLVVELFLRYDTFTADVGVDLLGTKVEFTGVTKATSGPESAV

SEQ ID NO: 12896 - protein, 103 aa, Glycine max
MSGRVKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 12897 - protein, 502 aa, Glycine max
MTFTNGDAAAASLNKVPTVNFTKLFIGGHFVHSVSGKTFETIDPRTGDVIARISEGDKEDIDIAVKAARHAFDNGPWPRLPGSERGRILLKWAELIEENAEELAALDAIDAGKLYHMCRNLEVPAAANTLRYYAGAADKIHGEVLKMSREFHAYTLLEPLGVVGHITPWNFPNTMFYIKVAPSLAAGCTMVLKPAEQTPLSALFSAHLAKLAGIPDGVINVVPGFGPTAGAALSSHMDVDKVSFTGSTQTGRVIMQAAAKSNLKQVSLELGGKSPLIIFDDADIDKATELALLGILYNKGEVCVASSRVFVQEGIYDEFEKKLVEKAKAWVVGDPFDPKVQQGPQVDKEQFEKVLSYIEHGKKEGATLLTGGKTVGNKGYFIEPTIFSNIREDMLIAQDEIFGPVMALKKFKTTEEAIKSANNTKYGLAAGIVTKNLDTANTVSRSIRAGTIWINCYFAFGDDVPFGGYKMSGFGKDHGLEALHKYLQVKSVVTPLYNSPWL

SEQ ID NO: 12898 - protein, 472 aa, Dunaliella salina
MASRSEESINYEAAGNNSLYNSFLVCGSVFECLSRYSPLKPIGKGAYGVVCSARDSETNQKVAIKKISNAFENLVDAKRTLREIKLVRHLNHENVVQIMDLIPPMVHSNFKDLYVVYELMDTDLHQIIRSPQPLSDDHCQYFLYQVLRGLKYIHSAAILHRDLKPSNLLVNANCDLKICDFGLARSTSSSRVEFMTEYVVTRWYRAPELLLSCSEYGTAIDVWSVGCIFAELLGRKPLFPGKDYVHQLNLITRVIGSPAESELGFISSDKARRYIRSLPRAEPADFMRMWPNANPKAVDLVKKMLMFDPNKRITVEEALAHEYLATLHDISDEPVCANPFNFDLESDDLTPDVVRGIILKDMAALHPSQADGINAAASACLCGASPAQQQEQQATTIPQGAMQQQQQQQEGESSSSKAGPQQQQQQQQQQHEHEQYQKQVPRKEEEKTDGLGGEQGEGMAASSADRGSHSGN

SEQ ID NO: 12899 - protein, 142 aa, Zea mays
MDSLDVVSVKTEVIKGLDGRSISGRKLDVARPSARSIRRHRSAAEAAKYGDKSVYFDLDDIGNTTGQRDLYGSDAPSAYNPLQSKLFETFADPFTKRGLLLKFLLLGDDSLLDYVRAAASPDLLPIKKGPQEPPQPGPGGRI

SEQ ID NO: 12900 - protein, 208 aa, Arabidopsis thaliana
MEGIIVRRVIPSDNSCLFNAIGYVMDKDKNKAPELRQVIAAAVASNKEKYNEAFLGKLNEEYCAWILNPDKWGGAIELSILADYYGREIAAYDIQTSRCDLYGQTRNYDERVMLIYDGLHYDALALSPFEGAEEDFDMTIYPVGKDRSIGSIEGLALNLVKDQQRKRSYTDTANFTLRCGVCQIGVIGQKEAVEHAQATGHVNFQEYK

SEQ ID NO: 12901 - protein, 192 aa, Zea mays
  misc_feature (115)..(115): Xaa can be any naturally occurring amino acid
MENSSHKRAREAGDLVAGGCGEEGSPQADAKRLRPQDLLDMLEDDTDAAAAGDLASVMRSLEEEIASFDEAAEAPAPAPELGFLLEASDDELGLPPAGSAAAASSEEAGRAGAHXAVPPALDGQIWGFEDEIVDGGCFGGYSPEAAAAAAASAAAAAWDDDGFGAGLFAFGGDDACGPSDLAALRHETMPAV

SEQ ID NO: 12902 - protein, 321 aa, Photorhabdus luminescens subsp. laumondii TTO1
MNLYGLVADIGGTNARLALCNLENGVIERIETYSAKQHAGLESIISHYLAEQKTVVTYACIAIACPINGDWVEMTNHQWAFSISELKRTLGLEKLDVINDFTAVSMAIPMLTEEYKLQLGGGEAVKDKPIAVYGAGTGLGVAHLIKVDKQWVSLPGEGGHVDFAANSEEQDAILAVLRRKFGHVSVERILSGSGLVNLYQAIAILDHRQPEDLEPETVTQRALDKSCQYCHRALTLFCEIMGRFGGNLALNMGTFGGVYIAGGIVPRFLDFFRQSNFLHGFEDKGRFKPLVQQIPVYLITHPQPGLLGSGTYLRQQLSLID

SEQ ID NO: 12903 - protein, 256 aa, Sinorhizobium meliloti 1021
MTPDIRPLVAGNWKMNGTRASLDQIKAMAEGVKGDLSARVDALICPPATLLYVATALCDDSPLMIGAQDCHQKQSGAHTGEVSAEMVADCFGTHVIVGHSERRTDHGEGDALVRAKTEAAHGADLVAIVCVGETEEERKAGRTLDILKRQLSESLPDQATAENTVIAYEPVWAIGTGLTPTVSDVEEAHAFMRRELVSRFGAEGGKMRILYGGSVKPSNAKELMGVANVDGALIGGASLKADDFLAIYRAYEELTA

SEQ ID NO: 12904 - protein, 343 aa, Arabidopsis thaliana
MFSRVPAKSIARFRCVSESIHRRPDVTEQSLTKSMSRPRLLFALEVNKDLLFFSSPQPQNPYDNSSLVATPYKRFPKYLPTRICTTLGGLVFLQKWLRKKTRVICNPVSGDYITLPKVKATGVGESYFGFDPITKQFKVLCMTWSRYGTPNTHQVLTLETGKRLWRTIQDPILPHYRSFDRICINGVLYYGADFEESQSSKIVCFDFRFEKFSFINIADEGMFRGSYKWTLFNYKGKLGAHQYSRNGELVLWVLEDAENHKWSKSICILPPIVHNSRIVGVTGTGEIVFSPYACYMPSPFYIFFYNIQTKTCTRVHVKGFEEFKHNFTLLHTFLDFVEDTKFM

SEQ ID NO: 12905 - protein, 270 aa, Oryza sativa (japonica cultivar-group)
MAAEAEQQHQLLSTAVHDTMPGKYVRPESQRPRLDLVVSDARIPVVDLASPDRAAVVSAVGDACRTHGFFQVVNHGIDAALIASVMEVGREFFRLPAEEKAKLYSDDPAKKIRLSTSFNVRKETVHNWRDYLRLHCYPLHQFVPDWPSNPPSFKEIIGTYCTEVRELGFRLYEAISESLGLEGGYMRETLGEQEQHMAVNYYPQCPEPELTYGLPAHTDPNALTILLMDDQVAGLQVLNDGKWIAVNPQPGALVINIGDQLQVTIPLRSS

SEQ ID NO: 12906 - protein, 116 aa, Glycine max
VRGLFFPSIFGAAGQIPPATCWYLGQWVIVGLIFNYFIRRAYFGWWTRYNYVLSGALDIGTALCIVVSALALGLSGASFPDWWGNTVWQNNLDAEGTAVTKTVADDGSFFGPTTWH

SEQ ID NO: 12907 - protein, 424 aa, Sinorhizobium meliloti 1021
MTAIIDIIGREILDSRGNPTVEVDVHLEDGSFGRAAVPSGASTGAHEAVELRDGGTRYLGKGVERAVDAVNGEIFEAIGGLDAENQIQIDRTMIELDGTPNKSRLGANAILGVSLAVAKAAAEASGLPLYRYVGGPNAHLLPVPMMNIINGGAHADNPIDFQEFMIMPVGAETLKDAVRMGSEVFHTLKKQLAADGHNTNVGDEGGFAPGLASAPAALDFIMKSIEKAGYKPGEDMYVALDCASTEFFKDGKYVLEGEGRTLEPGAMAEYLAELAGKYPIISIEDGMAEDDWDGWKSLTDLVGNKCQLVGDDLFVTNSARLRDGIKMGVANSILVKVNQIGSLSETLDAVETAHKARYTAVMSHRSGETEDSTIADLAVATNCGQIKTGSLARSDRLAKYNQLIRIEEQLGPQAQYAGRSVLRG

SEQ ID NO: 12908 - protein, 135 aa, Ashbya gossypii ATCC 10895
MGAWLFVFAFVMNAVSMFLQVHFTIMYADLEADYVNPIELCSKVNRLITPEAGVHAFISLLFLLNGYWFVFLLNLPVLFYNAKKIYHKMQLLDATEIFRTLSKHKRESFLKLGFYLLLFFFYLYRMIMALIAEDN

SEQ ID NO: 12909 - protein, 460 aa, Sinorhizobium meliloti 1021
MPVEILMPALSPTMEEGTLSKWLKNEGDKVSSGDVIAEIETDKATMEVEAVDEGTIGKLLIAAGTEGVKVNTPIAVLLQDGEAASDIDSMKTEAPKAETPKPAAAEAPAASAAPVAAQPKADVPSDPAIPAGTEMATMTVREALRDAMAEEMRANEDVFVMGEEVAEYQGAYKVTQGLLQEFGARRVVDTPITEHGFAGVGVGAAMTGLRPIVEFMTFNFAMQAIDQIINSAAKTLYMSGGQMGAPIVFRGPSGAAARVAAQHSQCYAAWYSHIPGLKVVMPYTAADAKGLLKAAIRDPNPVIFLENEILYGQSFEVPKLDDFVLPIGKARIHRTGKDATLVSFGIGMTYAIKAAAELEAQGIDVEIIDLRTIRPMDLPTVIESVKKTGRLVTVEEGYPQSSVGTEIATRVMQQAFDYLDAPILTIAGKDVPMPYAANLEKLALPNVAEVVDAVKAVCYK

SEQ ID NO: 12910 - protein, 484 aa, Oryza sativa (japonica cultivar-group)
MANIRALLIGLVRARGSLVDIGRCVSSSRPSYLASLGRHYKVPMEIRWLSSTGFPPHLVVGMPALSPTMNQGNIAKWRKQEGEKIEVGDVICEIETDKATLEFESLEEGYLAKILAPEGSKDVQVGQPIAVTVEDLEDIKNIPADASFGGEQKEQSIASEAQKVETDAAKESSIITRISPAAKLLIKEHRLDQSVLNASGPRGTLLKGDVLAALKLGASSSSTKQKNAPAAPSSQPTHDFQAQSVTIPQQNDAYEDIPNSQIRKVIAKRLLESKQTTPHLYLSQDVILDPLLAFRNELKEQHGVKVSVNDIVIKAVALALRNVPEANAYWNNDKEQAQKCVSVDISIAVATEKGLMTPIIRNADQKTISAISSEVKQLAEKARAGKLAPNEFQGGTFSISNLGMYPVDHFCAIINPPQSGILAVGRGNKIIEPVVDSDGTEKATVVTKMSLTLSADHRVFDGQVGGKFFTELSQNFGDIRRLLL

SEQ ID NO: 12911 - protein, 478 aa, Ashbya gossypii ATCC 10895
MEQVDLPNANKIAAGANKASVRVVNGLGALMGSKAMAAVDFEKDSMAEMLARDQREKEHYRHHKHISEQPWTLNNWHLHVNWVNIVLVVVVPIIGLYLALSGRVPPRFEVLALAIVYYSLGGLGITAGYHRLWAHRSYSARWPLRVMYALFGASSVEGSIKWWGHSHRIHHRYTDTPRDPYDARRGLWYSHMGWMLLQPNPRYRARADIEDLMNDWVVRLQHRHYVLIMAFMAFLLPAIICHFIFRDFWGGLVYAGILRVFAIQQATFCINSLAHYLGDQPFDDRRTPRDNWITALVTLGEGYHNFHHEFPTDYRNAIRWYQYDPTKVFIYCASLVGLAYDLKKFSQNAIQQGLIQQKQKKLDNARSRLNWGTPLSQLPVWDRSEFVRASRENSGLVVISGIVHDVSGYITEHPGGETLIQAALGKDATRAFNGGVYMHSNAAHNILATMRVAVVKEGQDAATRFAARRGEALEKKTA

SEQ ID NO: 12912 - protein, 445 aa, Mortierella alpina
MATPLPPSFVVPATQTETRRDPLQHEELPPLFPEKITIYNIWRYLDYKHVVGLGLTPLIALYGLLTTEIQTKTLIWSIIYYYATGLGITAGYHRLWAHRAYNAGPAMSFVLALLGAGAVEGSIKWWSRGHRAHHRWTDTEKDPYSAHRGLFFSHIGWMLIKRPGWKIGHADVDDLNKSKLVQWQHKNYLPLVLIMGVVFPTLVAGLGWGDWRGGYFYAAILRLVFVHHATFCVNSLAHWLGDGPFDDRHSPRDHFITAFVTLGEGYHNFHHQFPQDYRNAIRFYQYDPTKWVIALCAFFGLASHLKTFPENEVRKGQLQMIEKRVLEKKTKLQWGTPIADLPILSFEDYQHACKNDNKKWILLEGVVYDVADFMSEHPGGEKYIKMGVGKDMTAAFNGGMYDHSNAARNLLSLMRVAVVEYGGEVEAQKKNPSMPIYGTDHAKAE

SEQ ID NO: 12913 - protein, 130 aa, Triticum aestivum
MESKAFVSVTFLIVTLLLCRTIQSRSCRSDEKTTEKTMILGGVHDLRGNQNSGEIENLARFAIQQHNNRKNKVLEFKKIVKAREQVVAGTMYYLTLEANEGGQAKNFEAKVWVKPWMNFKQLQEFKESSS

SEQ ID NO: 12914 - protein, 337 aa, Zea mays
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 12915 - protein, 578 aa, Tortula ruralis
MGNSCVGAAGYFQGFTSVIALGGRSSRSPSEVSPTPSKAESRGGSRAEAESPETQRKPPRPAHIPAVEPAETQQFKEVIEAMKKGREMKPVPGQSLTHSVLQRKTENLRDLYVLGKKLGQGQFGTTYLCIEKATNREYACKSIAKRKLISKEDVDDVRRELQIMHHLSGHPNIVMIKGAYEDPASVHLVMELCAGGELFDRIIQRGQYSEAKAAVLTRTIVGVVETCHSLGVMHRDLKPENFLFSSTKEDAALKTTDFGLSVFFKPGEVFRDVVGSPYYVAPEVLRKNYGPEADVWSAGVILYILLSGVPPFWAETEQGIFEQVLKSELDFASDPWPKISDSAKDLIRKMLTPQASKRLKAHQVLAHPWICEDGVAPDRPIDSAVQSRLKHFSAMNKLKKIAIRVIAESLSEEEIAGLKEMFKMMDTDNSGSISYEELKAGLKKVGSNLKEEDVRQLMDAADVDGSGAIDYGEFLAATLHLNKVERDENMFAAFSYLDKDNSGYLTVDELQHALAEFNMGDVSVEELLREVDQNNDGQIDYTEFVTMMRKGNMGGGAGRSSLRNSQQLSLTDVLGIGG

SEQ ID NO: 12916 - protein, 945 aa, Arabidopsis thaliana
MTSMIVKTTPELFKGNGVFRTDHLGENRMVSRSNRLGDGSNRFPRTGTIHCQRLSIAKTGLHRETKARAILSPVSDPAASIAQKILERNYHRSLGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQGEDVVAGIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 12917 - protein, 781 aa, Zea mays
MPHPPRATTTMASSPPPPRQEEDQQREEGHHHGDGGDDDQITTPLLVEAATTSSPSPSEGDDPENSPIEQVALTVPVGDDPSTPVLTFRMWVLGTASCALLSFLNQFFWYRKEPLTITAISAQIAVVPLGRLMAAALPARAVLRGTRWEFSLNPGPFSVKEHVLVTIFANSGAGTVYAIHVITAVRVFYGKHITFFVSLLVVLTTQVLGFGWAGIFRRYLVEPAAMWWPSNLVQVSLFRALHEKERRVKGGMTRNQFFLVAFVCSFAYYVFPGYLFQMLTSLSWLCWAFPRSVVAQQLGSGLSGLGVGAVGLDWSTISSYLGSPLASPWFATANVAAGFVLIMYVITPAAYYWLGLYGARSFPIFSDGLFTAAGQTYNISSIVDSNFRFDTEAYERNGPLYLSTFFAVTYGVGFASLTATVVHVFLFHGSEIWQLSRSAFQEKKVDVHTRLMRRYRQVPEWWFICILVANVAVTIFACEYYIEQLQLPWWGVLLACAIAFFFTLPIGIITATTNQTPGLNIITEYIMGYLYPGRPVANMCFKVYGYISMTQALAFLQDFKLGHYMKIPPRTMFMAQVVGTLIAALVYIGTAWWLMDSVPNICSTELLPADSPWTCPMDHVFYDASVIWGLIGPRRIFGDLGTYSAVNWFFLGGAVAPLLVWLAHRAFPSQSWILLVNMPVLIGSTGMMPPATAVNYTTWIIAGFLSGYVVYRYRRHWWERHNYLLSGALDAGLAFMAVLIYLCLGLENVGLNWWGNDLDGCPLASCPTAKGIVVEGCPVYT

SEQ ID NO: 12918 - protein, 647 aa, Zea mays
  misc_feature (333)..(333): Xaa can be any naturally occurring amino acid
  misc_feature (369)..(369): Xaa can be any naturally occurring amino acid
  misc_feature (412)..(412): Xaa can be any naturally occurring amino acid
  misc_feature (421)..(421): Xaa can be any naturally occurring amino acid
MKTEMVATGGTDAVLNLWHDSTMEDKQEDFRKKASETCYCYTLSIYNCKQDACFWKKNYEISDIRSCINIEEEVLRGQELENAVSDSDYAKAIQLAFELRRPHRLLDLFSKLARRADAEDPIEKALLGLPTDGLRVLLEYVREWNTKPKFCHVAQFVLFRLLRSFSPTDILEIKGISELLEGLIPYSQRHFSRVDRLVRSTFLLDYTLMRMSVSLGVLDLYHRSPARRENLAYQEGEVLSKSAMPNVLCKSRSNATHGHSQSENVGNRFSDVDAATTTDVNALFDTRQTLLMKGFSNKWCDWIEAFTQRGHVNIKINDQLTNNFQTKKGLRQXDPLSPVLFNVIVDMLVTLINRAKREGHIEGVIPHLXDDGLSILQYADDTILFMDHDLDKARNLKLILCAFEQLSGLKIXFHKSEIFCXGDAKEHEQAYSDLFGCKAGAYPFRYLGIPMHFRKLRNAEWNSVIERIEKKLNSWKGKHLSVGGRLVLINSVLSSLRVYMLSFFEIPRKVLEKIDFLRSRFYWQSEDEKKKYRLAKWGVLCQPKEVGGIGIKNIDSQNKCLLVKWLFKLANEEGMWQQILKRKYFRNKTIGEVQVLYRGTYWCRFWAQLQRHEEDAKVIREACRKLETTVMQIFAFHGWQFSNRIAL

SEQ ID NO: 12919 - protein, 419 aa, Vibrio angustum S14
MPKLNLHRPDYVTSMLGQLSSSQLHQRLDPIVTPPIKKLPRNPYVSDRTIAKRWEVLNNINSQTVLYDTETQQQQHCYEKNIENFIGSVKLPLGVAGPLKVNGLFASGEYFVPLATTEAALVASYHRGALLISAAGGASAILLNEGVTRAPGFAFESLVQASKFITWVTTQYDTFKTIAESTTRYGKLSDINLSMEGNHVYLVFEYLTGDASGQNMVTISTNAVFEYILANTPIKPVEAFLDCNLSGDKKATAQTLRSVRGKKVTAEVHLSRELVKKYLHTTPEKMVDFGKMTTVGGALSGTIGVNAHYANALAAFYIACGQDAACVAESSVGITRMELNQQDGLCVSVTLPNLMVGTVGGGTHLPSQKACLELLGLYGSGHSQALAEVCAALCLAGELSIIGAFCSGHFAKAHHRLAR

SEQ ID NO: 12920 - protein, 170 aa, Ashbya gossypii ATCC 10895
MSTPARRRLMRDFKRMKEDAPPGVSASPLPDNVMVWNAMIIGPADTPYEDGTFRLLLEFDEEYPNKPPHVKFLSEMFHPNVYANGEICLDILQNRWTPTYDVASILTSIQSLFNDPNPASPANVEAATLFKDHKSQYVKRVKETVEKSWEDDLKDMDDGDDDDDDDDDDD

SEQ ID NO: 12921 - protein, 435 aa, Streptococcus pyogenes serotype M6
MSIITDVYAREVLDSRGNPTLEVEVYTESGAFGRGMVPSGASTGEHEAVELRDGDKSRYLGLGTQKAVDNVNNIIAKAIIGYDVRDQQAIDRAMIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 12922 - protein, 613 aa, Arabidopsis thaliana
MASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYA

SEQ ID NO: 12923 - protein, 664 aa, Bacillus cereus G9241
MTQNINQLAVNTLRTLSIDAINAANSGHPGLPMGAAPMAYALWANHLNHNPNHPKWFNRDRFVLSAGHGSSLLYSLLHLAGYDVSIDDLKSFRKLNSKTPGHPEYGHTSGVEATTGPLGQGIANAVGMAMAEAHLAAKFNKDGHSIIDHNTYALVGDGDLMEGVAYEAMSMAGHMKLGKLIVLYDSNEISLDGELNIAFSEDMQKRVESAHWQYVRVEDGNDVDAITKAIQLAKDNTDQPTLIEIRTVIGYGSPKVAGTNKAHGNPLGVEEATATKQVYGWHYEEDFFVPKEVTAHFNDLKQKGIEKENEWNEQFNVYRESNPALADELEKAITGEVLIEAKDILSFDTEKTISTRVASGEAINHYVKSIPSIFGGSADLSHSTMTDIKGEAVYAVESYAGRNIYFGVREHAMGAAANGLALHGGVKPFVSTFFVFNDYLRPSIRLAALQKLPVTYVFTHDSIAVGEDGPTHEPIEHLAALRAIPGLTVIRPSDANETANAWAYALQQTDGPVALVLSRQNLPVFDETRTNIEDLSRGAYILTQTNENPEVILIATGSEVSLAVNAKVQLEQEHISVCIVAMPSWELFDRQSKEYKESVLPSSITKRVSLEMGISLGWERYVGQEGKVLSIETFGASGTGAEVMNLFGFTTENVVQITKNVLHS

SEQ ID NO: 12924 - protein, 438 aa, Arabidopsis thaliana
MGSRDFISSLPDEVLGKKILSLLPTKLVVSTSVLSKRWRNLFHFVDSFDLEDSTPIRNADSFSDFMKDTVALLSNCPIKRLTLNSHYEKSSVNRWIRSALKRGCLELNLQSQYDHYLDIGIFFRNNTLVKLTLSSYRTFLRGNVPPEGRVFFPALKTLSLGAVVAKPALYNWLISGCPVLEELFILDVGSGDDQPTWTRSVVSASIKRLTIVFHFPHNTYPYEDDVEIKTPNLEFLDYSALRSDGSDVDYLDSLAEARLDLRLWELTNTFDFGEVTNLVSAIRNVKTLHLSSSSLEAFYYRCYTMPVFDKLIHLSIESDKENGWQALPRLLLKSPNLQTLAIKGLLHKVTYRCGNACACTSKPKKGRCCLSTCRVKVLEISGYGGSLREVKQMEHFLRKLKYLETVKIGVEEDNDSEHLRTELMTLDIASSKCNIQFI

SEQ ID NO: 12925 - protein, 227 aa, Arabidopsis thaliana
TNEGEREFMFYRNPSADMLLEESELDFDLIKKAKIFHYGSISLITEPCKSAHISAAKAAKEAGVILSYDPNLRLPLWPSADNAREEILSIWETADIIKISEEEIVFLTKGEDPYDDNVVRKLFHPKLKLLLVTEGPEGCRYYTKDFSGRVHGLKVDVVDTTGAGDAFVAGILSQLANDLSLLQDEERLREALMFANACGALTVKVRGAIPALPTKEAVHEALLKAVV

SEQ ID NO: 12926 - protein, 505 aa, Oryza sativa (japonica cultivar-group)
MGHELWVLWATLAVSLLCYLYLTSHRLGSRRRRWPPGPRPLPLLGNLLDLRGGNLHHTLARLARAHGAPVMRLQLGLSPAVVISSPGAAREAFTAHDRRLAARAVPDANHALGFCDRSMIWLPSADPMWRTLRGVVAAHAFSPRALAAARAVHERKVRDLVAYLRGRAGREVDVKDAVYGGVLNLVSSALFSADVVDVGGESAQGFRELVEELIESIAKPNVSDLFPFLRRFDLQGWRRWTSGHLAKIYKVLDDIIDRRSAEDDAAMDKRGDFLDVLLELMSTGKIAREYLTNILFDVFTAGSDTMSLTVVWAMAELLRNPGVMAKARAEIDAALGGREAVEEADVARMPYVQAVLKEAMRLHPVAPVMLPRKAAEDGVEIGGFEVPRGCAVIFNTWAIMRDPAAWERPDEFVPERFVGRSRATEEMDFRGKDFGFLPFGSGRRLCPGVPMAERVLPLIMASLLHAFEWRLPDGMSAEQLDVSEKFTTANVLAVPLKAVPVVIAC

SEQ ID NO: 12927 - protein, 393 aa, Pelargonium x hortorum
MTIPATRKDLMIVNMGPHHPSMHGVLRLILTLDGEDVIDCEPVLGYLHRGMEKIAENRTIIQYLPYVTRWDYLATMFTEVITVNAPEQLGNIQVPKRAGYIRTIMLELSRIASHLLWLGPFMADIGAQTPFFYIFRERELIYDLFEAATGMRMMHNYFRIGGVAADLPHGWIDKCLDFCNYFLTGLAEYEKLITRNPIFLERVEGIGIIGKEEAISWGLSGPMLRASGMQWDLRKIDNSECYKKFDWEVQWQKEGDSLARYLVRIGEMRESIKMIQQALEGIPGGPYENLEIRCFDRERYPEWGGFEYRFISKKPSPTFELPKQELYVRVEAPKGELGVFLIGDRSSFPWRWKIRPPGFMNLQILPQLVKRMKLADIMTILGSIDIIMGEVDR

SEQ ID NO: 12928 - protein, 985 aa, Bacillus clausii KSM-K16
MARQFEVTLNGKKETVTNPRSLLTFLAEKKVEVPSLCYHPSLGAIETCDTCIVEVNGEFVRSCSTDIKPGDTIHTKSAGVHEAQLIAMDRILGNHELYCTVCDYNNGNCEIHNAVKEMKMTHQETEHSSKKAEVQRNAFYRYDPDQCILCGRCVEACQDVQVTETLSIDWSLERPRVIWDKHSPIDESSCVNCGHCSTVCPCNAMMEVGMEGEAGYLTAIKENSMRPMINITKNVETGYQSLMAVSDVEAIMREERINKTKTVCTYCGVGCSFDVWTKGRQILKVEPQPEAPANGISTCVKGKFGWDFVNSEERLTKPLIREGDGFRETNWEEALDVIARKFKEAIDQNGPDALAFISSSKCTNEESYLMQKLARAVVGTNNIDNCSRYCQSPATKGLWRTVGYGGDSGGIEDIAKAGLVISIGSNTTESHPVLATRVKRAQKLHGQKVIVADIRKHELAERADVFIKPAPGSDLVWLSAVTKYIIDQGWHDEAFLRKHVNNVQTFIDSLAVYTLDYAEKATNLSKDEMIAVATAIHEADTTCILWAMGVTQHGGGSDTSTAISNLLLVTGNYMKPGAGAYPLRGHNNVQGASDFGSMPDRFPGYQFVSDDEVRQRYEQKWGVKIPAEPGLNNHEMVDAIHEGKLNILYLKGEDMGIVDSNANYVQAAFEKLDFFVVQDVFFSKTAQFADVVLPASPSLEKEGTFTNTERRVQRLYQVLEPLGDSRPDWMIIRDIANRLGAAWSYKHPSEIMDEAASLAPLFAGVRYDRLEGYNSLQWPVAEDGTDTPLLFKDKFPLPEGKAHLYPVTWTKPLEFGDEYDIHVNNGRLLEHFHEGNLTYRSKAISGKTPEVFLEVSKELAKDRGITDGTKVRLTSPYGSVKVRCVVTERVAGKEVYLPMNTSGEGAINYLTSSHSDKDTDTPAYKEVAAKLEVLEPQGKNPLPKTNHRYGNPQPQIGVRVQEKWARKDYVFPGDVVKERRAQSNG

SEQ ID NO: 12929 - protein, 548 aa, Zea mays
MAKSTVSLLNRSANFASRTSQDAVDGLSDESDGETSTKKKRTPRRGRKKATVETSRDVGEEIEVITEQTAAEETKEVKRRGRKKAATSASSEEEKDKAKEPKKRGRRKVKTVEEPIDNAGEHLSKDLMLYNEREDQTRLQNSASVLESKIASVLHEDIGEVDDLIPLVCCFGPAKYSFIPSGRPANRLIDHEIHDRMKDMFWSPDKFVRAPGGSSSNVALALAAIGGRVAFMGKLGDDDYGQSLLYHLNINGVQTRAVYMDPSAPTAVSLMKVRTEGSLKTNCVKPCAEDRFLPSDINPAVLKEAKMFYYNSSALLEPTTESSLLKAIDVSKKFGGTIFFDLNLPLPLWSSSKETKSLIKEAWEAANIIEVTKQELEFLCGIKPSEKFDTNDNDKSKFTHYSSEVIMKLWHSNLKVLFVTNGTSKIHYYTETHNGWVRGTEDAPITPFTGDMSQSGDAIVAALMRMLVINPHLITDKVYLHKAVKHAIKCGVIDQWVLARERGFLPKERADPTGEQYEVRSITEREYRTLPDAMQSENSSTSELAYVE

SEQ ID NO: 12930 - protein, 335 aa, Dehalococcoides sp. CBDB1
MVTRIGINGFGRIGRITLRTINQYHRGELEVVAVNDLADNKSNAHLLKWDSTYGKYAGTVESDDCSIIVDGKPIRVFSERDPMQIPWETAGVDLVIESTGLFTDASKAAAHLRGSVKTVVISAPAKGEDITIVMGVNEDKYNCNTHRIISNASCTTNCVAPLIKVLHDKFGVKKGFMTTCHAYTNDQKIQDMFHKDIRRARAAAVNVIPTTTGAAKAVALVLPELKGKLDGISFRIPSASVSLVDFVGELARDVTVEEVNAAFKEASQGKLSGILEYCEEELVSSDFKGNPASSIIDASSTMVLGGNMVKVLSWYDNEWGYSTRLGDLIAYIAKK

SEQ ID NO: 12931 - protein, 302 aa, Tulipa gesneriana
MAIPVIDFSMLNGSERTQTLAQIANGCEEWGFFELVNHGIPVELLDRVKKVCSECYKMEREEGFKAASEKLLKKMENSGKEDVDWEDVFLLQDDNEWPSNPRDFKETMKAYRAEIKNLAERVMEVMDENLGLDKGYINRAFCGGDTVQQPFFGTKVSHYPPCPRPDLVNGLRAHTDAGGVILLFQDDEVAGLQILKDGRWIDVQPLPNSIVINTGDQIEVLSNGQYKSVRHRVLPTPDGNRRSIASFYNPAMKATIGPATKLVAQAAAVASYPDFVFGDYMDVYAKQKFLAKEPRFQAVRAM

SEQ ID NO: 12932 - protein, 428 aa, Dehalococcoides sp. CBDB1
MSAEVKSIKAREILDSRGNPTVEADVVLSDGSFGRAAVPSGASTGSHEAVELRDGDKSRYNGLGVHKAVANVNTSIASAISGFKASDQQGLDNLLIELDGTPNKAKLGANAMLATSLAVAHAAAASRHMPLYRYLNNSEEYILPVPMFNILNGGKHASNSTDFQEFMVMPVGAKSFAQALQMGTEVYHSLKKVLKGMNQNTTVGDEGGFAPSLPTNKDAVEVILKAIEKAGYRPGEDIFIALDPASSELYQDGKYTLATENKTLSSAEMVDYWCGWVEKYPIISIEDGLFEDDWDGWKLLTRKIGNKVQLVGDDFYVTNIKRLDRGIKEKASNSILIKLNQIGTLSETIAAIKMANNAGWTAVVSHRSGETEDTTIADLAVAMNAGQIKTGAPCRSERTAKYNRLLRIEEELGGKAKYPGKDAFLNLK

SEQ ID NO: 12933 - protein, 427 aa, Photorhabdus luminescens subsp. laumondii TTO1
MADNKATLAPDGSVAIELDVLTPTLGSKVIDVRTLGSQGFYTYDPGFTSTASCESKITYIDGNEGVLLHRGFPIDQLATKSTYLEVCYILLYGETPTQEQFDKFKKTITRHTMIHEQIHRLFNGFRRDSHPMAVLCGVTGALAAFYHDALDVNNPRHRDITAYRLLSKMPTVAAMCYKYSIGQPFVYPRNDLSYAGNFLNMMFATPCEEYKVNPVLERAMDRIFILHADHEQNASTSTVRTAGSSGANPFACIAAGIASLWGPAHGGANEACLRMLEEIQSVEHIPEFIKRAKDKNDAFRLMGFGHRVYKNYDPRATVMRETCHEVLDELGLNDSLLEVAMELERIALHDPYFIEKKLYPNVDFYSGIILKAMGIPSTMFTVIFAIARTIGWIAHWNEMHDGGVKIARPRQLYTGYTKRDFDSQLEK

SEQ ID NO: 12934 - protein, 275 aa, Arabidopsis thaliana
MNLLKTIHYQSTITRFYRFAPTRSFASSVSLSPQRHIISLVSISNRGRCFAFSSVSGASLYNNQEDGKKEESERNYASTKEGDEVVYQKTLRLVECAMFAAVTGLVYFLSNSLAIEVATVMLLFILSGPVKALTYFVSLRFPRLPSRVLSRDHCLTFGDFIFVAYSWSCGACTGIIVEVRALGLIGYVLTSSFLIRENILAVITINIHASLSYVFTAMGLNIMPSMSLIYMIFGTVLLLNSGFFVLLLHLLYSIFLTRLGMKSSLRLPAWLDKAI

SEQ ID NO: 12935 - protein, 278 aa, Trichodesmium erythraeum IMS101
MKYRTLIALLLAVCLSVLTACSETPDSNKPLTYEDIVNTGLANNCPELPETARGFIAIDQSQSYTLTDLCLKPTTYFVKEEPTNKRQKAEFIQGKKLTRYTSTLDQITGELVFNEDNSLTFNEQYGIDFQPITILLPGGEEVPFLFTVKGLSAKSQPNITAINTSTDFQGLYNVPSYRGSSFLDPKGRGVTSGYDNAVALPASSDSQGLVKANVKSAETLLKAGEMSLQITKVDGETGEVVGIFEAIQPSDTDLGAKEALEVKVRGNFYGRVDTDTIS

SEQ ID NO: 12936 - protein, 359 aa, Ashbya gossypii ATCC 10895
MSSRFSLVSNLTRSLSSVGRMQQMRFASSKSMTVRDALNSAMAEEMDRDDDVFIIGEEVAQYNGAYKVTKGLLDRFGERRVVDTPITEMGFAGLAVGAALKGLKPIVEFMSFNFSMQAIDHVVNSAAKTYYMSGGVQTCQIVFRGPNGAAVGVAAQHSQDYTAWYGSIPGLKVLCPYSAEDARGLLKAAIRDPNPVVFLENELLYGESFEVSEEVLSPDFTLPYTSKVEREGTDISIITYSRNVQFSLAAAEILDKQYGVSAEVINMRSIRPLDIDAIIKTVKKTNHLITVEATFPAFGVGSEIIAQIMESEAFDHLDAPVQRVTGADVPTPYAKELEDFAFPDPDTIVRAAKQVLSIE

SEQ ID NO: 12937 - protein, 385 aa, Silicibacter sp. TM1040
MSKRDYYEVLGVSKGASADEIKKGFRKKAKELHPDRNADNPDAEAQFKEANEAYDVLKDPERKAAYDRYGHAAFENGMGGGGGGRAGGHPGGDFSSAFSDVFDDLFGDFMGGGGGRAGARQRATRGADLRYNLRLSLEEAFAGLHKTINVPTSVSCTSCEGTGAEGGAEPTTCPTCSGMGKVRAQQGFFTVERTCPTCSGLGQMIKNPCKTCNGHGRVEKDRSLSVNIPAGVETGTRIRLAGEGEAGLRGGPPGDLYIFIEVARHELFEREGNNLHCRVPVSMAKAALGGAIEVPTIDGGRGRVQIPEGSQSGRQMRLRGKGMPALRGGGTGDMFIELAVETPVNLTPRQKEILKEFDEISEENTNPETRSFFSSVKSFWDGMKG

SEQ ID NO: 12938 - protein, 130 aa, Chlorella vulgaris
MAKLQQLVQAIQSGTIKTELPDVRVGDLVRIGVSIQEGNKQRIQPFEGTVISKHQAGANSTVTVRKSLQGIGVERVFPLYAPCVANLQVLRRAQVSRAKLYYLRSRTGKATRLKEKFETLPQIWMNQNQH

SEQ ID NO: 12939 - protein, 602 aa, Gibberella zeae PH-1
MAADNEGTAASGTNDSRPSGDSNAAQNNDNGNRRNPRHDHRKPGKGRSEKGRGEWGREKGDKRKKNDEFKEFKRRKLNKKGESADGESSNNPFSKDEIAAEERRPKRKVAVMIGYAGTGYKGMQVNGNEKTIEADLFKAFVAAGAISKANADDPKKSSLVRCARTDKGVHAAGNVISLKLIIEDEDIVDKINAELPEQIRIWGLQRTNNAFSCYQTCDSRWYEYLMPSYCLLPPHPETFLGRKLVELAKEHGVEDELTARMADVKDFWTEVEEKEIKPILARLDPETRAAVLEKVHVTDDEEIAARKAAARETDEAEPSEEKPATEAPAEATEQTTEPEAQQSTVVLESHKPKNRELGPIDFALRDIKAAYMAAKRRYRVSTERLERLQEALNMYNGTRNFHNYTVQKSFFDASAKRHIKSFIVNPKPIIINDTEWLSLKVHGQSFMMHQIRKMVGLASLIVRCGTPMERIKESYQNQKMAIPKAPGLGLLLERPVFHNYNRKATESLGKEGIDFDKYDDKIQAFKDKQIYTRIFSVEEKDNSFHMFFNQIDQFKTNHFLWLTAGGMKAAELTRDTTGEKVQRDVDKELGDEDEEDPEGGEG

SEQ ID NO: 12940 - protein, 112 aa, Brassica napus
  misc_feature (19)..(19): Xaa can be any naturally occurring amino acid
CVVLYICFLVMGYGPIPNXFCSEISPTRVRGLCIAICAMVFWICAIIVTYSLPVLLSSIGLVGVFSIYAPVCVISWVFVYLKVPETKGMPLEVITDYFAFGAQASAPSKDDT

SEQ ID NO: 12941 - protein, 398 aa, Methanosarcina barkeri str. Fusaro
MFSINSECVLSKKSEDIPPFYVMEVLESAQALEAEGRHIIHLEVGEPDFPTAPHICDAACAAIGRGATKYTHSQGLPSLREAIVESYQQKFGVELSPDQVIVTSGTSPALLIVFMALLEKMDEVIMSNPHYACYPNFVKYLGGTPVFVYTSETNGFALEPKTVRQCLSPNTKAILINSPSNPGGHVMSPENLQGLAKIADEKRIPIVSDEIYQGLIYGGDEHTILEYTKNAFVLNGFSKLYAMTGWRLGYIICPPECVRAIQKIHQNFFICANSFVQEAGIAALKGPQDHVDEMVHTYNKRRQYMLKRLIGMGLEVRKEPMGAFYVLADARRYGPDSLEMSRRILNEAGVAVTPGIDFGNGAEGYLRFSYANSIENIKEGMDRLEAFLEKELEGLEIL

SEQ ID NO: 12942 - protein, 187 aa, Glycine max
MASFLSLSLPKLNLIKASSAANTNTTTTLPTAETLNEKFGRKGIKFLESDNIPIVELTVRNGSSLRLRIPDAHVTSYKPKVNWKDDGFQEVLYTIPATETGPYKAKGGVGLVMNELLQPGAKGLLPSTLEWTVNDVDSDSIDALQGRGLCFRVIRMGFEDIYLSSPGSLSEKYGKDYFICTGPASIL

SEQ ID NO: 12943 - protein, 278 aa, Zea mays
PDSTSPTYLWDNNCLCLACSNVCFSVSLQAAELEIEAYPLLDELTSKISTLNLERARRLKSRLVALTRRVQKVRDEIEQLMDDDGDMAEMYLTEKKMRMESSVFGDQSLLGYNSAGAVGASVSAPVSPVSSPTESRKLEKSFSLCRSRHDSTKGSDNTMTEHIQELEMLLEAYFVVIDSTLNKLTSLKEYIDDTEDFINIQLDNVRNQLIQFELLLTTATFVVAIFGVVAGIFGMNFETSVFEIENAFQWVLVITSVTGVFIFCSFLWFFKYKRLMPL

SEQ ID NO: 12944 - protein, 393 aa, Listeria monocytogenes str. 1/2a F6854
MDLPLSKRVKGVAPSPTLAITAKAKQMKQEGIDVIGLGAGEPDFNTPQNIIDAAIESMNKGFTKYTPSSGIIELKQAIVDKLKKDQFLNYETNQIFVGTGAKHVLYSAFQTILDPGDEVIIPVPYWVTYPEQVKLAGGIPVFVETGFDADFKISAADFEKAITKKTKAIVLNSPNNPSGMCYTKEELIAIGEVAEKHQIYILSDEIYEKLYYGNKADLVSIASLSDRLYDLTIVINGVSKAYSMTGWRIGYAAANKEIIAGMSKLADHLTSNPTANAQYAALEAYVGSQEVPEKMYKAFEERMERFYPELNSIPGFKPKKPDGAFYFFIEVKEAAHKKGFQDVDAFVAALLEEAKVAVIPGSGFGMPDYIRLSYATNPDLFQEAINRIKSFMK

SEQ ID NO: 12945 - protein, 238 aa, Triticum aestivum
  misc_feature (62)..(62): Xaa can be any naturally occurring amino acid
RALRVFLPQSFPRNATHYFGGHPKSICGAKIPKGQKTRLLLSSASGVKAQDAFERNFFQLKXFNRKPRGILPPSPEEYRILGINLMRLLAENRIAEFHTELELLPPRALDHPCIKYAVELEQSFMEGTYNRLTNGRQAVPHETYLYFMDLLAETIRDEIADCSGQAYDHLPVDDARKMLMFSSEQKLLEHISEIQHEWEVQNHSVLFHMAKVQPRVGIQAHQMIKRSLCYARELERVV

SEQ ID NO: 12946 - protein, 321 aa, Salmonella typhimurium LT2
MSDALLNAGRQTLMLELQEASRLPERLGDDFVRAANIIIHCEGKVIVSGIGKSGHIGKKIAATLASTGTPAFFVHPAEALHGDLGMIESRDVMLFISYSGGAKELDLIIPRLEDKSVALLAMTGKLHSPLGRAAKAVLDISVEREACPMHLAPTSSTVNTLMMGDALAMAVMQARGFNEEDFARSHPAGALGARLLNNVHHLMRQGDAIPQVMLATSVMDAMLELSRTGLGLVAVCDEQHVVKGVFTDGDLRRWLVGGGALTTPVSEAMTPNGITLQAQSRAIDAKELLMKRKITAAPVVDENGKLTGAINLQDFYQAGII

SEQ ID NO: 12947 - protein, 894 aa, Oryza sativa (japonica cultivar-group)
MPPWWGKSSSKEVKKTAKENLIDTFHRLLSPNEQKGRTKSRGNRRHSKDPTAEKGCWSTAQSRSASPSKEVSRCQSFAAARAHAQPLPLPRSRAMVARTASDITESKVVLEKRGKGQQLPLPTTNWVKERPETTEPVAELSTASISSHGSIDSDDPGDLRLQGPVANDTDNVAKVATTGNSSVVHKECSSAITRKGTKEVTMPTNAFLSNQILSTSPRGTVVADSYQSNLQNSRKVVLDSAPNSVMSSPSRSPRILCPDQIPSSAFWAVKPHTDVTFVGSAQCSSPGSGQTSGHNSVGGDMLAQLFWQPSRGSPECSPIPSPRMTSPGPSSRVHSGSVSPLHPRAGGMAPESPTRRLDEGKRKQTHRLPLPPLSICNNSTFLPNNSTPTSPISHSPGRVENPTSPGSRWKKGKLVGRGTFGHVYIGFNSDKGEMCAMKEVTLFSDDPKSKESAKQLCQEILLLNRLQHPNIVRYYGSEMVDDKLYIYLEYVSGGSIHKLLQEYGQFGEPAIRSYTKQILLGLAYLHAKNTVHRDIKGANILVDPNGRVKLADFGMAKHINGQQCAFSFKGSPYWMAPEVIKNSNGCNLAVDIWSLGCTVLEMATSKPPWSQYEGIAAVFKIGNSKELPPIPDHLSEEGRDFIRQCLQRNPSSRPTAVDLLQHSFIRNASPLEKSLSDPLLQLSTTSCKPDLKVVGHARNMSSLGLEGQSIYQRRAAKFSSVHSDIHVRSYISCPVSPCGSPHLRSRSPQHQNGIMSPSPISSPRTTSGASTPLTGGNGAIPFNHARHLAYNNEGFTITSRCLDEPLPNQPPDPVLGRFVRVKQPSLGFQERAVPEADILSPQFGRMGHVSVWNLHDKPLPSEHASQKGFEDRVKLKPPLDLRSGPPHLGCNHGH

SEQ ID NO: 12948 - protein, 4419 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKLLLNGETRPCFKRDSNAFQRYLKCYKRTLLVIATVNSLCRFIGALSNTMEEEPERRKAIALFMAFGTKGDVYPLAAIAAVFARVQQHYTVVLMSHLAHENLSSHLSKAKVSYFPINSPPALSNEPQGTQNVTDSLRKMFLEEKERIKREHRQECHSAFRTIFGKDPCMEGDFVVINFFALEGWSLAEVFQIRCVVAAPYVVPYSPPSGFERQFRKELPDLYKYLKEAPIGKVSWSDVTHWMWPLFTEEWGSWRYEELNLSCYPFADPVTDLPIWHIRPPSPLVLYGFSKEIVECPDYWPLSVRVCGFWFLPNEWQFSCNECGDNPFAGRLGTDDSHTCSNHTELYTFISSCEPALPIFVGLSSVGSMGFVRDPIAFLRVLQSVIQITGYRFIIFTASYGPLDAAIRTIANGSDSSEKQPLHAGISIFNGKLFCFSGMVPYNWMFRTCAAAIHHGGSGSVAAALQAGIPQIICPFMLDQFYWAEKMSWLGVAPQPLKRNHLLLEDSNDEKNITEAAQVVAKAIYDALSAKTRARAMEIAEILSLEDGVTEAVRVLREEVRNRKKYSSCDCEEERRQVFVSSTGKKNPTIFLDSFTLLRPPSLSFFSRRRYLGRYIKDIQKDQLKISLWNGEVLLENVELNPEAFEYLQLPIALKQGRVGKLSIKIPWKKLHRDPVTIMIEDVFICASQRNDQEWSSDVVEKREFAGKKAKLASAELAKLSRRVFDNPGGNSYMSYITAKILDSVQVSIKNFHILYSDAQPESGQVVLGLRFSSLTVTKQNSVGPSVGRVRGGQVNILVEVEGLEIYCDMYEGNMDFPSVNEKIGFDNWCQSRLQSNRFGYLLKPVHVSVTLLVNRSGELYDDLPQYSISAELTDVVVTLNEFQLQQILILLDYLQTSQLRERYGRYRPCSTSLSRKPPGWQKLWWHYAQNSVLSDVRKKLWKTSWRFLEQRIQILLECIQAVCSLLDFCFGEKIQENPQESIDKSIRLGLEELEKKSDIDDILSYRSAAEGEMQEACSELTVNMGATGATRSEKEQSAPEKEPSDDPTLNKSRGWLNWLSRGMLGAGGTEDSSQFSGVVSDEVVKDIHKATKFYPLSSSPRNTSATGKICTCSIRLNVRKFSATLQHISGSSSQVITELDILGVIVECKSWKDSTAMILSVISGRLVYPHNGKEILTMKRVCSQSDTLETKPSYGARLELSKDHDVALSLKATLQPLEAAYDGGFILAVSNFFSGSRYFKLQHERILSSLNGLESETRLAAKAEYLLSSRNKVKWDLDIKDLTLSFPGRLVESESYNLVLVLESLSITSSSTDALSQIPRLQSDVDHVVNSLQSSVEALDAFQVKDLYDHFDIKICNLEMKLMKIHPFQELPLVEKSSLLIKFASCIIPEESILKQLEVEATLPMFNVHFSPSIFKGVMSVIEYLDIQDHGTRNPPPSPAPIFHFTIKTDLAFLRLHVNLENKGENSTVLVLSIQQLDLWYSRAIFEEWSVRAKTLEITACSSKDAADSHILCSSGNLLKSSSHGHGMDAHTSDETNIIDYRTTPEAAISLNCKVSQSKSFIFHKYTVYWRSAELHCYPYIFGLLTNFLDKIASYKISSSYTNPSSLATDTIAPTEIPQFDFERFGFSNFTESRSCGCIPLDKFPFVTINNSGSLHSLESSLCYSTSDWRKLFILKNRKDGAQIGLNCECNSCTFQLKRDCPLNGLASSRDLGQTNHFTVDMHVFNTNVHFHDSSSVFGTIILPVSRYFLNISDDLLDLVASAEDLMLVSSLFTNYSGGFLWKQSSTDVSQVLNLRVRKRGLEPSGSQLEVSIGIQHTYCILPPEYLAIIIGYFSLSDWTSKSGLQSLPQATELTKAHSEFAISYKIEILDSSIVLPVEGDDRRQLKVDIQQLYISFIPECALSNVVQHIPQECVIPLNQVLGRADCLNIFGRDLSVSLLLSESDISTFKKNAVCRSITLAASIIADTWIRFPCDHNPLTELACVMSRVDVCEIVVDDSDALDGFKAFLDVVDQLSLVDEESKLFVSDVPQFLHTKMRLKQELSVAPLEPSTSFIKFRIFVNLLTSKLHRLRKAPGTLLSEPVLQADMKFVCSGELKNNFPMSLDVQFFKIGLYSLLSSVMLARCINADGDPSALRVRFTEQAENEYDLCFSLPSLDIWLHFFDWIEVIELLKSYSQKLEDSSEDRFFSKGSKLDMDESIGVVRTICDNTDRVLNVLQTEVSENSSEVMSFAARSENIGVKIHIPLCTSHTEFPGFMATDVHEISEEEHTNCFKGNYCKYVSVTACSRSGELSILGRDVKLSYKIEKLNGILAISGVDTVRSCSLFGAAQLLVETSIQMDQNKIMSIDVGILSDKVEMHASHQVLSFWHGITFDAPETPSSQNSEGNMSIKVQIRDVSLLISDGKWGCSGMLLEVLMRNFLLQANLAEKNMESLVSCDLEVNYNNMHKVLWEPFIEPWNFDIKLSRKFDANSLLNNAGLTEVIVASSNQLNLNLTESLFECIFRIIEMLNILELMETDAIPDNKGLSVYCTNSTRTERYSPYVLQNLTSLPLGYQVFQGHDSDVLNISAPVAQNFVQPGCSVPIYIDNSDTLLIPDRRRSQFGCSSSESGDAIHHYMKVQLDGTSFASPPHSMDRIGLSYFEVDFSKTSNSSDNVEKASKSGYGSSFVVPVVYEVSLQQQSKLIRVYSTVIILNSTSMPLELRFDIPFGISPKILDPIFPGQEFPLPLHLAKSGRLRWRPLGDSYLWSEAHSISKVLSQDSGIGFRRSFACYPCHPSHEPFRCCISVQSTSLPASFHINDLSAGNFGQQLHNLDQSREQFIHQVTLSTPFVVSNCLPDPISLSIESGGITQTASLPEGETPFHHIDPSHDLVLEFKLNGCRTSSLKFSRSETFSTEAKFSGGKFSQIETISFDSHVGGGSVYVSCEKTMDATCGAREVLIFVPFLLYNCTGTPLIVSDCTNETKGIYSVIPSCYNLIEQHFVQSRKVGLGILTSEKDLLDKAVMEDIPCSPSSSECSNTASSTERFIDKHATQSTRQVPFAAYPKDSAIVRKRSLSSKSLREVCFQGNDESGKVKACIYSPCPISRVSDTMIRVKRDLPGWVNSSSPYPLWSAPFPLVPPSGSTNVVVPQPSPGESSLLSVTCSILGGALAGRTQAITFQPSHNLCYKQKGTNLVSHLAVGQHSQLQWTDTTRELLVSIRLNEPGWQWSGSFLPDHLGDTQLKIWNYVNKAFNMVRVEVQNANMSSGDEKIVGSVHGHVGTNFILLSDDDMGYMPYRIDNFSNERLRVYQQKCETFDTIVHPYTSCPYAWDEPCYPHRLTIEVPGDRVLGSYAFEITKQPIAVHLRSTSEKPERTLLLSICAEGATKVFSVVDSGYHAIKDIKETFDSRFHEKGKKKLQTDNIIRYTETFLLVLPSIGISLVNSHPQELVYACASNVVLELSQSVDQQKLSFQISSLQIDNPLQNSSYPVILSFNHDHEVIPPDWGMKNNKAILLSEIVQQVRGNSCDAVVYVDLAKWRKKDVSLVSFEYINIRIGEFGLELELQTLLSLLEFVKAVLPNSQARLLPLSDPTLRPLIYDTGSKDISSEDTPHARNIPVFNKNQRSIVALPIVVPIGAPWQHIHLLARRRRKIYVETFDLAPIQFTLSFCSAPWMLRNGILTSGESLIHRGLMALADVEGARIHLKQLTIAHQITSWESFQEILVGHYTRQILHEIYKVFGSAGVIGNPMGFARNVAFGIKDFLSAPSRSISKSPAGIIQGMAHGTTSLFSSTIYALSDAATQFSKAAHKGIVAFTFNDHDVARMEKQQLGEGSRSKGVIGEVFEGLTGLLQSPIRGAEKHGLPGVISGVAMGITGLVARPTASILEVTGKTAQSIRNRSRIHNIRSQRHRLRLPRPLSREQPLRPYSWEEAVGTAVLMEVGDSLKFKGEKLVKCKALKQEGAFVVITGRLVLVLSSLSLVDFRKQGFLGVPIDLVWNIEREIGLESVIHTDCSGGVVRIIGSNSDGVWNWRQDQQKKSSPTKKRWNNPSAQPLLQTNLEFPSEEEAEDLLSVLLSTIETGKSRSWHSRFVLSRSNIT

SEQ ID NO: 12949 - protein, 491 aa, Arabidopsis thaliana
MDDCSKDIINCLPDNLLCQILSNLSTKEAALTSLLSKRWRYLFALVPNLDFDVLPSLHPEVAMQDQDQTSFIDFVDRVLKLRGKDHINKFSLKCGDGIEDEDVFPWILNTLRHGVSDLSLHVSPSLVYWLPSKVFASKTLVRLKIGPKDGPRVKLRNVCLPKLKTLNLDSVVFEEGKIGFAKLLSGCPVLEELSLLNLAWDRWDSCSVSSKILKRLTLYCAHSSRNPKSVSFDTPNVVYFEYSDNIANKYPKVNFDSLVEASIGIRMTKVQKANARYVSDVDEETEMVGNATDLLMGICNVKTLYLSYDTLETLNLCCQVIPVFNNLTHLTIESHPELGWESLPNLLKSCPNLGTLVFQGLLHKATDRCGDVCMCQGLENSHSCLSSSPVKCLKILKFGETNDDDDMEIEMEQIKNFLEKMPNLEQLIIYYESSIDNDLVRVSSQLQEVPTVASLKCKIQNLTGFVELVMRSCLDYHLEAIYGCAHGYKYL

SEQ ID NO: 12950 - protein, 425 aa, Oryza sativa (indica cultivar-group)
MQVELADRAAARPSETGEAPPSSPAAAAAASAAAEDAPLLPGGGGGVRRRVVVSERFRQRSGSFRREVRRAAEETYLLTRLTLILLRYLGIGYRWIRQFLALCCYTFLLMPGFIQVVYYYFFSSQVCRSVVYGEQPRNRLDLYIPTDRTALKPVVAFVTGGAWIIGYKGWGALLGRRLAERGILVACIDYRNFPQGTIGDMVEDASQGIAFVCNNIASYGGDPERIYLVGQSAGAHIAACTLLHQAIKESGEGDASTWSIAQLKAYFGISGGYNLLNLVDHFHKRGLYRSIFLSIMEGEESLQKFSPLVMVKDPAARSAVSLLPRIFLFHGTSDYSIPSAESEAFFDALQQNGAKADLFLYDGKTHTDLFLQDPLRGGRDKLLEEIVTVIHNDNPDTSAQHLAVPVARRLVPEFMLMLAGRVSPF

SEQ ID NO: 12951 - protein, 133 aa, Brassica napus
MGFSDAGICHSDQNNLGQTEIGLLRVPSIGFSDRSVQVFRPDQDLETKVRELTNCSPEGVKNEEEEELCKTPTRLDQILPNIPNICPPAPRKPKGIQSRSLKVRDSYKSRRMIILNVSREIDCMFHSASLGNK

SEQ ID NO: 12952 - protein, 220 aa, Oryza sativa (indica cultivar-group)
MAGSGWRRIPAARRPPMSRPASVCLWIVLVAATLALAQAKKSKADLTEVTHKVYFDVEIDGKPAGRVVMGLFGKTVPKTAENFRALCTGEKGTGKSGKALHFKGSAFHRIIPSFMIQGGDFTLGDGRGGESIYGTKFADENFKIKHTGPGLLSMANAGRDTNGSQFFITTVTTSWLDGKHVVFGKVLSGMDVVYKIEAEGQQSGSPKSKVVIADSGELPM

SEQ ID NO: 12953 - protein, 337 aa, Zea mays
  misc_feature (45)..(45): Xaa can be any naturally occurring amino acid
  misc_feature (49)..(49): Xaa can be any naturally occurring amino acid
  misc_feature (62)..(62): Xaa can be any naturally occurring amino acid
  misc_feature (74)..(74): Xaa can be any naturally occurring amino acid
GYTGAERELGEPVWYRAAEIDEKASMESKLSTAAAFVEGGVKDAXDGAXSICLNAFCDTIPXTMTKYKYDDHVXCILACCQRSSQCPMCWQHISMKDPMSQELLEAVEQERNIRANPSRNTAVFHHQMLGDFEIPVGADDAELEERIIQHLAAAAAVRRSHRHHNRRDGHQSRSEASSHPQFLVLSADERTISGQEGDYEQASAVASGRPLRTLVEQERTRGLADASSPSLRCSTPADSTGRSNNRISGIESTPVDQDGTGPSALQSMVQGFHNQSASGWRERWFSRSNSLLDLGSEVRREVNAGIAAVSRMMEWHDARDGTGAGPSPTSASRSGSQ

SEQ ID NO: 12954 - protein, 887 aa, Methanothermobacter thermautotrophicus
MKGTVKFRIDGREVEAARGMTVLEAALANGIYIPNLCFREGIEPFGGCRLCLVENNEGRLVTACETPAEDGSEFISESERINRIRRTTLSLIIADHSRDCLACPASGDCRLQELSSYLNVSDGDLERLRPELSGIDVDESNPFFLRNHDKCILCGICVRVCRGLGAEAVDFAYRGHDTRIATFMDRDILDSSCVSCGECVEACPVGALLPRTERPSTEVRTVCPYCGAGCEIYLGVRGNRVVSSRGVPDSPVNQGRLCVKGRFALKFVNSPERLKKPLIKVDGEFVEVEWDEAISVVAERLSEYTGEEFAAVASAKCTNEENYLLQKFTRAVMGSGNIDHCARLCHAPSLTGLRMSLGSGAMTNSISELGAAGCILAVGTNPTETHPVTSYRVIRALRSRARLVVVDPRKTRLSELADIHLQNRPGSDIPLLMAMCRFILEEGLHDSEFIDSRTEKFEDFRDAVMALDLDEVERITGVNVKDIRRAAIMYASNSPASIIYSMGITQHVNGTGNVLALSNLALLTGNIGIKSAGINPLRGQNNVQGACDMGALPDLLPGYQGIGEAAGKFSEKWGSPIPPAGLTLPEMFDAARDGKIRCMYIMGENPLLSEPDIERTREALEGLEFLVVQDICLTETAELADVVLPAASFAEKDGTFTNTERRVQLLRKALDAPGDALPDWQIISMIAGRMGREDFDYESASRIFDEIRELVPSYAGISHERLKSGGIQWPCTSEEDAGTGYLHSEEFPTPTGRASFLLPDYQFRGVPEEYPLVLVTGRNLYQYHTRSMTARVEELESFSDHEELLMNPADASSMGIREGDTVEVTSERGSLRVRAGVTDEVMEGVVFMTFHFADAPANVLTGGDRDPFSGMPGLKFTPVRVCRVQLR

SEQ ID NO: 12955 - protein, 427 aa, Methylobacillus flagellatus KT
MQQHELSSSRFVSTLTKNTVALILAGGKGSRLRDLTNWTAKPAVPFGGKFRIIDFPLSNCINSGVRRIGVVTQYKAHTLIQHIQRGWGFLRGEFNEFVELLPAQQRIQEEWYKGTADAVFQNLDILRQTNIEFVLILAGDHVYKMDYGQMLAAHVRNKADMTVACINVPLKEASAFGVMGVDENDRVVDFEEKPAHPSSLPDDPDHALASMGIYVFNAAFLYEQLIRDADDPKSSHDFGHDIIPYLIKKYRVFAHRFTDSCVGAADGNYYWRDVGTVDAYWEANMELTKVVPELNLYDRQWPIWTYQEQLPPAKFVFDNEERRGQATDSLISGGCIVSGANVRNSVLFSDVRVNSYSSIEQSVILPKVDIGRHVTLRRVVVDSGARIPDGMEIGVNLELDRKRFHITEQGVVLVTPDMLGQNLHHIR

SEQ ID NO: 12956 - protein, 481 aa, Methylobacterium extorquens
MATDILMPALSPTMEEGKLAKWLKKEGDPVKAGDILAEIETDKATMEVEAIDEGVLAKILVADGTENVAVNTPIAIIAEEGEDVSAAASGGKGKSDGAAGSAPAPTPDMQAEGMADSSAATAKTGDDAQKAPASPAIITNKAPDPVMEEFPADSPMKTTTVREALRDAMAEEMRKDDKVLVMGEEVAEYQGAYKITQGLLQEFGARRVVDTPITEHGFAGIGVGAAFMGLRPIVEFMTFNFAMQAIDHIINSAAKTLYMSGGQLGCPIVFRGPNGAAARVGAQHSHDYAAWYSNVPGLKVIAPYTASDAKGLLKAAIRDPNPVIFLENEILYGQSFPVPEIEDFVLPIGKARVHRPGKDVTIVSFSIGMTYALKAAQALAEEGIEAEVIDLRTIRPMDSATVVESVKKTGRCVCVEEGFPQSGVGAEIVARLMVDAFDYLDAPVLRVTGKDVPMPYAANLEKLALPSVADVIEAVKSVCYK

SEQ ID NO: 12957 - protein, 470 aa, Methylobacterium extorquens
MPINVLMPALSPTMEKGNLAKWLKKEGDAIKSGDVIAEIETDKATMEVEAVDEGVLAKILVAEGTADVPVNELIALIAEEGEDPGSVQAPKGGAEAKTAPVEPKGTPDQNAAPDGSHASYARVDQVPEGAKPNGAAQPAGSGDRVFASPLARRIAKQEGVDLSAVKGSGPHGRVIQRDVQAAIENGTAKAGAAAKPEAKSEGKSAPAPEKSAPKAAAAGGAPAGLSLDQVKGFYEKGSFEEVPLDGMRKTIAKRLTEAMQVAPHFYLTVDCELDALMKLRETLNGSAGKDKDGKPLFKLSVNDFVIKAMGLALTRVPAANAVWAEDRILRFKHAEVGVAVAIDGGLFTPVIRKADQKTLSTISNEMKDFAGRARAKKLKPEEYQGGVTSVSNLGMFGIKHFTAVINPPQSSILAVGAGEKRVVVKDGQPTVAQVMTATLSCDHRVLDGALGAELIAAFKGLIENPMGMLV

SEQ ID NO: 12958 - protein, 479 aa, Methylobacterium extorquens
MSETYDVLIIGAGPGGYVAAIRSAQLGFKTAVVDREHLGGICLNWGCIPTKALLRSAEIYHYMQHASDYGLSAKEVSFDAAAIVKRSRGVSGRLNGGVGMLLKKNKVDVIWGEASIESGAKGNEPGKVTVKETKRAEPPKGAKGAGTYAAKHIIVATGARPRVLPGIKPDKKQIWTYYEAMVPEKMPKSLLVMGSGAIGIEFASFYRTMGADVTVIELLPQILPVEDAEIAGLARKRFEKQGIKILTSAKVTKVEKGADSVTATVEDDKGKTQQLTAEKLISAVGVVGNIENLGLEKVGVKIERGVVVTDGLGRTNVPGVYAIGDVAGPPMLAHKAEHEGVLCVETIKGLHTHPMDKAKIPGCTYCQPQIASVGVTEGKAKELGLSIKVGRFPFAGNGKAIALGEPDGLVKTIFDAKTGQLLGAHMVGAEVTELIQGYVVAMTLESTEEELMHTVFPHPTLSEMMHESVLDAYGRVIHT

SEQ ID NO: 12959 - protein, 375 aa, Aspergillus oryzae
MADTVGKAAVAWAAGEPLSIEDIEVAPPKAHEVRIQVHHTGVCHTDAYTLSGKDPEGAFPVVLGHEGAGIVESVGEGVTSVKPGDYVIALYTPECRECKFCKSGKTNLCGKIRATQGKGVMPDGTSRFKARGKDLLHFMGTSTFSQYTVVADISVVAVTPKIPTDRSCLLGCGITTGYGAAVVTAKVEEGSNVAIFGAGCVGLSVIQGAVKNKAGKIIAVDVNDGKEAWARKFGATHFVNPTKLNGKTIQEELIEMTDGGCDYTFDCTGNVGVMRAALEACHKGWGESIVIGVAAAGQEISTRPFQLVTGRVWKGCAFGGIKGRTQLPGLVDDYLNNELKVDEFITHRETLDNINAAFEQMHHGDCIRCVVDCRQ

SEQ ID NO: 12960 - protein, 526 aa, Glycine max
  misc_feature (223)..(223): Xaa can be any naturally occurring amino acid
MLQVLSFSLKSDTHTLLRSTLRTKTASSLAYAVVSRSAQENLLQAPLLSRSNSTEASLAKDTSSNDVKNGQGFKGHSMLAPFTAGWQTTDLHPLVIEKSEGSYVYDINGKKYLDALAGLWATSLGGSEPRLVDAAIAQLKKLPFYHSFWNRTTLPSLDLAKELLEMFTARKMGKAFFVNSGSEANDTQVKLVWYYNNALGRPDKKKFIARAKSYNGSTLIAAXLSGPSGFCHQKFDLPAPFVLHTDCPHYWRYHLPGETEEEFSTRLANNLEQLILKEGPETIAAFIAEPVMGAGGVIPPPSTYFEKVQAVVKKYDILFIADEVICAFGRLGTMFGCDKYNIKPDLVSLAKALSSAYLPIGAVLVSPEISEVIHDQSNKLGSFSHGFTYSGHPAACAVAIEALKIYKERNIVDQVNKIAPRFQDGIKAFSDSPIIGEIRGTGLILGTEFTDNKSPNDPFPPEWGIGAYFGAQCEKHGMLVRVAGDNIMMSPPYIISPGEVEELISIYGKALKETEKKVQELKSQRK

SEQ ID NO: 12961 - protein, 442 aa, Methylobacterium extorquens
MATDILVPTLGESVSEATIGRWFKKPGDTVAADEPLVELETDKVTLEVNAPAAGELGEILVKDGETVEPGAVLGSIVEGGKGSGKSDAKPAPKSAEPAETKTQSREEKGESKPAKEDAPAQESSASYGSHGDAPPTDGRPADDSGPAVAKLARESGIDPASLNGSGKDGRVTKGDMLAAIDRNGQKAPAQEARSETKAPPPRAPSAPDDAAREERVRMTKLRQTIAKRLKSAQETAAMLTTFNDVDMGAVMAMRSQYKDIFEKKHGTKLGFMGFFTKAVIGALKDVPAVNAEIDGQDLVYKNYYHIGIAVGTDKGLVVPVVRDADDLSIAGIEKKISGFGKKAREGKLSIDEMQGGTFTITNGGIYGSLMSTPILNAPQSGILGMHRIEERPVVRNGKIEARPMMYLALSYDHRIVDGKEAVTFLVRVKEALEDPARLVLDL

SEQ ID NO: 12962 - protein, 720 aa, Aspergillus oryzae
MAPTPIPVPLFAQTQQQLLLQEHEAEVSSSTLASTAASVSPSTRRTLQATGYALTGIVLSQCRTGLGGRVVGEFGADAAVSTKNTDGHGKDGEPQLGAHGIRVGDVVRVNEIGSSTKKMGKDKASKDGKPAGTGPPKGPEGVVTRVGERSVWVAFGQQGGGGRSKEDDEAIEELWGKKLWLIKLANDVTYRRMRQTMEKMGKIIESDYTHFMRVAFGHTTPLPPDYGAVGDVEFNDPSLNDSQKEAIRFALASRDIALIHGPPGTGKTHTLIELILQMVQRKLRVLVCGPSNISVDNIVERLAPKKVPVVRIGHPARLLPSVLEHSLEVLTHTSDAASIVRDVRKEIDQKVASIRKTRFGREKRAIYQDLKELRREFRERESKCVDNLVRESSVVLATLHGAGGHQLKNQKFDVVIIDEASQALEAQCWISLLSASKVVLAGDHLQLPPTVKSTDQKSKDVKAGKVDTVNDGDNGVLGKMSLETTMFDRLLSLHGESIKRMLTTQYRMHETIMRFPSDELYESKLMAGDAVKARLLKDLPYDVEETDDTKEPLVFWDTQGGDFPEKTEDKEVGQKEALLGESKSNEMEAMVVAKHVDNLVQSGLKPEDIAVITPYNGQLAILSQMLREKYPGIELGSVDGFQGREKEAVVVSLVRSNSENEVGFLGEKRRLNVAMTRPKRHLCVCGDSETISKGSGFLKRWMAFLEENADLRYPDAGGLL

SEQ ID NO: 12963 - protein, 500 aa, Methanosarcina mazei Go1
MKYISSLRMKAIDRNCAYLGLLPLQLMENAGAAVARSVKEKLGNGKVLFVAGRGNNGGDAFVAARHLAGIPGYAVRVILLGKGSDIGSEEAFHNFSLLRFSRVKTLEIRDSNQLTASEWFSEADLLVDAVFGTGVKGKIKEPESTAIELINKEGKAGKTVIAVDIPSGLDPEGGDFDKAVYADLTVTFHRMKAGLLTEKAKEYTGTIKVEEIGVCADAEHYVGPGDLQMLRKRKFDAHKGNAGRILIIGGGPYSGAPALAALAALKTGADLVTAAVPESVARTVASYSPDLIVRKLSSNVLCPEDMSTLPDLINSHDVVVMGMGLGRATETLETVRKILPFCRKMVLDADALSALSGVLFETLAGNCEIIVTPHGGEFALLRGVETPEDHDAREKAVREFSEEKGVVTLLKGKTDIISDGKQTLLNRTGNPGMTVGGTGDVLAGITGALFSRNPAFLSAACAAFINGSAGDLAFEKSGNALLATDVLEKIPEIIREAGIG

SEQ ID NO: 12964 - protein, 649 aa, Oryza sativa (japonica cultivar-group)
MGGSHSREDLDLSDSEDDDSASHASDASSDFATPPPSSSAKPSAAKSSAAAATPASIDAIDRHLRSLHLKYAEPISPNPSPSPTSAAAPAALNAVKLYLHIGGSSPSARWIISDRLAAASFVRAGDDDDDDAPSSGPWCLVVGSKIRARVGPELQLKTFPAQRRVDFVADGVWALKFLHADGYPNFYAKYQSCLFENSYGVAATDEGRAKVFGKDFAAWARPEDGDESIWEDATDGFVPSPSRSPMPSRSPILKPLMEDLREYEEPVEEGGGIQSLALGALDNSFLVGDSGIQVVRNFEHGIHGKGVSVKFSGGSTNFSTPKKALLMRAETNMLLMSPATDGKPHAKGVHQLDIETGKVVSEWKFGKDGADINMRDITNDSKGAQMDPSESTFLGLDDNRLCRWDMRDRRGIVQNIASATESPVLQWTQGHQFSRGTNFQCFASTGDGSIVVGSLDGKVRLYSKSSMRMAKTAFPGLGSPITHVDVTYDGKWILGTTDTYLILICTIFIDKDGKEKTGFGGRMGNRIAAPRLLKLTPLDSHLAGQNNIFREGRFSWVTENGKQERHLVATVGKYSVVWNFLQVKNSHHECYQCQEGLKSCYCYKVIPKDESIVASRFMHEKYAVSDTPEAPLVVATPMKVTSFSISSKH

SEQ ID NO: 12965 - protein, 369 aa, Rhodopseudomonas palustris CGA009
MKTRAAVAFEAKKPLEIVELDLEGPKAGEVLVEIKATGICHTDAYTLDGFDSEGIFPSILGHEGAGIVREIGPGVTSVKPGDHVIPLYTPECRQCKSCLSQKTNLCTAIRATQGKGLMPDGTSRFSYKGQTIYHYMGCSTFSNFTVLPEIAVAKIRDDAPFDKSCYIGCGVTTGVGAVVNTAKVTPGSNVVVFGLGGIGLNVIQGAKMVGADKIVGVDINDDKEEWGRRFGMTHFVNPKKIDGDIVQHLVGLTDGGADYTFDCTGNTNVMRQALEACHRGWGVSVVIGVAEAGKEISTRPFQLVTGRVWKGSAFGGARGRTDVPKIVDWYMNGKIEIDPMITHVLKLEEINKGFDLMHQGKSIRSVVVY

SEQ ID NO: 12966 - protein, 547 aa, Listeria monocytogenes str. 1/2a F6854
MTVKSGFDYMNNPLLNKGTAFSEEERANYQLDGLLPPIIETIEQQAVRIETQIENLETPLHKHQLLTNLYNENRTLYYYLVTKNVTDYLPIIYTPTIGDAVIQYHKEYTAPDEALFIDAFAPEKLSASIKNYAKNNPNIDMIVITDGEGVLGIGDWGVNGVKIAVGKLAVYTVAAGLAPDRVLPVVIDAGTNNETLLNDSLYLGNKGPRLSESEYDAFIASFVNVMKEVFPKAILHWEDFGRANASRILHNYRDKICTFNDDIQGTGAMVVAAVLATIQVSRIPLSEQKIIIFGAGTAGIGIADQLSAQLMRETGLPFEKAKKHFYLVDRKGLVLDNMTDLTTGQKKYAHPSAEWSNVPTDTLENLVEAVHPTMLIGCSGVTGAFKESIVKKMTQYTERPAILPLSNPTKLAEATASDLIQWTDGKALIVTGSPSKPVEYQNTTYEIGQANNALLYPGLGLGALVTRAKYITDDMLAAASMAVAEQISPNKAGAALLPHVRTLRETSRAVAIAVANQAIKENIHQVELTNVIEAIELEMWQPIYKGV

SEQ ID NO: 12967 - protein, 551 aa, Bradyrhizobium japonicum USDA 110
MGVQTCAVAGRGVVAYLLAMTAAQNDRSASTPSVASAHDKILIVDFGSQVTQLIARRVREDGVYCEIVPFNKAEEAFKEMKPKAVILSGGPESVHEAGSPRAPQLIFASGVPVMGICYGQMTMAAQLGGEVEGGHHREFGRADVEVKAQSKLFEDVWSSGSKNQVWMSHGDRITKMPPGFSVAGTSPNAPFAIIQDEKRKYYGLMFHPEVVHTPDGAKLIRNFVRKIAGLTGDWTMRAFREEEIAKIRAQVGKGKVICGLSGGVDSAVAAVLIHEAIGDQLTCVFVDHGLMRLNEAEQVVDLFRHHYNIPLVHVDASKQFLGELEGVTDPETKRKTIGRLFIEVFEAEAKKIGGADFLAQGTLYPDVIESVSFTGGPSVTIKSHHNVGGLPERMNMKLVEPLRELFKDEVRKLGRELGLPEIFVGRHPFPGPGLAIRCPGDITSDKLDILRKADAVYIDQIRKHGLYDDIWQAFAVLLPVKTVGVMGDGRTYDYVVGLRAVTSTDGMTADFYQFDMKFLGETATRIINEVKGVNRVVYDVTSKPPGTIEWE

SEQ ID NO: 12968 - protein, 1129 aa, Avena sativa
MSSSRPASSSSSRNRQSSQARVLAQTTLDAELNAEYEESGDSFDYSKLVEAQRDGPPVQQGRSEKVIAYLQHIQKGKLIQTFGCLLALDEKSFNVIAFSENAPEMLTTVSHAVPSVDDPPRLGIGTNVRSLFSDQGATALHKALGFADVSLLNPILVQCKTSGKPFYAIVHRATGCLVVDFEPVKPTEFPATAAGALQSYKLAAKAISKIQSLPGGSMEVLCNTVVKEVFDLTGYDRVMAYKFHEDDHGEVFSEITKPGLEPYLGLHYPATDIPQAARLLFMKNKVRMICDCRARSIKVIEAEALPFDISLCGSALRAPHSCHLQYMENMNSIASLVMAVVVNENEEDDEAESEQPAQQQKKKKLWGLLVCHHESPRYVPFPLRYACEFLAQVFAVHVNREFELEKQLREKNILKMQTMLSDMLFREASPLTIVSGTPNIMDLVKCDGAALLYGGKVWRLRNAPTESQIHDIAFWLSDVHRDSTGLSTDSLHDAGYPGAAALGDMICGMAVAKINSKDILFWFRSHTAAEIRWGGAKNDPSDMDDSRRMHPRLSFKAFLEVVKMKSLPWSDYEMDAIHSLQLILRGTLNDASKPKREASLDNQIGDLKLDGLAELQAVTSEMVRLMETATVPILAVDGNGLVNGWNQKAAELTGLRVDDAIGRHILTLVEDSSVPVVQRMLYLALQGKEEKEVRFEVKTHGPKRDDGPVILVVNACASRDLHDHVVGVCFVAQDMTVHKLVMDKFTRVEGDYKAIIHNPNPLIPPIFGADEFGWCSEWNAAMTKLTGWNRDEVLDKMLLGEVFDSSNASCPLKNRDAFVSLCVLINSALAGEETEKAPFGFFDRSGKYIECLLSANRKENEGGLITGVFCFIHVASHELQHALQVQQASEQTSLKRLKAFSYMRHAINNPLSGMLYSRKALKNTDLNEEQMKQIHVGDNCHHQINKILADLDQDSITEKSSCLDLEMAEFLLQDVVVAAVSQVLITCQGKGIRISCNLPERFMKQSVYGDGVRLQQILSDFLFISVKFSPVGGSVEISSKLTKNSIGENLHLIDLELRIKHQGLGVPAELMAQMFEEDNKEQSEEGLSLLVSRNLLRLMNGDVRHLREAGVSTFIITAELASAPTAMGQ

SEQ ID NO: 12969 - protein, 1129 aa, Avena sativa
MSSSRPASSSSSRNRQSSRARVLAQTTLDAELNAEYEESGDSFDYSKLVEAQRDGPPVQQGRSEKVIAYLQHIQKGKLIQTFGCMLALDEKSFNVIAFSENAPEMLTTVSHAVPSVDDPPRLGIGTNVRSLFSDQGATALHKALGFADVSLLNPILVQCKTSGKPFYAIVHRATGCLVVDFEPVKPTEFPATAAGALQSYKLAAKAISKIQSLPGGSMEVLCNTVVKEVFDLTGYDRVMAYKFHEDDHGEVFAEITKPGLEPYLGLHYPATDIPQAARFLFMKNKVRMICDCRARSIKVIEAEALPFDISLCGSALRAPHSCHLQYMENMNSIASLVMAVVVNENEEDDEAESEQPAQQQQKKKLWGLLVCHHESPRYVPFPLRYACEFLAQVFAVHVNREFELEKQLREKSILKMQTMLSDMLFREASPLTIVSGAPNIMDLVKCDGAALLYGGKVWRLRNAPTESQIHDIAFWLSDVHRDSTGLSTDSLHDAGYPGASALGDMICGMAVAKINSKDIIFWFRSHTAAEIRWGGAKHDSSDMDDSRRMHPRLSFKAFLEVVKMKSLPWTDYEMDAIHSLQLILRGTLNDASKPKREASLDNQIGDLKLDGLAELQAVTSEMVRLMETATVPILAVDGNGLVNGWNQKAAELTGLRVDDAIGRHILTLVEESSVPVVQRMLYLALQGKEEKEVRFEVKTHGPRRDDGPVILVVNACASRDLHDHVVGVCFVAQDMTVHKLVMDKFTRVEGDYKAIIHNPNPLIPPIFGADEFGWCSEWNAAMTKLTGWNRDEVLDKMLLGEVFDSSNASCPLKNKNAFVSLCVLINSALAGEETEKAPFGFFDRSGKYIECLLSANRKENEGGLITGVFCFIHVASHELQHALQVQQASEQTSLKRLKAFSYMRHAINNPLSGMLYSRKALKNTDLNEEQMKQIHVGDNCHHQINKILADLDQDSISEKSSCLDLEMAEFVFQDVVVAAVSQVLITCQGKGIRISCNLPERFMKQSVYGDGVRLQQILSDFLFISVKFSPVGGSVEISSKLTKNSIGENLHLIDLELRIKHQGLGVPAELMEQMFEEDNKEQSDEGLGLLVSRKLLRLMNGDVRHLREAGVSTFILTAELASAPTAIGQ

SEQ ID NO: 12970 - protein, 246 aa, Magnetospirillum magnetotacticum MS-1
MQLSILIETMRREGFEIAVSRPRVVFEKDENGGILEPVEEVVIDVDEEHSGVVVQKMSERKAEMLEMRPSGGDRLRLVFHAPTRGLIGYQGELLTDTRGTAIMNRLFKAYEPYKGEMPGRRNGVLISNDKGEAVAYAMWNLEDRGPMMIEPGWKVYQGMIVGEHNRENDLEVNVLKGKKLTNIRTTSKDEAVRLTPPIKMTLERSLAWIQDDELVEVTPKSIRLRKAVLDPNDRKRAERAKDALSA

SEQ ID NO: 12971 - protein, 542 aa, Bartonella henselae str. Houston-1
MTLMTVLTKAFDDQKLGTFGLRKKVSVFQQPHYVENFIQSLFNSIGSVEGKLFILGGDGRYFNRNLLQIVLKMAAAHGVACVKVGKEGLLSTPAVSHLIRKYHAYGGIILSASHNPGGREGDCGIKYNIANGGPAPASLCDAVFAASKRLSSYRIMEVPDIDLEREGTTFLGPMQIDIIDPVADYVALMQEIFDFDCIAKAVAEGLTLRFDALHAVTGPYAHEIFEKCLGFSEGTVVNGVPLPDFGGKPPDPNLLHAKALYDLVMSDQGPDLGAASDGDGDRNLIMGRGQFVTPSDSLAIMVDHAHLIKGYRQGIVGIARSMPTGRAADLVAEKKGLNFFETPTGWKFFGTLLDAGYVTFCGEESFGTGSNHIREKDGLWAVLFWLNLLAVTGKTVAQIVQQHWRTYGRFYTLRYDYEEVETCKASAIINALRAYLPKPGSEIAGLSVEKADDFTYHDPVDQSISTGQGVRIFFKNGARLVVRLSGTGTVGATLRLYFEQFEGDPRKHNQDPQKVLQPVQQAAFQLLNIKQHLRRTQPDVIT

SEQ ID NO: 12972 - protein, 1124 aa, Cucurbita pepo
MSTSRPSQSSSNSGRSRHSTRIIAQTSVDANVQADFEESGNSFDYSSSVRVTSDVSGDQQPRSDKVTTAYLHHIQKGKLIQPFGCLLALDDKTFKVIAYSENAPEMLTMVSHAVPSMGDYPVLGIGTDVRTIFTAPSASALLKALGFGEVTLLNPILVHCKTSGKPFYAIVHRVTGSLIIDFEPVKPYEGPVTAAGALQSYKLAAKAITRLQSLPSGSMARLCDTMVQEVFELTGYDRVMAYKFHDDDHGEVISEVAKPGLQPYLGLHYPATDIPQAARFLFMKNKVRMIVDCRAKHLKVLQDEKLQFDLTLCGSTLRAPHSCHLQYMENMNSIASLVMAVVVNEGDEENEGPALQQQKRKRLWGLVVCHNSSPRFVPFPLRYACEFLAQVFAIHVNKELELENQIIEKNILRTQTLLCDMLMRDAPLGIVSRSPNIMDLVKSDGAALLYKKKIWRLGLTPNDFQLLDIASWLSEYHMDSTGLSTDSLYDAGYPGAIALGDEVCGMAAVRITNNDMIFWFRSHTASEIRWGGAKHEHGQKDDARKMHPRSSFKAFLEVVKTRSLPWKDYEMDAIHSLQLILRNTFKDTDATEINRKSIQTTLGDLKIEGRQELESVTSEMVRLIETATVPILAVDLDGLINGWNTKIAELTGLPVDKAIGKHLLTLVEDSSVEVVRKMLFLALQGQEEQNVQFEIKTHGSHIEVGSISLVVNACASRDLRENVVGVFFVAQDITGQKMVMDKFTRLEGDYKAIVQNPNPLIPPIFGSDEFGWCSEWNPAMAKLTGWSREEVIDKMLLGEVFGVHKSCCRLKNQEAFVNLGIVLNNAMCGQDPEKASFGFLARNGMYVECLLCVNKILDKDGAVTGFFCFLQLPSHELQQALNIQRLCEQTALKRLRALGYIKRQIQNPLSGIIFSRRLLERTELGVEQKELLRTSGLCQKQISKVLDESDIDKIIDGFIDLEMDEFTLHEVLMVSISQVMLKIKGKGIQIVNETPEEAMSETLYGDSLRLQQVLADFLLISVSYAPSGGQLTISTDVTKNQLGKSVHLVHLEFRITYAGGGIPESLLNEMFGSEEDASEEGFSLLISRKLVKLMNGDVRYMREAGKSSFIITVELAAAHKSRTT

SEQ ID NO: 12973 - protein, 43 aa, Hevea brasiliensis
EQCGRQAGGKLCPDNLCCSQWGWCGSTDEYCSPDHNCQSNCKD

SEQ ID NO: 12974 - protein, 1131 aa, Zea mays
MSSSRPAHSSSSSSRTRQSSRARILAQTTLDAELNAEYEESGDSFDYSKLVEAQRSTPPEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFDLTGYDRVMAYKFHEDEHGEVFAEITKPGIEPYIGLHYPATDIPQAARFLFMKNKVRMICDCRARSVKIIEDEALSIDISLCGSTLRAPHSCHLKYMENMNSIASLVMAVVVNENEEDDEPEPEQPPQQQKKKRLWGLIVCHHESPRYVPFPLRYACEFLAQVFAVHVNKEFELEKQIREKNILRMQTMLSDMLFKESSPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKTKSLPWSDYEMDAIHSLQLILRGTLNDASKPAQASGLDNQIGDLKLDGLAELQAVTSEMVRLMETATVPILAVDGNGLVNGWNQKVAELSGLRVDEAIGRHILTLVEDSSVSLVQRMLYLALQGREEKEVRFELKTHGSKRDDGPVILVVNACASRDLHDHVVGVCFVAQDMTVHKLVMDKFTRVEGDYKAIIHNPNPLIPPIFGADQFGWCSEWNAAMTKLTGWHRDEVVDKMLLGEVFNSSNASCLLKSKDAFVRLCIVINSALAGEEAEKASFGFFDRNEKYVECLLSVNRKVNADGVVTGVFCFIHVPSDDLQHALHVQQASEQTAQRKLKAFSYMRHAINKPLSGMLYSRETLKSTGLNEEQMRQVRVGDNCHRQLNKILADLDQDNITDKSSCLDLDMAEFVLQDVVVSAVSQVLIGCQAKGIRVACNLPERSMKQKVYGDGIRLQQIVSDFLFVSVKFSPAGGSVDISSKLTKNSIGENLHLIDFELRIKHRGAGVPAEILSQMYEEDNKEQSEEGFSLAVSRNLLRLMNGDIRHLREAGMSTFILTAELAAAPSAVGR

SEQ ID NO: 12975 - protein, 695 aa, Methanosarcina barkeri str. Fusaro
MELKYVPTTCPYCGTGCGFNIVVKDGRAAGIEPWHRAPVNAGKLCQKGRYAHEFIHSKDRLVKPLVRENGKLVETSWEEALALIAGKFMTFLPEEIACLSSARTSNEENYLMQKFARAVLKTSNVDHCARLCHSSTVAGLAAVFGSGAMTNSILDIEESKCIFIIGSNTLEQHPLIGRRVMLAKKKGAKIVCADPRCTPTAKQADLHLSMYSGTDVSLLNGLMHHIIENGWEDSVFISKRTKNYEEMRSVVIQEAYSLPNVSKITGVPENDLKTAAEWIAQSKPSALIYSMGITQHTVGVDNVRSTANLMLLTGNLGVAGGGVNPLRGQNNVQGACDMGCLPDVYPGYQKVADPENHRKMESIWGVSGLPKAPGLTVTELMEQLAEGTSTVKCMYVMGENFMLSDPDLNKVRKAMKQLDFLVVQDIFLSETANLADVVLPAACYAEKNGTQTNTERRVQRIRKAVDPPGDAKADWRIICELAGCMGYGPQFSYMNEAEIFEEIAKVTPQYGGMSYERLEKPDSLQWPCPDKTHLGTPILHTEKFSTSDGLAEFSGIEWKPPAEVPDVEYPFILTTGRNIWHWHTGTMTRRSKTLASEVRTGWVELHPEDAKKLGIRNRETVRVLSRRGKIEIPSMVTEDIKPGVVFIPFHFKECAANLLTNGALDPVAKIPEYKACAVKIEKIEPQEGKLLEEKL

SEQ ID NO: 12976 - protein, 1124 aa, Pisum sativum
MSTTRPSQSSNNSGRSRNSARIIAQTTVDAKLHATFEESGSSFDYSSSVRVSGSVDGDQQPRSNKVTTAYLNHIQRGKQIQPFGCLLALDEKTCKVVAYSENAPEMLTMVSHAVPSVGDHPALGIGTDIRTVFTAPSASALQKALGFAEVSLLNPILVHCKTSGKPFYAIIHRVTGSLIIDFEPVKPYEVPMTAAGALQSYKLAAKAITRLQSLASGSMERLCDTMVQEVFELTGYDRVMAYKFHEDDHGEVIAEIAKPGLEPYLGLHYPATDIPQAARFLFMKNKVRMIVDCNAKHVKVLQDEKLPFDLTLCGSTLRAPHSCHLQYMANMDSIASLVMAVVVNDSDEDGDSADAVLPQKKKRLWGLVVCHNTTPRFVPFPLRYACEFLAQVFAIHVNKEIELEYQILEKNILRTQTLLCDMLMRDAPLGIVSQSPNIMDLVKCDGAALFYRNKLWLLGATPTESQLREIALWMSEYHTDSTGLSTDSLSDAGFPGALSLSDTVCGMAAVRITSKDIVFWFRSHTAAEIRWGGAKHEPGDQDDGRKMHPRSSFKAFLEVVKARSVPWKDFEMDAIHSLQLILRNASKDTDIIDLNTKAINTRLNDLKIEGMQELEAVTSEMVRLIETATVPILAVDVDGTVNGWNIKIAELTGLPVGEAIGKHLLTLVEDSSTDIVKKMLNLALQGEEEKNVQFEIKTHGDQVESGPISLIVNACASKDLRENVVGVCFVAQDITAQKTVMDKFTRIEGDYKAIVQNPNQLIPPIFGTDEFGWCCEWNAAMIKLTGWKREEVMDKMLLGEVFGTQMSCCRLKNQEAFVNFGIVLNKAMTGLETEKVPFGFFSRKGKYVECLLSVSKKIDAEGLVTGVFCFLQLASPELQQALHIQRLSEQTALKRLKVLTYMKRQIRNPLAGIVFSSKMLEGTDLETEQKRIVNTSSQCQRQLSKILDDSDLDGIIDGYLDLEMAEFTLHEVLVTSLSQVMNRSNTKGIRIANDVAEHIARETLYGDSLRLQQVLADFLLISINSTPNGGQVVIAASLTKEQLGKSVHLVNLELSITHGGSGVPEAALNQMFGNNVLESEEGISLHISRKLLKLMNGDVRYLKEAGKSSFILSVELAAAHKLKG

SEQ ID NO: 12977 - protein, 606 aa, Silicibacter sp. TM1040
MDLRNIAIIAHVDHGKTTLVDELLKQSGAFRENQAVAERAMDSNDLERERGITILAKATSVEWNGTRINIVDTPGHADFGGEVERILSMVDGVVLLVDAAEGPMPQTKFVTSKALALGLRPIVVLNKVDKPDAEPDRALDECFDLFANLGADDDQLDFPSMYASGRSGWADMELDGPRKDLSALFDLIVKHVPAPKQIAQKDEPFRMLATTLGSDPFMGRILTGRVESGTLKVGDSLKALTREGELIENFRATKILAFRGLAQQPIDLAEAGDIVTIAGMAKATVADSLVDTSVTEALPAQPIDPPTITVTFGINDSPLAGRDGKKVQSRVIRDRLLKEAELNVAIEVTDTPGGEAFEVAGRGELQMGVLIENMRREGFELSISRPQVLFKEENGQRMEPVEEATIDVDDEYSGVVIEKLTGNRKGELVEMKPAGAGKTRIIAHVPSRGLIGYHGEFLTDTRGTGVLNRVFHGWTPHKGAIPGRRAGVLISMENGQSVAYALWNLEERGKMFIGAQADVYTGMIIGEHSRDNDLEVNPLKGKKLTNVRASGSDDAVRLTTPVTLSLEEAIAYINDDELVEVTPNSVRLRKRYLDPHERKRMAKANS

SEQ ID NO: 12978 - protein, 154 aa, Zea mays
MTVGMINANPVVHERPERASHPHAADVLDPLDVFDTVRDIKDPEHPYSLEQLSVLSEESVSVDETLGRIQITFTPTVQHCSMATVIGLCLRLKLMQNFPPHFKVDIKVAPGSLANEESVNKQLNDKERVAAALENPNLRQLVDECLCFNDPYSR

SEQ ID NO: 12979 - protein, 279 aa, Vibrio angustum S14
MKLEAVDYTAENAKQLFVESLRETGFGVLKNHPIQQTLVQKIYDKWYDFFNSEEKNAFHFNVETQDGLFPTEVSETAKGHTQKDIKEYFHYYPWGQCPAELKQDIQQYYQEANELATELLSWVEQYSPNEVSAKYTQSLSSMIDGSEKTLLRILHYPPLQGDEELGAIRAGAHEDINLLTILPAANEPGLQVKAKDGSWIDVPCDFGHLIINIGDMLQEASGGYFPSTTHRVINPEGADKTKSRISLPLFLHPKPDVVLSEKYTAHEYLMERLRELGVI

SEQ ID NO: 12980 - protein, 467 aa, Methylobacterium extorquens
MSYDLIVIGTGPGGYVCAIRAAQLGLKTAVVEKRATHGGTCLNVGCIPSKALLHASEAFEEANKHFSELGIDVGTPKLDLKKMQSFKQSGVDGNTKGVEFLLKKNKVDTYHGRGRIAGAGRVEVISDDGGNQLLETKNIVIATGSDVTRLPGVEIDEKTVVSSTGALELAEVPKRLVVIGAGVIGLELGSVWRRLGAEVTVIEYLDRVLPGMDGEVGKQFQRILAKQGMVFKLSTKVTGVETGKKGRATVTVEPAQGGEPEKLEADVVLVAIGRVPYTEGLGLETVGVATDDKGRIEVDSHYATNVTGIYAIGDVIAGPMLAHKAEDEGVAVAEILAGQSGHVNYGVIPNVVYTFPEVASVGKTEEELKKDGIAYNVGKFPFTANGRAKANGTTDGFVKILADAQTDRVLGVHIVGADAGNLIAEVAVAMEFAASAEDIARTCHAHPTLTEAIKEAALAVDKRAIHV

SEQ ID NO: 12981 - protein, 390 aa, Agrobacterium tumefaciens str. C58
MNQGNDLFDPASLIVAHDETHAFEAVVPPLVQTSLFTFSSYDEMVSTYRGEKVRPVYTRGLNPTVRMFEEMLARLEGAEDALGFASGMSAISSTVLSFVSPGDRIVAVRHVYPDAFRLFGTFMQRMNVEVVYVDGRDEAAVEKAMPGAKLFYMESPTSWVMEAHDVGALAAIGKRHGAVTVIDNSWASPVFQQPISLGVDLVVHSASKYLGGHSDVVSGVVAGSKAMIDRIREETYPYLGGKMSPFDAWLLIRGLRTLPLRMKAHQASALDIATRLQALDVVEKVCHPGLANRLPPGLHGTSGLFSFIFKEGVDVRAFADRLQLFKLGVSWGGHESLIVPGEVVLEQKAQPNSAHTFGISARSVRLHVGLEGTEALWNDLEPAIKAASAV

SEQ ID NO: 12982 - protein, 500 aa, Frankia sp. CcI3
MTTDSAQTGQAGEPERLEERSTSPHRVVIIGSGFGGLFTAQALRKAPVEVTLVAKTTHHLFQPLLYQVATGILSEGEIAPTTREVLSRQDNAQVVLGEVTTIDVNARTVTSQLLGRTTVHHYDSLVVAAGAGQSYFGNDHFATHAPGMKSIDDALELRGRIFGMFELAEASTDPADVERLLTFVVVGAGPTGVEMAGQIAELSRRTLRRDFRSIDPAKARVILLDAAPAVLPPFGERLGAKAADKLTKIGVDVQLGAKVVNVDATGIDVEDSDGTRRRIDSVCKVWAAGVAASPLGRQLAEQTGAGLDRAGRIEVLPDLTLPGHPEVFVIGDMASLNRLPGVAQVAIQGGRHAAKEIQAWVAGKQTGRPFEYHDKGSMATISRFSAVASIGKVQFSGFFAWLVWLAVHLVYIIGFKHRLTTLLHWTVSFIGRGRSERTVTEQQIFARVAVQRLGTDFAPSLPPHASQEAPSWTGARTIVPMQPQAKGEGKGEDSRQPSRV

SEQ ID NO: 12983 - protein, 247 aa, Aspergillus oryzae
MPKLETHWATIVTSYSPSTIEFTGTLLIQLLTFWLPSLIYLTLPTLFPTWSNNHKIQPAPKQPTKKEIHHCFKIVLRNQLLTTTLHLLQLNLLNKGTSSYTLTPTFPSLPILARDFLLSLLAREALFYYAHRFLHRPYFYVRIHKQHHKFTAPIALAAQFAHPIEQIFANALPISLPPQLLGSHVLTFWAFLGYELFVTATVHSGFDFFGGKARMHDLHHEKFNLNYGSLGLLDWVHGTDRLEKRRD

SEQ ID NO: 12984 - protein, 140 aa, Trichodesmium erythraeum IMS101
MTKTPEELYKEGLERYKAGEKAGTLIPLFKEITDRSPKSSSSWISLSWLYLLEKKPKSAHKAAKEGFKLNPDDPQGRINLALAMLEIEKKGVRPHVEKAQQLIMADEDWLKEIKNNIKDGFDRRGEWPALARIKQWLFDI

SEQ ID NO: 12985 - protein, 376 aa, Arabidopsis thaliana
MASIVLRSRLLPRLAKLRSRNLRCFSAEASSTNSTSRYSGVTSTQSMFSDFPPPNQPPPPPPPQVEAAAAAATGKERKGLKYLGYALLWALTGATAATGYASFAYTIDEVNEKTKAFRESATKTPVIKSSGIDVIDKYQTKLYSAAMTGSARAIDKYLELREIVEEQVKGFTEPLSEKLLPDLHPAEQHVFTLVLDLNETLLYTDWKRERGWRTFKRPGVDAFLEHLGKFYEIVVYSDQMEMYVLPVCEKLDPNGYIRYKLARGATKYENGKHYRDLSKLNRDPKKILFVSANAFESTLQPENSVPIKPYKLEADDTALVDLIPFLEYVARNSPADIRPVLASFERKDIAKEFIDRSIEYQKRKQGQLGQGRFWRR

SEQ ID NO: 12986 - protein, 278 aa, Streptococcus thermophilus
MKVDDDLVRQVIRPRLRGSHKGSYGRVLLVGGLYPYGGAIIMAAIACVNSGAGLVTVATDRENIIALHAHLPEAMAFDLRETERFLDKLRAADVILIGSGLGEEETADWALELVLANIRSNQNLVVDGSALNLLAKKNQSSLPKCHLILTPHQKEWERLSGLAISEQSVSNTQRALEEFQSGTILVAKSHKTAVYQGAEVTHLEVGGPYQATGGMGDTLAGMVAGFLAQFASTDSYKAVIVATWLHSAIADNIAENAYVVLPTRISKAIPSWMKKLSL

SEQ ID NO: 12987 - protein, 405 aa, Xanthomonas axonopodis pv. citri str. 306
MSRIVNEVVIPSVLQDGSVRTPEPRKQNLLDLDREGLERFFADTLGEARYRAHQVMKWIHHRYVTDFDQMTDLGKALRAKLHQHAEVLVPNVVFDKPSADGTHKWLLAMGTDGKNAIETVYIPDKGRGTLCVSSQVGCGLNCSFCSTATQGFNRNLTTAEIIGQVWVAARHLGNVPHQQRRLTNVVMMGMGEPLMNFDNVVRAMSVMRDDLGYGLASKRVTLSTSGLVPMIDRLSTESDVSLAVSLHAANDALRESLVPLNKKYPIAELMESCARYLRGSKKRDSVTFEYTLMKGINDQPEHARQLARLMRQFDNAVQSKDAGKVNLIPFNPFPGTRYERSGETEIRAFQKILLDAQVLTMVRRTRGDDIDAACGQLKGQVMDRTRRQAEFRRTLEGQADRDAAA

SEQ ID NO: 12988 - protein, 454 aa, Zea mays
MASTAARRLRELQAQTGNKTCVDCAQRNPQWASVSYGVFMCLECSGKHRGLGVHISFVRSVTMDSWTEAQLRKMEAGGNDRLNAFLTARGVPKETPHVAKYNSNAAAAYRDRIAALAEGKPWTDPPVVKETPGSGAPAPARKPPVHTSAASGGGGWDDWDDDFRPDMRRNQSVGSFAAAGAQSGRQPPRSKSTQDMYTRQQLEASAANKEDFFARRMAENESKPDGIPPSQGGKYVGFGSSPPPSANRNGGAAQGDVMQVVSQGFGRLSLVAASAAQSAASAVQVGTKEIQSKMRDGGYDQKVNETVSVVANKTAEIGSRTWGIMRGVMALASQKVEEYAKEGGVGGWGEDWQHSEQKSEPYQRFEHETNGNSWNSSQNSSSKNNSSSWDDWDDPGKKDEPAKPHQSSDSWAGWDDGKDDGFDSPSYNNHSTSNKGSNQNGTSGGTFWTEGGFR

SEQ ID NO: 12989 - protein, 330 aa, Rubrobacter xylanophilus DSM 9941
MSTDRRLYFIRAMYEGLRDAMREDKTVVVIGEDVDRSIIGATRGLIEEFGPERVRNTPISEATFVGACIGASAAGLRPVVDLMVGSFFYVAMDQVANQAAKLPYMSGGQVSLPIVYFTATGPSGSAAAQHSENPHPMLMNVAGLKIVMPSSPCDAKGLMISAIRDPNPVIYLQDAVLGGTRGPVPEEPYSIPIGEAEVKREGEDVTVVAIGALVNRALKVAGEMERDGISVEVVDPRTLVPMDKKTILDSVRKTGRLVVCDNARMTCSAASEIAAFVSEEAFDSLKTAPRRVAWEDVPVPFSPVLEKRVLVDEEKIRAAVESTLATRTRA

SEQ ID NO: 12990 - protein, 332 aa, Rubrobacter xylanophilus DSM 9941
MLGEEKLVGMLRLMLRIRRFEEKLAELFKRGKLPGFVHLYIGEEAVAVGACSALREDDRITSTHRGHGHVIAKGADVSRMMAELLGKEAGYCRGKGGSMHTVDFSLGIMGTNGIVGGGIPIAVGSAWGDRQLGRDTVTVSFFGDGASNQGVFFEGMNLAAIWKLPVIFLCENNGYTEWTPTEKLTAGRISDRGVPFGIPSVQVDGNDVISVHEAVSEAVGRARAGEGPSLIEARTYRWHGHNEGEEAFSGPYRPEEEIEEWKGKDPITTFAARLVEQGVFAREEIERVDAEEKERIEDAVRFAVESAYPDPEEALMHLFYDERPRLQQEVNR

SEQ ID NO: 12991 - protein, 587 aa, Zea mays
MAMIDEPLYPIAVLIDELKNEDIQLRLNSIKKLSTIARALGEERTRKELIPFLSENNDDEDEVLLAMAEELGVFIPYVGGVEHAHVLLPPLETLCTVEETCVRDKAVESLCQIGAQMKENDIVDWFAHVVKRLAVGEWFTARVSSCGLFHIAYPSAPEQLKAELRTIYGQLCQDDMPMVRRAAASNLGKFAATVEQSHLKTEIMSMFDDLTQDDQDSVRLLAVEGCAALGKLLEPQDCAAHILPVIVNFSQDKSWRVRYMVANQLYELCEAVGTEPTRGDLVSAYVRLLCDNEAEVRIAAAGKVTKFCKILNPQIAIEHILPCIKELSSDSSQHVRSALASVIMGMAPVLGKDATLEQLLPIFLSLLKDEFPDVRLNIISKLDQVNQVIGIDLLSQSLLPAIVELSEDRHWRVRLAIIEYIPLLASQLGVGFFDDKLGALCMQWLEDKVFSIRDAGANNLKRLTEEFGPEWAMQHIIPQVLEKINNPHYLYRMTTLQAISLLAPVMGPDITCQQLLPVVIASSKDRVPNMKFNVAKVLQSLVPILDQSVVEKTVKPCLVELSEDPDVDVRYYAHQALRACDQMVISS

SEQ ID NO: 12992 - protein, 512 aa, Arabidopsis thaliana
MSPLISFTPTSLDFTFFAIIISGFVFIITRWNSNSKKRLNLPPGPPGWPVVGNLFQFARSGKPFFEYAEDLKKTYGPIFTLRMGTRTMIILSDATLVHEALIQRGALFASRPAENPTRTIFSCNKFTVNAAKYGPVWRSLRRNMVQNMLSSTRLKEFGKLRQSAMDKLIERIKSEARDNDGLIWVLKNARFAAFCILLEMCFGIEMDEETIEKMDDILKTVLMTVDPRIDDYLPILAPFFSKERKRALEVRREQVDYVVGVIERRRRAIQNPGSDKTASSFSYLDTLFDLKIEGRKTTPSNEELVTLCSEFLNGGTDTTGTAIEWGIAQLIANPEIQSRLYDEIKSTVGDDRRVDEKDVDKMVFLQAFVKELLRKHPPTYFSLTHAVMETTTLAGYDIPAGVNVEVYLPGISEDPRIWNNPKKFDPDRFMLGKEDADITGISGVKMIPFGVGRRICPGLAMATVHVHLMLARMVQEFEWCAHPPGSEIDFAGKLEFTVVMKNPLRAMVKPRI

SEQ ID NO: 12993 - protein, 339 aa, Pseudomonas syringae pv. tomato str. DC3000
MSQESINWDTLGFDYIKTDKRYLSHWRDGAWDQGSLTEDNTLHISEGSTALHYGQQCFEGLKAYRCKDGSINLFRPDQNAQRMQRSCSRLLMPHVPTDVFIEACKQVVKANERFIPPYGSGGALYLRPFVIGVGDNIGVRTAPEFIFSIFCIPVGAYFKGGLKPNNFVISGYDRAAPNGTGAAKVGGNYAASLMPGSEAKKHSFADCIYLDPQTHSKIEEVGSANFFAITSDDVFLTPKSPSVLPGITRLSLIELAKNRLGLTVEEGDVFIDQLDTFKEAGACGTAAVITPIGGISYQDNLHVFYSQTDVGPVTQRLYKELTGVQSGDIEPPAGWIVKV

SEQ ID NO: 12994 - protein, 132 aa, Oryza sativa
  misc_feature (16)..(16): Xaa can be any naturally occurring amino acid
SSPFLSTGHVSSGPSXSRWTVQYKQPGHTFYRRTHVQSFLAFASTDASEGKRSSGDNVVMVDPLEAKRLAAQQMQQIQAREKLKRRCRAEAINGALAMIGLTVGLVLEGQTGKGILAQLAGYLTALSSLFGQ

SEQ ID NO: 12995 - protein, 335 aa, Agrobacterium tumefaciens str. C58
MLMEETMRQASVLAPHTNGPTVTAGEILVEIMATTVGDGFLEPQTLIGPFPSGAPAIFIDQVARCGGTAGIIAAVGDDDFGRLNIERLRRDGVDVSAITTIADRPTGSAFVRYRENGARDFVFNIAHSAASETRMTDEAQALIEKAGHVHIMGSAFAIAGIGAIILEAVKSVKARGGSVSFDPNIRKELAQGDEGRRLIDDLLAVTDLLLPSGEELQAASGLDDEEAAIEKLLAAGIGEIVLKRGANGASHFSRAHGRIDAPGLEVEEIDPTGAGDCFGATYLTCRRLGMRPGKALVYANASGAHNVTKRGPMEGAASLAELDAFMAAQLSEEVL

SEQ ID NO: 12996 - protein, 1061 aa, Lactobacillus acidophilus NCFM
MPLENDLDKVLIIGSGPTLIGSVAEMDLMATEAIDALTEEGIQVVLVNPNPATISTDKRPDVTVYLEPMTLDFLKRILRMEEPDAIITEYGSTNGLKVAHKLLQDGILEQMGIQLLTLNSRMLQMGNQQKRNELLKKLGIDTGKSWELNQGIPDSINSNELTEKITFPVLVTKYNRYVHNEHLHFDNAQDLIDFFKKEKQNDNFNWKNYRLTEDLSSWEEVIVDVIRDKDGNTVFINFAGSIEPVKINSGDSAVTMPALTLNNDHIQELRESVKKIINNLNLIGFSSFHFAIKHYGTQIKSKLLTIRPRLTRSAVWTQRIGLYDVGYIVSKVAIGYRLNEIIDPLSGLNASIEPTLDAIAIKMPYWSFAESGYNHYRLSNRMQASGEAMGVGRNFETAFLKGLHATIDLELGWNAFIQETQKNKDKILEDLANPDELHLVKLLAAIKQGITFAELQKVTGLHPIYYQKLLHIINIANRLISDKDNLSFDLLEEAKVYGFFNTLLAKILNKSVEDVQEIIEQYNLTPSFLKIDGSAGVYKPNVCAYYSAYNVQNEANTLAADKKILILGMLPLQVSVTSEFDYMIAHAAKTLHNNGYVTVLLSNNDESVSSRYKDIDRVYFESITLENILTVANRENIKDILLQFSGKKVSALSKRLEECGLHVIGQVPTNDVHDKIDNLLKENLANLDRVPALKTTQEDDVFEFADQHGFPILIGGMNKDNKQKSAVVYDIPAIEKYLTENQLDQIAVSQFIEGNKYEVTAISDGENVTLPGIIEHLEQTGSHASDSIAVIQPQNLMIKQQNRIEKESIKIIKRLKTRGIFNLHYLFVNDDLYLLQIKPYAGHNVAFLSKSLNKDITACATEVLIGKNLIDMGYPDGLWQTSNFIHIKMPVFSFLNYTSGNTFDSNMKSSGSVMGRDTQLAKALYKGYEASDLHIPSYGTIFISVRDEDKEKVTQLARRFDRLGFKLVATEGTANIFAEAGITTGIVEKVHNNPRNLLEKIRQHKIVMVVNITNLSDAASEDALRIRDQALYTHIPVFSSIETAELILDVLESLALTTQPI

SEQ ID NO: 12997 - protein, 685 aa, Pseudomonas aeruginosa UCBPP-PA14
MKRRSVLLSGVALSGTALANDSIFFSPLKYLGAEQQRSIDASRSLLDNLIPPSLPQYDNLAGKLARRAVLTSKKLVYVWTENFANVKGVPMARSVPLGELPNVDWLLKTAGVIVELIVNFVASLPASAAAQFERIAAGLSGDLEAARQVHEALLEEAKNDPAAAGSLLLRFTELQTRVIALLTRVGLLVDDILKSASNLVTQGGQGDGLNRFRAVFGTLRLPEVADSFRDDEAFAYWRVAGPNPLLIRRVDALPANFPLGEEQFRRVMGADDSLLEAAASRRLYLLDYAELGKLAPSGAVDKLLTGTGFAYAPIALFALGKDRARLLPVAIQCGQDPATHPMFVRPAESESDLYWGWQMAKTVVQVAEENYHEMFVHLAQTHLVSEAFCLATQRTLAPSHPLHVLLAPHFEGTLFINEGAARILLPSAGFIDVMFAAPIQDTQATAGGNRLGFDFYRGMLPESLKARNVDDPAALPDYPYRDDGLLVWNAIRQWAADYVAVYYASDGDVTGDVELVAWVGEVIGSGKVAGFRPITGRSQLVEVLTMVIFTASAQHAAVNFPQPSMMTYAPAICAMSAAPAPDSPSGKSEADWLKMMPPTLVALEKVNIYHLLGSVYHGRLGDYRQTGFPYAPVFSDRRVTASGGPLERFQARLKEVEATIRTRNQARRKPYEYLLPSRIPASTNI

SEQ ID NO: 12998 - protein, 258 aa, Pseudomonas syringae pv. tomato str. DC3000
MAGSGIQTTLRQLTNLRLFMNSSLSRRKILQGACCLPVAAALMELPSIANAATPTSPRTTMTADQALKALRDGNDAFMTDKTINVERNRDRRLEIAKGQTPFCILISCSDSRVPPELLFGRGLGELFIVRNAGNTVDTAALGSIEYGVSQLGVPLVVVMGHEKCGAVAAAVSVVEDNTVYPGAIGQMIEPILPAVLNAKSKKGGNLLEDSVKANIQRTVARLRTASEPALMNPIKTGQVKVVGAYYSLENGKVDFFDV

SEQ ID NO: 12999 - protein, 390 aa, Zea mays
MGITPHTDGLGLTLLLHVDDTPGLQIRRGGRWFPVRPLPGAFVVNVADILDVLTNGAYTSVEHRVLPDAERARTTVVVFQEASVGGLVAPLPGLLDPELAPSEVAKLGDACRNWGFFQLTNHGVDKAVVQRMKDATVQFFSSPLDSKAKVAVRGNGFEGFGHHYSRASSGKLDWAESMILITQPVKDRNMEMWPTNPPTFRDALDVYSVEMIGLAMRLLGFMAADLGVEPEALQDAFTGKRQSMAVHHYPPCRQREKVMGITPHTDGLGLTLLLHVDDTPGLQIRRGGRWFPVRPLPGAFVVNVADILDVLTNGAYTSVEHRVLPDAERARTTVVVFQEASVGGLVAPLPGLLDQQGARARYRSIEIEEYIKGNFNALEQGTRFIQSLRI

SEQ ID NO: 13000 - protein, 462 aa, Thermoactinomyces vulgaris
MANDASTVFDLVILGGGSGGYAAALRGAQLGLDVALIEKGKVGGTCLHNGCIPTKALLHAGEIADQAREAGQFGVKATFEGVDMAAVHKYKDDVISGLYKGLQGLVASRKVHYIEGEGRLSSPASVDVNGQRIQGRHVLLATGSVPKSLPGLEIDGNRIISSDHALKLDRVPKSAIVLGGGVIGVEFASAWTSFGTDVTIIEGLKHLVPVEDENSSKLLERAFRKRGIKFNLGTFFQSAEYTQDGVRVTLADGKTFEAEVLLVAIGRGPVSQGLGYEEAGVAMDRGYVLVDEYMRTNVETISAVGDLVPTLQLAHVGFAEGILVAERLAGLQTVPVDYDGVPRVTYCHPEVASVGITEAKAKELYGADKVVALKYNLAGNGKSKILKTAGEIKLVQVKDGAVVGVHMVGDRMGEQVGEAQLIYNWEALPAEVAQLIHAHPTQSEALGEAHLALAGKPLHSHD

SEQ ID NO: 13001 - protein, 558 aa, Lactobacillus acidophilus NCFM
MKSDIEIAQETKELPIEEIAAKVNLKKEDLEPYGQDKAKINWKAINRIRKNDKLGKLILVTSISPTPAGEGKSTITIGLGDAIHNQLHKNTLIALREPSMGPVFGLKGGATGGGRAQIIPMEDINLHFTGDMHALTAAIDTLAALVDNYIYQDNSLNIDPERILLKRGLDVNDRALRKITVGQGSKFNGIEHKASFAITVANELMAILCLANDINDLKARIGDMLVGYTQDDQPVYVKQLGFQGAIAALLSNALKPNLVQTLEHTPALVHGGPFANIAHGANSVMATNLALHLSDYVLTEAGFGSDLGGQKFMDFVSKHLDKTPDAAVVVATVRALKYQALGSTDKLDEENLDALKTGFKNLERHMNNMRSYNVPVIVLINRFDTDTDKELELLKELVEKQGIKAEVVTYHNEGSKGGSRAAQEVINLADSGKAELISTYNEDDDIKSKIKKIATKIYHADGVEYTDKAEEQIKELAKIGKDKLPVIIAKTQYSFSDDKKKLGAPGGFNLHVKGVSLKNGARFIVVTTGNVLDMPGLPKHPAALDIDVDNDGKISGLF

SEQ ID NO: 13002 - protein, 289 aa, labyrinthulid quahog parasite QPX
KLIEYKTYLQGLPYFDRLDYVSMIAQEHTYSLAIESLLEIQVPIRAQYIRVIFLEITRILNHLLAVSCHALDTGAITPFFWGFEEREKLIEFYERVSGARIHAAYIRPCGVSFDLPKGLLDDIYHFCNQFKVCLDEFEELLTYNRIWRQRLVDIGIVSAKEAKAWGFSGVMLRGSGLCWDIRKNEAYEVYKKLSFNIPVGTNGDCFDRYLVRIEEMRESLCIIFQCINIIPEGPVQSHDLKYRKVGKTIIKNSIEGLIHHFKYSTEGFSVPSGEVYCATEAPKGEFGVF

SEQ ID NO: 13003 - protein, 517 aa, Oryza sativa (indica cultivar-group)
MGSTGDCGNGKAAGGGRGGGLVVPEIKFTKLFINGEFVDAASGKTFETRDPRTGDVLAHIAEADKADVDLAVKAAREAFEHGRWPRMSGYERSRVMNKLADLVEQHADELAALDGADAGKLLTLGKIIDMPAAAQMLRYYAGAADKIHGESLRVAGKYQGYTLREPIGVVGVIIPWNFPTMMFFLKVSPALAAGCTIVVKPAEQTPLSALYYAHLAKLCTFDIIIQAGVPDGVINVIPGFGPTAGAALSSHMDVDSVAFTGSAEIGRAIMESAARSNLKNVSLELGGKSPMIVFDDADVDMAVSLSSLAVFFNKGEICVAGSRVYVQEGIYDEFVKKAVEAAKNWRVGDPFDAATNMGPQVDKVQFERILKYIEIGKNEGATLLTGGKPTGDKGYYIEPTIFVDVKEEMTIAQEEIFGPVMSLMKFKTVEEAIEKANCTKYGLAAGIVTKNLNIANMVSRSVRAGTVWVNCYFAFDPDAPFGGYKMSGFGRDQGMVAMDKYLQVKTVITAVPDSPWY

SEQ ID NO: 13004 - protein, 302 aa, Synechococcus sp. WH 7805
MSPAAELSPTPFGRLLTAMVTPFDAEGAVDLALAGRLARHLVDEGSDGLVVCGTTGESPTLSWGEQVQLLEAVRQAVGPGVSVLAGTGSNCTQEAVKATCEAAAAGADGALVVVPYYNKPPQEGLEAHFRAIAEATPELPLMLYNIPGRTGCSIEPATVARLMDCSNVVSFKAASGSTEEVTALRLACGARLAIYSGDDGLLLPMLSVGAVGVVSVASHLVGRRMRAMVEAYLSGQPAVALGHHEQLIPLFKALFATTNPIPVKAALELSGWPVGSPRCPLLPLDPAMRAALSDTLAALRPT

SEQ ID NO: 13005 - protein, 122 aa, Triticum aestivum
MAPVKMALGPQVPLKDLLHLHKEEEEGEDESLRRWKEQLLGPDAVHTTNLLHALGAVENQKVMLGTFSPQQEPYTYKAEEDSTPSGIFARGSYSARLKFVDDDGKVYLDMRYSFEIRKDWPN

SEQ ID NO: 13006 - protein, 170 aa, Oryza sativa
MDHEADAYRTDLMTITRYVLNEQSRNPEARGDLTILLSHIVLGCKFVASAVNKAGLAKLIGLAGETNVQASVPGNNCHLSQFLVSEIEIGEEQKKLDVLSNEVFVKALVSSGRTCVLVSEEDEEATFVDPALRGKYCVCFDPLRGSSNIDCGVSFGTGVHVNPKRKKLEL

SEQ ID NO: 13007 - protein, 347 aa, Bacillus cereus G9241
MKDLIIIGAGQAGLTTGYYLKQEGYNFLLLEAGNRVGDSWRNRYDSLQLFTPKKYSSLPGMILKGERNEFPHKDEIATYLEEYARHFQLPIQLQTEVFKIKKEKDIFELHTPTEILQTKKVIIATGGFQQPFIPSVSANLSSHVFQIHSSQYKSPSQIPKGKVLVVGGGNSGMQIAVELAKTHEVTLSISHPLTYLPLHLFRKSIFNWLEKLGLLYAEVNTKRGKWFQKRKDPIFGFEGKELIRNGSIQLQEKVVSASENNIMFQNGETYSAERIIWSTGFIQNYNWIEIEKAVDENGLPNHVKGISPVRGLYYIGLPWQSQRGSALICGVGKDALYLLSEIKKIDQ

SEQ ID NO: 13008 - protein, 389 aa, Xanthomonas axonopodis pv. citri str. 306
MRALCWNGVNDLRVETVPDPALVNPRDVILKVGLTTTCGSDLHFIDGYLPTMREGDVIGHEFMGTVVEIGTAVKNVRVGQRVVVPSFISCGGCWHCERKEFSLCDNTNPNWEMQEPLLGHPTAGIYGYTHAFGGYAGSHATYIRVPHADVGCFEVPDGVSDEDALFLSDAGPTGFMGADFCDIQSGDTVAVWGCGGVGLMAQQSARILGAERVIGIDRLPERLAMARDVLGVEVIDYSAVDSVVDVLREMTGGRGPDACIDAVGMEAHGTGIGHTYDRVKQALHLHTDRGQALREAILACRKGGILSVLGVYGVMDKFPLGAVMNKGLTVRTAQQHGQRYVPKLLDLAQAGRLKSGFLLTHKMPLEDAVRGYDMFKHKHDGCVRAGFVP

SEQ ID NO: 13009 - protein, 311 aa, Triticum aestivum
  misc_feature (167)..(167): Xaa can be any naturally occurring amino acid
  misc_feature (257)..(257): Xaa can be any naturally occurring amino acid
  misc_feature (284)..(284): Xaa can be any naturally occurring amino acid
MLPSFSPAATAAATPPPKPIPGGYGAPVLGPLRDRLDYFWFQGPEEFFRRRAVQYRSTVFRANIPPTFPFFVGVNPRVVAIVDTAAFTALFDPELVDKRDCLIGPYNPSDSFTGGTRVGVYLDTEEPEHERTKAFAMDLLRRSSRVWAPEFLEGVDGMLAAIESDLXPPGKEGGASFLVPLQKCIFRVLCRAVASADRAAEELVDRYGLLILDVWLGLQLVPTPKNGANPEAGWRSSSSNLSPFPSILGKPGVQPAXRFVEEDGAASVAVGVKDHGMSEQERIXNLLFPLGFKALGGFSGFLPFFIRKARK

SEQ ID NO: 13010 - protein, 666 aa, Dehalococcoides sp. CBDB1
MSNTKLDSLCINALRFLSVDAVQKANSGHPGAPMGMAAMAYALWQNFLKHNPQDPAWPNRDRFILSAGHASALLYSLLHLTGYDLPLDELKNFRQWGSKTPGHPEYGLTPGVEMTTGPLGQGFASGVGMAMAEAHLAAVFNQPDCKIIDHYTYGIVSDGDLMEGVASEAASLAGHLALGKLIYLYDDNDISIEGSTELAFTENAALRFESYGWQVIDHVDGLDPEAVSQAIKQAQSDTTRPSLIICKTIIGFGSPNKAGKASAHGEPLGTDEVSKSRKSLGWDYEPFVIPVEALTEFREALGKGKTAQQVWLSKLDYYLSHYPEKASLLQDMLSGNLPEDWDKDLDRLFDKAMSSREASGLLINALASRLPSLMGGSADLSPSNKTVIKDGGEYEPHYYEGRNIHFGVREHAMGAIANGLALHGGIIPYVATFLIFYDYMRPAVRLASLMGQRVIYIFTHDSIGLGEDGPTHQPIEQLAGLRSVPGLVTIRPADSYETAQAWKTAILRKNGPTAIALSRQKLPLLDNSQTKSLNLPKGAYILQETDSHPQVALVASGSEVTIAVEAAEILKGKGISSRVVSFPSWQLFDNQPQTYRQSVLPSSLPRVIMEAGNSQGWCKYLGTNGTVISIDHFGASAPAALLYKNFGLTPENMAEKALKLLENEHE

SEQ ID NO: 13011 - protein, 488 aa, Solanum pennellii
MSSFCSKSPAISNCSNDEYSNSSLPVREIPGDYGFPFLGAIKDRYDYYYNLGTDEFFRTKSQKYNSTVFKTNMPPGPFIAKNSKVIALLDSKTFPILFDNSKVEKKNVLDGTYMPSTDFFGGYRPCAFLDPSEPKHARLKGFYLSIISKYHTQSIPIFETSVSALFQNLENEISKNGKANFNDISDAMSFDFVFRLLCDKTTRNVGPKYFDKWMLPQLVPLVTLGLKFVPNFLEDLILHTFPLPFCLVKSIYQKLYDAFSEHAGSILNEIEKSGIKRDEACHNLVFLAGFNAYGGMKVLFPSPIKWVASVGKSLHTRLANEIRTIIKEEGGSITLSAINKMSLVKSTVYEVLRIEPPIPFQYGKAKEDIMVQSHDSNFLIKKGEMIFGYQTFATKDAKIFENPEEFIAERFMGSEGEKLLKYVYWSNARETDDPTVDNKQCPAKDLVVLLCRLLLVEFFMRYDTFTVESRKYLAGSSVTFKTLDKKTT

SEQ ID NO: 13012 - protein, 469 aa, Sinorhizobium meliloti
MTTANEVLKQIKENDVKFVDLRFTDPKGKLQHVTMDVVCVDEDMFADGVMFDGSSIGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKALNAFTNPSTNSYKRLVPGYEAPVLLAYSARNRSASCRIPFGTNPKPNGVEVRFPDPTANPYLAFAAMLMAGLDGIKNKLHPGKAMDKDLYDLPPKELKKIPTVCGSLREALESLDKDRKFLTAGGVFDDDQIDSFIELKMQEVMRFEMTPHPVEFDMYYSV

SEQ ID NO: 13013 - protein, 455 aa, Oryza sativa (japonica cultivar-group)
MSKPQQQSPPSTTTTSPPPPPPSTPPPASSSRSLLSALRRSPVTTLVAAFFLLALFMYGEDVRTLAELSIDDYLYPDADFYNVSALPPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGVPDVWNQILYTRILSKSSPPSTHPSLPPQ

SEQ ID NO: 13014 - protein, 478 aa, Aspergillus nidulans FGSC A4
MKAATPRPSVRALSSGRSYRTARFVSRTSNARSSLAADTNSLLQQAPPSPKKQLASPLAKLPLSSVLRSLLILSVSSSSILLKPCIYTLSALAHPKTALLDVAKNPLLNLLVKHTIYKQFNAGENKLEVQRSINAIKELGYRGVLLGYAREVLVGESKTDPRDEQASRQEIQTWLDGTLQTVDMAQEGDFVALKFTGMGIQALEYLQNQAPPSPFMDEAIKQVCDLAISRNVRLLVDAEEQAVQPGIEEWATMYQKYCNSRTPGRAIFYNTYQAYLCSTPATLARHLEISRKEGYTLGVKLVRGAYLKTEPRHLIWAKKEQTDECYDGIVEALLTRRYNHMLKPASAEHTTELPPVSVIVATHNRDSVRKAHALRLEQASRGEKSDVELSYAQLQGMADEISCELLQGFQTAGPENTKVAESPNVYKLLTWGSVKECMGFLLRRAVENTEAVGRTKQSQEAMFSELRRRARRAFGLRY

SEQ ID NO: 13015 - protein, 582 aa, Cryptococcus neoformans var. neoformans JEC21
MVLRHLTRLSPCLRVSKSFAPISMRYSSSVPSNTPTTPSLFTPEGDPANAKPFYVTTPIFYVNASPHVGHLHSLLLTDVLARFSRLRHPQRKVVFATGTDEHGLKIQQAAKANGVGEQEFCDDVSQRFRKLAKLANASNTDFIRTTELRHVKAVEQFWNTLVASGDIYKGTHSGWYSISDESFYAVSQVTKSPEDGKMIAIETGNEVIWEEETNWKFRLGRHKKVLEKWLSQPESVHPNTVRLDLLRQLSSLEDLSVSRPSSRVKWAIPVPGDPEQSIYVWVDALINYITVLGYPDWEGKGESVGWPADVHVVGKDIIKFHALHWPSLLHSASLPAPKRIIAHAHWTMSHTKMSKSRGNVVDPISAMTQWGEDGVRWYLMRVGGGLVDDADYNPAEVEVHYRLLADQVGNLLSRISGAKVLKKAEREFDWGNEKTRDRGEDRDEELDGMMARMREEFEGKMEVFGVSQACAGVMDVVMATNKLFTSLAPWSPSTPSSVPALTYAYHALRLSAILLQPIIPAKAGEALDRLGVPAEERSWVDAEWPPSEEKVLRTEKMVERLKEASKKWKGKGHLFPLPGKDA

SEQ ID NO: 13016 - protein, 147 aa, Listeria innocua Clip11262
MEQTYVMVKPDGVERGLIGEIVAKIEKKGIKLVAGKLMQIDRTLAEQHYAEHIGKPFFEDLIGFITSGPVFAMVLEGDDVIKTARRMMGKTNPLEADPGTIRAEYAIHTNRNVIHGSDSPESAKREIQLFFEPHEILSYEKAVDTWI

SEQ ID NO: 13017 - protein, 333 aa, Aspergillus oryzae
MDIREPPVIDFAPFYGPEGAAKERLINELRQACKQFGFFQLINHTIPASLQESVLQQSKEFFELPISTKEKYKKGLNGDNRGYEGFRAQNFEKRGKGDLKEGFYLGKDLPLDDPQVVTRKFDKGPNKYPLEVSEPAKFRAVMDEYHEAMTSLAMGILRMLALTLELEESAFDAFCEHPIAILRLLHYPPQDPDSSDIERGIGAHTDFGGITILLQDTTGGLQVWNNVSSEWVDVTPVPGAYVVNLGNMMMRWTNDRYLSNLHRVINKSGKERFSVPFFLSGNPDYIVECLPTCIGAGPKYPPITVGQWMAGRYADTYGTSNEEAISDMREVPS

SEQ ID NO: 13018 - protein, 318 aa, Cryptococcus neoformans var. neoformans JEC21
MNRQGAEAFAKLAQQLNRARMQASGGGGGGGRGGGQMPGGFKGFMAGSGAIGTLVVGAIALNYSLFNVDGGHRAIKYSRLQGVKADIYPEGTHLVLPWFEHPVIYDVRAKPRNIASLTGTKDLQMVNITCRVLSRPSVNDLPTIYRELGTDYDERVLPSIVNEVLKSVVAQFNASQLITQREMVSRLVRENLTRRARRFNLILDDVSITHVAFSPEFTHAVEAKQVAQQIAQRAAFLVDQAIQEKQSIIVKAQGEARSAELIGEAVKTNKGFLQLRKLEAAREIAGTLAQSGNRVMLDAKSLLLDVTEDEVLNATLRK

SEQ ID NO: 13019 - protein, 257 aa, Coprinopsis cinerea okayama7#130
MSQSREDSVYLAKLAEQAERYEEMVENMKRVASSDQELTVEERNLLSVAYKNVIGARRASWRIVSSIEQKEESKGNEAQVQMIKGYREKIESELAKICEDILDVLDKHLIPSAASGESKVFYHKMMGDYHRYLAEFATGDKRKDSADKSLEAYKAASDVAVTELPPTHPIRLGLALNFSVFYYEILNSPDRACHLAKQAFDDAIAELDTLSEESYKDSTLIMQLLRDNLTLWTSDMQDSADKPSEGKDEAGDAPADE

SEQ ID NO: 13020 - protein, 381 aa, Aspergillus oryzae
MRWFTIERLFFIWKLLKYQYSNPSFVLKAVKDVAFEDRPVPALQDPWDVRVQIAQTGICGSDVHYWQRGRIGDFVLTSPIVLGHESSGTVMDVGSAVKNLKVGDRVAIEPGIPCRHCEYCHSGSYNLCPNDRFAATPPHDGTLSKYYITQSDFCYPIPDHMNMEEGAMVEPVAVACQITKVGNVRANQKIVVFGCGPIGLLCQAVSKAYGAKKVIGVDISKSRAEFAKTFGADDVFVPPPPPADVSPEEWSEKLAKIIKEQFDLGEGPDVVLEATGAQPCIQTGIHLTKKGGTYVQAGMGRENVMFPITTACIRDLTIRGSIRYSTGCYSTAVDLIASGKVDVKRLITNRYTFEEAEQAFELVRQGKESVIKVIIEGYQGR

SEQ ID NO: 13021 - protein, 232 aa, Rhodopseudomonas palustris CGA009
MDKEELKRRAAARALEEVRGGMKLGLGTGSTAKHFVELLGERVRLGLEIIGVPTSEVTRADAERCGIRLTSLDEIDRLDITIDGADEVDHHLDLIKGGGGALLREKIVAAASDRMIVIADESKLVDTLGRFPLPIEVIPFGLGATRRALQNAFTAAGCDGELKLRPGKDGHAFVTDGGHWILDAQLGRIPDAPRLAQLLSVIPGVVEHGLFVGMASTVVLAGADGIRTIERA

SEQ ID NO: 13022 - protein, 123 aa, Brassica napus
  misc_feature (18)..(18): Xaa can be any naturally occurring amino acid
  misc_feature (45)..(45): Xaa can be any naturally occurring amino acid
SHMIFTLVFVLTYQKYGXKRFIKLLGWIIAILQSLLIIASRKHYXVDVVVAWYTVNLVVFFLDKKLPELPDRTTVLLPVSSKDRTKEENHKLLNGNGVDPADRRPRAQVNGNVGHTDNATNGA

SEQ ID NO: 13023 - protein, 461 aa, Rhodopseudomonas palustris CGA009
MADFDADLFVIGGGSGGVRAARIAAGYGARVVVAEEYRFGGTCVIRGCVPKKLMVYASQVHEEIRDAAGFGWSIPTAEFNWSALIANKDKEIARLEQIYANNVEKAGARTIKARAVFDDPHTLLLSTGEKVRAKTILIATGGAPNHGKPIPGIEHVISSNEVFHLPQQPKRILIQGGGYIALEFACIFAGLGSDVTLVYRGDNILRGFDEDVRTHVRTEMERAGITIITGCTVTAVEKLGEEYTSHLSSGSSIASDQVMFAIGRHPAVASLGLEKAGVAINPDNGGIAVDDHCRTSVPHIYAVGDVTHRTNLTPVAIREGHAFADNVFGGKQIQVDYAYVPTAVFSQPQVGTVGLTEAQARAQYSVVDIYKTDFRPMKGTMSGSQSRVLMKLIVDGTTDRLLGCHIVGPDAAELVQVVAVAMKMKATKADFDGTMALHPTAAEELVTMRTRTARYQREAAE

SEQ ID NO: 13024 - protein, 300 aa, Salmonella typhimurium LT2
MTMVRIACVGITVMDRIYYVEGLPTEGGKYVAKRYTEVGGGPAATAAVAAAKLGAQVDFIGRVGDDDTGNSLLAELESLGVNTRYTRRYTQAMSSQSAIMVDAKGERIIVNYPSPDLLPDADWLNDIDFSQWDVVLADVRWHDGAKQAFTLARQAGVMTVLDGDITPQDISELVALSDHAAFSEPGLARLTGMSEAIDALKKAQMLTNGHVYVTRGSEGCNWLEKAAVRHQPGFTVEVVDTTGAGDVFHGALAFGLASGYAIEEAVRFASGVAALKCTRPGGRAGIPDCEQTRSFLSLFV

SEQ ID NO: 13025 - protein, 93 aa, Glycine max
  misc_feature (44)..(44): Xaa can be any naturally occurring amino acid
GVGKERSKEHRKVFCYNIQGITKPPIGRLVPKGGVKKISGLIYXKTRGVLKIFLENVIRNAVTYTEPAKRKTVPAMDVVYALKRKGRTFYGFG

SEQ ID NO: 13026 - protein, 472 aa, Bacillus cereus G9241
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLIGMWFNDDTRISLVVGIVFLAIVTISFYAFGIGKRPPLDVPNDQEISSK

SEQ ID NO: 13027 - protein, 166 aa, Tridax balbisioides
MFPMVTEFMNYGQQTVRAARYIGQGFMITLAHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 13028 - protein, 444 aa, Xanthomonas axonopodis pv. citri str. 306
MSADTAASAPSSTTAIGGLGDHQASVSVPNSGHWWSRLLAFLGPGYMVSVGYMDPGNWATDLAGGSQFGYLLLSVILLSNLMAIVLQGLSARLGIATGLDLAQACRARYPRGVNLALWGICELAIIACDLAEVIGTAIALKLLFGIPLTMGAIITAVDVVLVLLLMNRGFRALEAFVIALLLIIFACFGIQIALAAPPIAAVLGGFIPRAQVVTDPQALYLAIGIIGATVMPHNLYLHSSIVQTRAYPRTDVGRKSALRWAVTDSTVALMFALFINASILILAAAVFHAQGRTDVQEIEQAHALLAPMLGVGLASTLFAVALLASGINSTVTATLAGQIVMEGFLQLRLPPWIRRLLTRGIAIVPVVIVTWLYGEAGTARLLVLSQVVLSMQLPFAVIPLVRFVSDRQLMGALVAPAWLVRIAWVIAAVIVCLNLKLLWDTALH

SEQ ID NO: 13029 - protein, 321 aa, Glycine max
  misc_feature (43)..(43): Xaa can be any naturally occurring amino acid
KEGKDVDGGAFFPANPSTNSVPPKFNSQPNQSVPFSQNPVFFXTAKCQQQQKTQEDGIPADEVKILAKFKSRHNYIRVLEVSRKAEHPFRGSRLLLLDTPGNIHSISFLFKSLTNTYFDVFATLPPIVPPGPLALLGFGAGTAARLLLLHHPSALLHCWELDPAVIQVAREYFNLARLERDNQDRLFIYVGDALNATVPNGFSGIVVDLFSKGSLIPELQDPATWRMLRGRLRKGGRIMVNVGGSCVEAENRLRDGKVVMEETLGAMKEVFGKKVFVLSLGNRKDDSSLALTGDLPHLEEWKNRLPGPFKCYADMWTPYSQ

SEQ ID NO: 13030 - protein, 291 aa, Oryza sativa (japonica cultivar-group)
MGRSKREVAPPPPPSPSQASPGSFASGMMLPGSLGSGAWQGPAPPQPPHPLLYAYGAAASAFPMAQMKQGLDRSAIDLSDLQERGMDFHPPGGFLSYFQDPSILQNHRPFVPPNYYPAEQVAPCSKLRPGAQQPVNIDSGDEEAHTVRTEKRLTWSTEEDIRLVSAWLNNSNDSISGNFKKNDRYWGDVTAEYNSTTPKNRTRQEKQIKDRFHKIKKNVGRFCCVYKEVKSIYVSGQNDMQLREKAEAAYQADYKEGPFSFLHCWNILRDQPKWHSYLEELEKPNKPKMDD

SEQ ID NO: 13031 - protein, 792 aa, Xanthomonas axonopodis pv. citri str. 306
MNENILWLHELRLADLARVGGKNSSLGEMIGNLAGLGVSVPGGYATTAEAFKDFIAHNDLSKRIFDRLATLDVEDVNALTLAGKEIRGWVIDAPLQPDLDRDIRSAYAQLCAENGGGDVAVAVRSSATAEDLPDASFAGQQETFLNVTGADDVVHKVKEVFASLYNDRAIAYRVHHGFKHEDVFLSAGVQLMVRSGVGAAGVLFTLDTESGFRDVVFVTSSFGLGEMVVQGAVNPDEFYVYKPTLTAGKPAILRRSLGSKAIRMVYSDVPGERVRTEDTPVELRSTFSISDEDVQELSKQALVIEKHYGRPMDIEWAKDGVSGKLFIVQARPETVKSRSHATQIERFALEAKGAKILAEGRAVGAKIGSGVARVVRSLDDMNRVQAGDVLIADMTDPDWEPVMKRASAIVTNRGGRTCHAAIIARELGVPAVVGSGNATDVLSDGQEVTVSCAEGDTGFIYDGLLPFERTTTDLGNMPPAPLKIMMNVANPERAFDFGQLPNAGIGLARLEMIIAAHIGIHPNALLEYDKQDADVLKKIDAKIAGYGDPVSFYVNRLAEGIATLTASVAPNTVIVRLSDFKSNEYANLIGGSRYEPHEENPMIGFRGASRYVDPSFTKAFALECKAVLKVRNEMGLDNLWVMIPFVRTLEEGRKVIEVLEQNGLKQGENGLKIIMMCELPSNALLADEFLEIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLKSEG

SEQ ID NO: 13032 - protein, 321 aa, Listeria innocua Clip11262
MKLNFLYPNMQKDIDLVEKELKRALTGAAAETTSDAALHLLEAGGKRIRPMFVCLSARLSPDADFEAVKNAGVAIELIHMASIVHDDVVDDADLRRGRETIKSKWGNHIAMYTGDFLFAKSLEYMTEIKDVAAHKMLSHVTVELSTGEIEQLKDKYNFDQSVRNYLRRIKRKTALLIAASCGLGGVVSGQSEADYKKLYRFGYYVGMAFQITDDVLDFVGTEKELGKPAGEDLSQGNVTLPVFFAMEDPFLKKRISQVTEDTQAEEIAVLVEEIKKSGAKKAEDVATAYLKKAVATLDSLPQVPELKPLKQIVRVLDKRNY

SEQ ID NO: 13033 - protein, 397 aa, Magnetospirillum magnetotacticum MS-1
  misc_feature (348)..(348): Xaa can be any naturally occurring amino acid
MPSDIEIARAATLKPIAEVAGKLGVPDEALHNYGKHIAKIDHGFIKSLEGKPEGKLVLVTAISPTPAGEGKTTTTVGLGDALNRIGKKAVMCLREPSLGPCFGMKGGAAGGGKAQVVPMEQINLHFTGDFHAITSAHSLAAALIDNHIYWANELNIDVRRIHWRRVVDMNDRALRAINQSLGGVANGFPREDGFDITVASEVMAVFCLAKDLADLEERLGRIVIAETRDRKPVTLAEVKATGAMTVLLKDALQPNLVQTLEGNPALIHGGPFANIAHGCNSVIATRTGLRLADYTVTEAGFGADLGAEKFIDIKCRQTGLKPSAVVIVATVRALKMHGGVNKKDLSGXEPRRAGEGLRQPRAPCEERAQLRPAGGGRCEPLLPGHRCRARQAQGLPR

SEQ ID NO: 13034 - protein, 347 aa, Rubrobacter xylanophilus DSM 9941
MKALVYHGPGEKSWESKEDPRIERPTDAVVRIDTTTICGTDLHILKGDVPEVAEGRTLGHEAVGTVVDAGPGVENFEEGDRVLVSCISACGRCAYCRRGMYGQCLQGGGWILGHLVDGTQAEFARIPFADNSLYEVPEGLSDEQVVFISDILPTGYEVGVLNGKVEPGDTVAIVGAGPIGLASMLTARLYGPSRIIAIDLADSRLEQARRFGADTTINNSAQDAVEMVMELTGGLGADVVMEAVGVPATFELCTGLVRPGGHVANIGVHGAPATLHLERLWARDVTITTGLVDTYSTPTLLRLVAEGRLDPTPFATHRFALGEILDAYETFADAARTQALKVVLSAE

SEQ ID NO: 13035 - protein, 572 aa, Aspergillus nidulans FGSC A4
MQSSMLLRVRALPKTASVLSRTKTATYATYKVPRIDNEPNKHYAAGSPDRKALQEALARTQRNAPLSVPLVIAGKEVKSSSSLTQSNPASHGPVATYSNATAKDVQAAIESALEARKSWASTPFADRASVFLKAADLISTKYRYDVMALTMHGQGKNAWQAEIDSAAELCDFFRFGVKYAEDLYAQQPVHHAPGVWNRVEYRPLEGFVYAISPFNFTAIGGNLAGAPALMGNVVVWKPSPSAIASNWLVHQILLEAGLPKNVIQFVPGEAEEVTKTVLDHPDFAALHFTGSTNVFRNLYGQISTRVAAGKYRSYPRIVGETGGKNFHLIHKSADIRNAAVQTVRGAFEYQGQKCSATSRVYVASSIADSFLEQVASEAKSLKVGPPSDFTNFCGPVIHEASFTKLAKVIDEAKNDPELELLAGGSYDSSKGWYIQPTVYRTTNPDHPLLTRELFGPILVVYAYPDATEADFARIAQKIDATGEYGLTGSVFAQDREALAVANDVLRNAAGNFYINCKSTGAVVGQQPFGGARASGTNDKAGSGNLLSRFVSLRSIKEEFVPTYKVAYPSNEA

SEQ ID NO: 13036 - protein, 550 aa, Amaranthus tuberculatus
MSAMALSSSILQCPPHSDISFRFFAHTRTQPPIFFGRPRKLSYIHCSTSSSSTANYQNTITSQGEGDKVLDCVIVGAGISGLCIAQALSTKHIQSNLNFIVTEAKHRVGGNITTMESDGYIWEEGPNSFQPSDPVLTMAVDSGLKDDLVLGDPNAPRFVLWNGKLRPVPSKPTDLPFFDLMSFPGKIRAGLGALGLRPPPPSYEESVEEFVRRNLGDEVFERLIEPFCSGVYAGDPAKLSMKAAFGKVWTLEQKGGSIIAGTLKTIQERKNNPPPPRDPRLPKPKGQTVGSFRKGLIMLPTAIAARLGSKVKLSWTLSNIDKSLNGEYNLTYQTPDGPVSVRTKAVVMTVPSYIASSLLRPLSDVAADSLSKFYYPPVAAVSLSYPKEAIRPECLIDGELKGFGQLHPRSQGVETLGTIYSSSLFPGRAPPGRTLILSYIGGATNLGILQKSEDELAETVDKDLRKILINPNAKGSRVLGVRVWPKAIPQFLVGHFDVLDAAKAGLANAGQKGLFLGGNYVSGVALGRCIEGAYDSASEVVDFLSQYKDK

SEQ ID NO: 13037 - protein, 456 aa, Clostridium thermocellum ATCC 27405
MMNANFMEFEKNKLEELTELATKCSYIDPELFVKYQVKRGLRDLDGKGVLVGLTEIGEVHSYIIDENEIVPVPGRLIYRGIDIFDLVDGFISEGRFGFEETTYLLLFGDLPTREQLNEFEKLLSSYRELPEEFLNDMILNLPGKDIMNVLARSVLAYYTYDSNPDDTSVKNVLRQCMRLIGSMPTIAVYAYQAMAHYYDRKSLVIHPPRPELSTAENILHMLRPDSKYTDLEARLLDLALVLHAEHGGGNNSTFVTHVVTSTGTDTYSVIAAALGSLKGPRHGGANIKVCQMFEDLKQNVRDWKDDEEIENYLMKLLNKEAFDRAGLIYGIGHAVYSISDPRCILLKEQAEKLAKEKGLEDEFELYDRVERLAPQIIGRVRKMYKGVSANVDFYSGFVYKMLNLPLELYTPIFAISRMSGWAAHRIEEIVNAGKIIRPAYKSVAERRDYVAMKDRK

SEQ ID NO: 13038 - protein, 530 aa, Bordetella bronchiseptica RB50
MHQRILILDYGSQVTQLIARRVREAGVYSEIHAGDVDDAFVRDQVAQGLKGIILSGSHASAYEEGSMRVPAAVFEVGVPVLGICYGMQSMAQQLGGTVSFSDHREFGYAEVRAHGHTKLLDGLADFTTDEGHGMLKVWMSHGDKVTELPPGFKLMASTASCPIAGMADEDRGFYAVQFHPEVTHTVQGKAMLARFVKDICGCEGDWNMPDYISEAVARIREQVGSDEVILGLSGGVDSSVAAALIHRAIGDQLTCVFVDHGLLRLDEGKQVMQTFAENMGVKIVHVDATSQFMGKLTGVADPEAKRKIIGREFVEVFQDEAGKLQGAKWLAQGTIYPDVIESAGAKTGKATSIKSHHNVGGLPDTLNLQLLEPLRELFKDEVRELGVALGLPPQMVYRHPFPGPGLGVRILGEVKHEYAELLRRADAIFIEELRNAKDPASGLTWYELTSQAFAVFLPVKSVGVMGDGRTYEYVVALRAVQTFDFMTADWAPLPHPLLARVSSRIINEVRGINRVVYDVSSKPPATIEWE

SEQ ID NO: 13039 - protein, 335 aa, Streptomyces clavuligerus
MTIRVGINGFGRIGRNYFRALLEQGADIEIVAVNDLGDTATTAHLLKYDTILGRLKAEVTHTADTITVDGHTIKVLSERNPADIPWGELGVDIVIESTGIFTKKADAEKHLAGGAKKVLISAPAKDEDITLVMGVNQDTYDPAQHHVISNASCTTNCVAPMAKVLDENFGIVRGLMTTVHAYTNDQRILDFPHSDLRRARAAAENIIPTTTGAAKATALVLPQLKGKLDGIAMRVPVPTGSATDLVVELSREVTKDEVNAAFKKAAEGELQGILSYTEDPIVSSDIVGDPASCTFDSSLTMVQEGNSVKILGWYDNEWGYSNRLVDLTVFVGEQL

SEQ ID NO: 13040 - protein, 403 aa, Streptomyces clavuligerus
MKTIDQLLAAGVAGKRVFVRADLNVPLDGTTITDDGRIRAVAPTVARLAAAGARVIVASHLGRPQGAPDPAFSLAPAARRLGELLGTDVAFATDTVGDSARAVVASLADGQVAVVENLRFNPGETSKDDAERGAFADRLASLADLYVGDGFGAVHRKHASVYDLPARLPHAAGELIATEVGVLKQLTDDVRRPYTVVLGGAKVSDKLGVIDHLLEKADRILIGGGMAYTFLKAQGHEVGISLLQEEQVPTVQGYLERARERGVELVLPVDVLVSPAFPDLRTKAPAHPTTVSADAIPADQEGLDIGPESRKLFASKIADSATVFWNGPMGVFEHPDFAEGTKAVAQALVDSPAFTVVGGGDSAAAVRILGFDENAFGHISTGGGASLEYLEGKTLPGLAALED

SEQ ID NO: 13041 - protein, 724 aa, Methylococcus capsulatus str. Bath
MRKVDDTLPARRVFLGVLRIGPGRGPAAMTVPAKFDYSTGSPLPLGVHFQGTDANFALFSRHGSRVRLLLFADPSHTRPHQVIDLDPHHHRTGDIWHVAVHGAHRGLAYAFQVDGPHEPHLGHRFDPQAVLLDPYATALVTPEHWEFSGAAVGGPEGVVAKALVTADHFDWGHDRPLKHHWSELVIYEAHVRGLSIHPSSAVRHPGTYLGVIDKIPYFKRLGITALELMPLQAFNPYEVTRYNPVTGERLRNYWGYNTIAFQAPHAGYGTGAYPGCQVEEFKRMVKALHEADIEVLLDVVFNHTAEGDETGPILNFRGLDNSIYYLLEEDRRHYRNYSGCGNTVNCNHPVVRSYILDCLRYWVVEMHVDGFRFDLASILGRDRNGHLVPNPPLLELIAEDPILRDVKLIAEAWDAGGAYLVGRFPGERWCEWNGVYRDDVRRYWRGDPGMAGAFASRLCGSADIYEHSGKAPVNSINFVTCHDGFTLNDLVSYACKHNSANGEDNRDGSDHNFSANYGCEGPTGDHGINAVRRRQMKNLMASLLLSRGVPMILGGDEFCRTQRGNNNAYCQDNEISWFDWRLLDENRSFFEFVRKMIAFRARHPVLSREQFYRPEDILWFSPAGGQPDWQADAALGCCIRAVGGEEQPLCLLFNPTAEGLCFRLPDTLRGGVWIKAVDTAVESPCDICELEGGSPLPDQRRLFLPDRSLVVLVEGAATAAAARA

SEQ ID NO: 13042 - protein, 103 aa, Medicago truncatula
MPSSHSATVSALAVAIGFQEGIGSSVFAIAVILACIVMYDATGVRLHAGRQAELLNQIVCELPPEHPLSNVRPLRDSLGHTPLQVVAGGLLGCIIAFLMRKSS

SEQ ID NO: 13043 - protein, 1217 aa, Oryza sativa
MSLAGSALEAALQAVGRGLDAAGDHRLLYCKGTGRLLMLDESRARDLTINGGVLRGVPPDVVVEEGHGILERIRQVPGPPTDEPVVCSFPKMAECFNRKAGLLETTVPLGSFNSLFSFTGSWKNDEAATKSLAIDGYSVPLFKVKITSGELFLHESVKRAIPHSWDPSALASFIENYGTHIITSVTVGGKDEVYIKQHSSSQLSELEFRNYVKEIGSERFSDGDSKLNATPINYSEKDMTVIFRRRGGCDLVQNFNDWIKTVQSAPDVIGMTFLPIVSLVGDMPGKKHLARAIELYLKYKPQIEELQYFLDFQVQLVWAPVPPGIAGQHRKEPVCPSLQFSLMGPKLFVSTEQISVGRRPVTGLKLCLEGAKQNRLAIHLQHLGSLPKIFVPHWDSHITIGPPKWQGPEEQDSRWFEPIKWRNFAHVSTAPIEYTETSITDLSGVYIVTGAQLGVWDFGAKSVLHLKLLFSRVPGCTIRRSVWDHSPSSSLVHRTDEASSSSSDNAKLVKIVDMTETLKGPQDAPGHWLMFGKVEAQQLLWSIDLQICSAIYSVDREMHHYLFGKLPKIRQSSEDPFTKQDALYGQANAPSICHSIHLEFLAKMENEEMSKVTQANGIDSREHKGQSIAVEANSKGETREVVEGKVDWRGRPAIRGSHGGVANSFFILVNFGLENLASLSLAVNLIIYFMTVMHIGLTDGSNLLTNYMGTSYMVAVLISVFADTFIGRYKTVIISSVIELVGLLILTLQAHSNKLKPPYCVFPFDPKCETVSGDGRTHLYVGLYLVAIGSAGIKAALPAHCADQFDEKHPTEKLQMSSFFNWLLLSLCTGGAISVTVFVWIQSYKGWDKGFGAATGVMGLALLVFIAGLPGYRISVVQGSTALLEILQVYVAAIRNRNMKLPENPDELYEISKSKAPPDTDFMAHRDKPFRFLDKAAIVQAPTDEAPSPWRQCRVTQVEHAKTVLAMVPIFCSAIIMSTCLAQLQTFSIQQGVTMDRTIGTFKMPPASLPIIPLIVLVFAVPIYERGFVPFARRITGHPNGIPHLQRVGVGLVLSIVSMAIAAVVEVRRKRVAARHGMLDANPILGKQLPISCFWLAPQFTVFGVADMFTFIGLLEFFYSQAPPALKSMSSSFLWCPMSLGYFLSTIIVKAVNAATRGATASGGWLAGNNINRNHLDLFFWLLAVLSFLNFLNYLFWASWYKYKPQQSAHVPAEHKV

SEQ ID NO: 13044 - protein, 326 aa, Rickettsia prowazekii str. Madrid E
MQITVREALRDAMQEEMLRDEKVFVIGEEVAEYQGAYKVTQGLLEQFGSKRVIDTPITEYGFAGLAVGAAFAGLRPIVEFMTFNFAMQAFDHIVNSAAKTHYMSGGQVKCPIVFRGPNGAASRVAAQHSQNYTACYSHIPGLKVVAPYSAEDHKGLMLTAIRDDNPVIFLENEILYGHSFDVPDIIEPIPFSKAKILKEGSNVTIVTFSIQVKLALDVVNILQNDNIDCELIDLRTIKPLDTDSIIESVKKTNRLVIVEEGWFFAGVGASIASIVMKEAFDYLDAPIEIVSGKDVPLPYAVNLEKLAMPSANDLIEAVKKVCYYSI

SEQ ID NO: 13045 - protein, 114 aa, Methylococcus capsulatus str. Bath
MNIVQQLESEWMSGKTIPAFGPGDTVVVQVKVKEGNRERLQAFEGVVIAKRNRGYNSAFTVRKVSHGEGVERVFQTYSPQVEEIQVKRRGDVRRAKLYYLRDRAGKAARIKEKI

SEQ ID NO: 13046 - protein, 605 aa, Rickettsia prowazekii str. Madrid E
MTSIRNIAIIAHVDHGKTTLIDNMLKQSGTFRANQAVAERAMDFNELERERGITILAKCTALMWNEIRINIVDTPGHADFGGEVERILSMVDGVVLLVDASEGPMPQTKFVLSKALNLGLKPIVVINKIDRDDQRIKEVIDEVFELFVALEADNDQLDFPIVYASGRAGTASLNFDNKINPLDNLAPLFNLIVTHVPTPAADHKAPFSMLVTTREYNPFFGRVLTGRVQSGTLKINQNVQVLNHENKVLETGRITKILAFRGLERIAIDNAKAGDIIAVAGVENANVSDTICAPEVTKAIPSLPIDPPTLSMTFSINDSPLAGSEGTKITSSLIGARLMRELESNVALKVTETTDKNTFQVAGRGELQLSILIETMRREGFELSISRPEVLCHTDKKGNKQEPIEEIQIDVDDDYVGVVVKSLALRKAEMTNIRPSGGGKSRITFIGPSRGLIGYYSQFLTETRGTGIINRIFYGYTDYKGPIEGRRKGVLISNCDGEAVTYALWNLEERGKMFINPGDKVYRGMIIGEHNRDNDLDVNPLKAKQLSNVRAAGKDEAIRLTPPMLLTLEQAISYIQDDELVEVTPKSIRLRKALLNPNDRKRAAK

SEQ ID NO: 13047 - protein, 339 aa, Flammulina velutipes
MAVKVGINGFGRIGRIVLRNALQVGGIEVVAVNDPFIDLEYMVYMFKYDSVHGRFKDDVHTKDGKLFIAGKPIAVFNERDPANIPWSSAGAEYIVESTGVFTTIDKASAHLKGGAKKVIISAPSADAPMFVCGVNLDKYDPKFKVISNASCTTNCLAPIAKVMHDKFGIVEALMSTIHASTATQKTVDGPSNKDWRGGRAVNNNIIPSSTGAAKAVGKVIPSLNGKLTGLAFRVPTLDVSVVDLVCRTEKSATYEEIKAAMKEASEGSLKDILGYTEDSVVSTDFVSDNRSSIFDAAAGIQLNGNFVKIIAWYDNEWGYSRRVCDLLVYAAQQDAKAQV

SEQ ID NO: 13048 - protein, 257 aa, Oryza sativa (indica cultivar-group)
MAATRVWLSALLLAFLLAAAPVVQVARAQSEEEAATAEVVDGADLGIVSDDTQVSSDGPLSPAPGVETVCVFPKNAGKIVLAGEETELLVGLQNEGESTLNVVAIHSTLHLPFDHKMYGQNLTVQNFFNASVPVSVQATFPYTFAVSKFLQPGAYDLVGYIVYEIDQNPYQNVFYNGTVEVVEAGGLLSVESVFLITLGVALLGLFGLWAYGQVQQLSKKTKKAPKVELGTGTTDANMDEWLEGTAFAQGSKSKKKK

SEQ ID NO: 13049 - protein, 452 aa, Zea mays
MATSPAASSSSAPTASAVAAATMAVEATDGPVLSVVSKRLRALRKKYNRITQMEESLAAGKTLNREQEEVLRSKPVVAALIDELERLRPPLASALAEELSSRPAPAPSAASSSDSDSSVQDLLALVYFGSLFDVKQQSDFVSLVYTRELERSSCLTYDYVGDDPEDSLAETDLNAVSALASLAALRPPAAAGVSHRDALQACAHHARLWLCRADEPIHPDSTITYAGVRAKLDRIMASGYFTAQLEMRTPLDLAAAVASFGAGGVQVQESMVVSPQAPEAVEESQAVEGHKNEKEDSQATEIYNDHPVVDSEHVEDEVLVHPTDEVPPAETEQEQETFDADVKDQEQKDQQFIQRRSYQNQRGGGRGGSRRGYPNGRGGRGGRGGGYQNGRGGYQNGRGGAGGYYYESGYYQPRNYNRGRGGRSGGGNSYYNSHGGGAQGHHPGSVELGANA

SEQ ID NO: 13050 - protein, 473 aa, Pseudomonas syringae pv. tomato str. DC3000
MSSSSTTAAADTQGRQNASPNRLIFISVLVATMGALAFGYDTGIIAGALPFMTLPADQGGLGLNAYSEGMITASLIVGAAFGSLASGYISDRFGRRLTLRLLSVLFIAGALGTAIAPSIPFMVAARFLLGIAVGGGSATVPVFIAEIAGPSRRARLVSRNELMIVSGQLLAYVLSAVMAALLHTPGIWRYMLAIAMVPGVLLLIGTFFVPPSPRWLASKGRFDEAQDVLEQLRSNKDDAQREVDEMKAQDEQARNRPKAKELLRQRWVIKLLLIGIGLGFTAQLTGVNAFMYYTPIILKNTGMGTNAALTATIGNGVVSVIATLLGIWAIGRYGRRHLLMTGLVMVILMQAALGCVLQFMPQNLTQSYTALACILVFLLFMQMCISPVYWLLMSELFPMQVRGLLTGTAVSMQWLFNASVAFTFPIAVDTIGNPTFFIFAAINVGSLIFVFLCLPETKGKSLEQIEKHLKKEL

SEQ ID NO: 13051 - protein, 552 aa, Amaranthus tuberculatus
MSAMALSSSILQCPPHSDISFRFFAHTRTPSPIFFGRTRKLSYIHCSTSSSSTANYQNTITSQGEGDKVLDCVIVGAGISGLCIAQALSTKHIQSNLNFIVTEAKHRVGGNITTMESDGYIWEEGPNSFQPSDPVLTMAVDSGLKDDLVLGDPNAPRFVLWNGKLRPVPSKPTDLPFFDLMSFPGKIRAGLGALGLRPPPPPPSYEESVEEFVRRNLGDEVFERLIEPFCSGVYAGDPAKLSMKAAFGKVWTLEQKGGSIIAGTLKTIQERKNNPPPPRDPRLPKPKGQTVGSFRKGLIMLPTAIAARLGSKVKLSWTLSNIDKSLNGEYNLTYQTPDGPVSVRTKAVVMTVPSYIASSLLRPLSDVAADSLSKFYYPPVAAVSLSYPKEAIRPECLIDGELKGFGQLHPRSQGVETLGTIYSSSLFPGRAPPGRTLILSYIGGATNLGILQKSEDELAETVDKDLRKILINPNAKGSRVLGVRVWPKAIPQFLVGHFDVLDAAKAGLANAGLKGLFLGGNYVSGVALGRCIEGAYDSASEVVDFLSQYKDK

SEQ ID NO: 13052 - protein, 460 aa, Cryptococcus neoformans var. neoformans JEC21
MPRISVPAFAKTVSSRLNFTSTRTLLYTRRMSTTPNAVIPQAKRMFDGATHKLDVWSIFTPANVPADCINLGQGFMNWAPPDWIRAESHESMDHDIMSNHYSHPRGRPRLLKAISKHYSPQFENIVARGKDLTNEEILVTSGANCGMFAALTAHCEPGDEVICIEPYFDQYFASIHFQGAKPVFVPLHPPTGKGIKHGGDWTLNIDEFAAAFTPKTKAVIINTPHNPVGKVFTKEELEQIAKVCIEKNVLVLADEVYDCMVYDGNKHFRIATLPGMWERTLTVGSGGKSFACTGWRVGWLIGPPQLTAATLAAHSRIVFCTNSPMQEAVAIGLEKAAEHKFFEEQVAAYEERRDILCSYFDQIGLSYTKPEGSYFLLVDISPVKVPEGYPIVETCKGRGKDFEFCWWLCQELKVVGIPPSEFYSEEHVNIGERFARFAFCKDPELLHAAGKRLLKLKEYL

SEQ ID NO: 13053 - protein, 296 aa, Methylobacillus flagellatus KT
MTLDYNPDKDHRDIDQPAQHQERQPGVEADMEPRPQYVDPSYRGSGKLEGKTALITGGDSGIGRAVAIHFAMEGADVAINYLSDDETEDAEKTLSLIREQGRKAIAIQGDVSDPQFCQELVSQTVEALGQLDILVNNAAQQYPQPSIEDISPEQLEQTFRANIFSMFYLTQAALPLLGEGGRIINTASVTAYKGHSTLIDYAATKGAIVAFTGSLAIELGERGITVNAVAPGPIWTPLIPASFSADQVEKFGRHTVLGRPGQPSEVAPAYVLFASNDGSYLTGQIIHPNGGSIVNG

SEQ ID NO: 13054 - protein, 549 aa, Desulfovibrio desulfuricans G20
MENFELREWTLGQILDHAVANWPDNEAVVYVDRDYRQTYREFGKVVDDLARGLMALGVKHGEKVAVWSTNVPYWVALQFATAKIGAVLLTVNTNYRKSELQYLLTQSECENLFIMDGYRDHDYLQTIYDLMPELKNQPRGNLNLNGFPHLRRVMFLGVEKHRGMYSVPEIISLGVMVSDQEYAERQRMLSPGDVVNMQYTSGTTGFPKGVMLTHVGIGLNGYWIGRNQNFTHKDRLCLPVPLFHCFGCVLGVLAAVNHGATLVILENFNPVHVMASVDQENCTALYGVPTMFLAVLEHKLFEKFDFSSLRTGIMAGSVCPEPLMRRVIENMNMTEVTICYGLTEGSPVMTQTLPTDSFERRTRTVGKAMPGIEVQVVDPDTGEELPHGSQGEVVCRGYNVMKGYYNMPEATQKAVDADGWLHSGDLGIMDEHGYVTITGRIKDMIIRGGENIYPREIEEFLYGMEGVQDVQVVGVPSRRYGEEVGAFIIAKEGADLAPEDVRDYCRGQIAWYKVPRHIAFVEEYPMTASGKIQKFKLREMCAELFPDVR

SEQ ID NO: 13055 - protein, 231 aa, Brassica napus
MDRILKAARTSGSLNLSNRSLREVPTEVYQCLETTGEGENWWEAVDLQKLILAHNEIEVLREDLKNLACLVVLNVSHNKLSQLPAAIGELTAMKSLDVSFNSISELPDQIGSATSLVKLDCSSNRLKELPESLGRCLDLSDLKASNNQISTLHEDMANCSKLSKLDVEGNKLTALSERQIASWTMLTELNASKNMLVDLPQNIGSLSRLIRLDLHQNKISSIPPSIGGCSS

SEQ ID NO: 13056 - protein, 659 aa, Oryza sativa
MGWAARFLTAVSFLAAGVLFAPDALLGGSGRSGAGVAAARLAHVLCFATAWGAALWVTFIGGIVMFKYLPRHQFGSLQGKMFPAYFMLISVCSAISVAAFAYLHPWKTASTIERYQLGFLISALGFDLSNLLVFTPMTTEMMMRRHKIEKDLGIGSEVGFSKNAEVARTNPTLAAMNKKFGMIHGLSSLANIMAFDLRRAPPMAGDGEPPALSAAVTTPDGWHPRTAERRLLHLLHHSPPARRRPLELLAFAVRHCLPSSPPSPHHHSLAALLLLSSPPPPALPLLRLVPPHAPPPLPLLNAAIKALSASSPPLAFRLLSSLRRLHAPDRLSFLPLLGCVSSLSLLSAVHALLLRLGFLSHHAISLALLKPYPLHYARVLFDEMTQRNKCTVAYNTLITACFRADDLGAARHLFDEMQRYRRSRRSVVSWNVMIAGCAWCKKDDIAVLCFERMVREGEVAPDDGTLAAVLPVCGRLGNVGVGRWAHEHARKSGLLDRKVHVANAVMDMYCKCGDVHSAREVFKGMRQRSVVSWNTMISGFSLNGHGIEGIELYREMRTHGEMPNEVTFLGVLGCCAHAGAVDVGRDIFQSMQLEHGIEPVIEHYGCMVDLFGRSGLLEEAYALIQGMPMRPNAAIWDSRLFTLLALLLGLGTKRGTERN

SEQ ID NO: 13057 - protein, 524 aa, Methylococcus capsulatus str. Bath
MTDIHAQKILILDFGSQYTQLIARRVRELGVYSEIHPYDCGDDFITEFAPQGIILSGGPESVTGTGTPRAPASVFTLGVPVLGICYGMQTMAAQLGGKVEAVEHREFGYAQVRAHGHSQLLNGIEDHTTPEGHGLLDVWMSHGDQVVGLPPGFKLIASTESAPIAGMADEERRFYALQFHPEVTHTRQGKRILERFVRKLCQCEARWTTGNIVEDAITRVRNRIGAERVVLGLSGGVDSSVVAALLQHAIGEQLTCVFVDTGLLRLNEGDQVMATFAEHMGVRVIRVNAEERFLQALQGIADPEDKRKIIGRLFVEIFDEEAAKIEDARWLAQGTIYPDVIESAGSKTGKAHVIKSHHNVGGLPETMKLQLVEPLRELFKDEVRQIGLELGLPYEMVYRHPFPGPGLGVRILGEVRKEYADLLRRADAIFIEELYRHDLYDKVSQAFAVFLPVKSVGVMGDGRRYDYVVALRAVETIDFMTARWAHLPYDFLDLVSRRIINEIPGISRVTYDISGKPPATIEWE

SEQ ID NO: 13058 - protein, 493 aa, Burkholderia pseudomallei K96243
MRSIAARSSHAGAGLEQEGVMDLEEGVRQLYPYAAEFGALHEFPERGMPRERLLEELRSMAVREDRKWESGRCSGTMYCGDHEHYAFLNEAYGLFSHVNALQRDLCPSMNRMESEIVAMTVALLHGEAVQRHDGAHRACGALSLGGTESILNATLAYREKARAERGIERPRMIWPASAHPAFRKAAHLFGFDVTVAPIDPVTMQVDADFVRDAVDANTVMLVGSACNYPYGTIDPIGALSAIAVEKDVWLHVDGCLGGWMLPWGEALGYPDIPAFDFRLPGVTSISADTHKFGYGPKGGSVLAWRDASFRRHQYFLMTDWVGGVYGSPGLTGSRSGGLIAATWAALRSLGREGYLARAKAIFETAFDMQAAVRAIPELRVLGKPTFCFAFTSDAFDIYHVNDFMRQRGWRFNGLQHPDALHMCVTGPQTQPGVAERFRQDLGEAVEHARHRAHARPQSSGVYGGDAAGLDLRDDARARAFFTQVLDLFTDCPL

SEQ ID NO: 13059 - protein, 507 aa, Zea mays
MAGGGFAVADGPSVDYGGQVTFSVVVTCLMAASGGLIFGYDIGISGGVTAMESFLSAFFPGVLRRMAAARRDEYCVYDSHVLTAFTSSLYLAGLAASLVASRVTRAIGRQAVMLAGGALFFAGAAVNAAAVNVAMLIVGRMLLGFGIGFTNQAAPVYLAETAPAKWRGAFTTGFQLFLSIGNLAANLVNYGTSRIPAWGWRLSLGLAAAPAAVILAGALLIPDTPSSLLVRGRAEEARAALRRVRGAKADVDAELEDVARAVEAARAHEQGAFRRILRREHRHHLAVAVAVPLFQQLTGVIVIAFFSPVLFQTAGFGSNAALMGAVILGAVNLASTLLSIVTVDRYGRRPLFLTGGFVMIICQVAVAWIMGSQIGADGGSAMARPYSLAVLALTCVFSAAFGWSWGPLTWVIPGEIFPVEIRSAGQGVSVAVNLGATFLLTQTFLSMLCTLKYATFIYYAAWVAVMTAFVVAFLPETKGVPLEAMGAIWERHWYWRRFVQPSVAEDP

SEQ ID NO: 13060 - protein, 280 aa, Oryza sativa (japonica cultivar-group)
MVDGSSKKKYHIIKCGSSLQVLGHLQENAKQVLLIMEEEGFYTNLMNEGNDSLDWDSLSTMPVEDDMSNQLDENGMSSEPVTQQFPTIERTTVARPNQKRSKNFSEQEDKILVSAWLHVSLDPVLGTNQTRAAYWTRIYEHLYKTSKSTPDRSQNSLMHRWKTIQENVNKFCGYLSQIEGRRQSGVSIHDKIAQAIVVFKELEDKPFQFLHCWTLLRSQSKWHDKMKQITSQKPCATKKQKASTDGLGKAIPTNDDTTNHVDEDNEPTETEEPKIKYLAA

SEQ ID NO: 13061 - protein, 436 aa, Listeria innocua Clip11262
MTFERLGTMNVNAEGHLEIGGVDTLKLTEKYGTPLYVYDVALIRDRARGFKKTFEELGVKAQVAYASKAFSAVAIYQLMAEEGLSLDVVSGGELYTAIKANFPPERIHFHGNNKSAEEIHMALDYGIGCFVIDNYYEISLLEDILIERNEKAAVLIRVTPGIEAHTHDYILTGQDDSKFGFGLTNGQAEKAIKQVLHASASFDLIGLHCHIGSQIFETTGFKLAARRIMDKLVEWHGTLGFDSKVLNLGGGFGVRYTAEDEPLEPSEYVRQIMDEVRDVANSNDIAIPEIWIEPGRSLVGEAGTTLYKVGSRKEVPGIRNYIAVDGGMSDNIRPALYDAHYDAVLAANPEKVAEETVAIAGKCCESGDMLIWDLPLPKSDAGEILAVFCTGAYGYAMASNYNRIPRPPVVFVENGMDKLIVARETYENLVQNDLSL

SEQ ID NO: 13062 - protein, 482 aa, Aspergillus nidulans FGSC A4
MGHLKQQCRIPLASAMSTLGASTPNAFSRLPMTPPEPVDSVLVPPNTVSKDAASVTTAVHVISTERAALAHLERLYQTDQLAQEHLSRAVDQIAGTIRNGGKLVCCGVGKSGKIAQKLEATMNSLGIYSTFLHPTEALHGDLGMIRPNDTLLLISFSGRTPELLLLLPHIPPTVTIVALTSHLHPSTCPLMSFQPMEKGILLPAPIHEDEETSIGVCAPTSSTTVALSLGDALAIATARKLHTTPGRGPAEVFKSFHPGGAIGAASTVSTPLSMSSSSASLTSHPSEFLQGPVRQPQLRHRHEKITPFSDPGVEYQDRMQSDSDAESEKSVPASPPPNTIANMISVPLSRIPTVSSPASISGAVHSNIRLLDILLTAIQHPDANSWVFVAPDILIPPRKLRYLSSKGYVDMDVSSLNAPYLAPRERWTFISDDCTIEEAKEWFPPNDPRPVSVVAVVRGQDSEDVLGVFEIEDLWGGNDGND

SEQ ID NO: 13063 - protein, 205 aa, Oryza sativa (japonica cultivar-group)
MSRLGRYGPPAVRDSYSLLVLNVSFRTTADDLLALFDRCGEVLDIRIPRDRRTGDSRGFAFVRYKYEDEAQKAVDKLDGRTVDGRDIMVQFAKYGPNAERIHKGRIVEEISKPRGRSRSPSPKRRYRADYRDRGYRDDYRDRHYRDDYQDREYRRSRSIERYERERYQEKGYRRRSRSISPDYDRRHRKNGPRDERSPRSRSPLT

SEQ ID NO: 13064 - protein, 220 aa, Zea mays
  misc_feature (24)..(24): Xaa can be any naturally occurring amino acid
  misc_feature (36)..(36): Xaa can be any naturally occurring amino acid
  misc_feature (113)..(113): Xaa can be any naturally occurring amino acid
  misc_feature (150)..(150): Xaa can be any naturally occurring amino acid
  misc_feature (209)..(209): Xaa can be any naturally occurring amino acid
SIRRLSLVRRRDPKGLCPSILPHXGGAVLETIAGGXTRGGQGDHGHPLRRPACGQCKLFLSGKTNLCQAIRATQGKGRMPEGTWRFSYKGQPIFHWMGSSTCSEYAVLPEMSXVAKIPKEAPLEKVCLAGCGVSTGIGAEINTAKVIAGXTVAIFGLGGIGLSGVIGAVKAQAGRIIAIDINPAKFEIAKQLGAADCINRKASDRPIAXVIVDSTDGGKG

SEQ ID NO: 13065 - protein, 520 aa, Coprinopsis cinerea okayama7#130
MASSQAAVFDQVPRPNRRKMAGRKEWGDYPCHQQVAFPPYRNCMTHVLSANLDPATNEELGTVPEMGLEETKEAIEAAAKAFTTWGRTTAKYRHDLLIKFFQLMQQHQDDLARLITLENGKTLTEAKGETAYSASFIEWFAEESVRTYGGLLSSMLVPKLPSNTTCRANPFPLPQRPKRRRQTTRRSILTPWNFPSAMITRKLGAALAAGCTAVIKPPPETPFSALALAELAARADIPPGVINIVTTQKNVTEVGRELCENKIIKKVSFTGSTPVAKLLYGLAASTLKKVSLEAGGNAPFIVFDDADVDEAVEAAIVCKFRGSGQTCVCANRIFVQSGVYAEFASRLAERVAAFKVGNGLEEGVTHGPLIHAKAVEKVERHVADAVSKGAQVLVGGKSIPNSSFFIPTVLSDVPSDAALNTEETFGPLAALTKFETEDEVIRLANNTDVGLAGYFFSRDVGRVWRVAEALEVGMVGANTGLISQAVIPFGGVKESGLGREGGPHGIEEYMNTKLIVFGGL

SEQ ID NO: 13066 - protein, 458 aa, Zymomonas mobilis subsp. mobilis ZM4
MTETSVSFKTLGLDSSLVQALDGLGYSKPTPIQAQAIPHLLEGKDLCGIAQTGTGKTAAFALPSIHYLATNPQARPQRGCRMLILSPTRELASQIARACNDYTRHLRMSVNAVFGGVPIGRQMRMLDRGTDILVATPGRLLDLIDQRALVLKDVEVFVLDEADQMLDLGFIHALRRIDKLLPKNRQTLFFSATMPKTIQELSSQFLSDPVTVSVAPQSSTAERVEQFGIFVNQSEKQALLTITLKNTPGLDRALVFTRTKHGADRVVRHLEAAGLPAAAIHGNKSQPQRERALNAFRNGRLKILVATDIAARGIDVPGVSHVFNYELPNVAEQYVHRIGRTARAGRDGQAISFIANDERSYLRSIERLTRVKLQILPLPENFVMEKELLPHPAPMRPERDGRDGRGGRGGGRGRFGGGAKPGFNHSHGKGDDRGDRGGERPRRPRRPQMRGVRAVARS

SEQ ID NO: 13067 - protein, 256 aa, Pseudomonas aeruginosa UCBPP-PA14
MDSHSPIATVAQALRRAERILVITGAGLSADSGMPTYRGLGGLYNGRTEEGLPIEAALSGPMLRRDPALCWKYLAELGKACLAARPNAGHEAIAELQKRKPECWVLTQNIDGFHRQAGSPAERLIEIHGELAPLYCQSCGAESGGLEEHLHGQLPPRCAACGGVLRPPVVLFEEMLPEEAIDTLYRELRKGFDAVLVVGTTASFPYIVEPVLRTRQAGGFTAEVNPGVTDLSERVDVKMTGRALDIMPQVVSHIYR

SEQ ID NO: 13068 - protein, 264 aa, Triticum aestivum
GKGGKDLDFDLDDDIEKGDDWEHEETFTDDDEAVDIDPEERADLAPEIPAPPEIKQDDEENEEEGGLSKSGKELKKLLGRSSGQNESDADDDDEEDDQDDESSPVLAPKQTDQPKDEPVDNSPAKPTPSSGHARSTPPASKSKQKRKSGGDDAKASSGAALKKAKVESDTKTSSIKEETPSSSKPTPKASASSRSANVSPVTEDEIRTVLLAVAPVTTQDLVSRFKSRLRGPEDKNAFAEILKKISKIQKTNGHNYVVLREDKK

SEQ ID NO: 13069 - protein, 385 aa, Rhodopseudomonas palustris CGA009
MSNKVFADLPVTVFEAMSQLARDNDAINLGQGFPDDPGPEDIRRAAADAVLNGYNQYPSMIGLPELRQAISTHYAHWHGVQLDPMTEVMVTSGATEALASAILSVVEPGDEVIVFQPVYDSYLPIIRQAGGIPRLVRLEPPHWRITEESLRRVFNAKTKAIVFNNPLNPAAVVYPREDLELLARFCQEFDAVAICDEVWEHVTFDGLSHIPLITIPGMRDRTIKIGSAGKIFSLTGWKVGFVCAAPKLLRVAAKVHQFLAFTTAPNLQAAVAYGLGKSDDYFLQMRKDLARSRDRLAQGLSSIGFPVIRSQGTYFLTVDLSPLGLNETDEAFCKRIVTDYKVAAIPVSAFYEEEPVTSVVRFCFAKKDQTLDTALERLSDAVHGR

SEQ ID NO: 13070 - protein, 507 aa, Bordetella bronchiseptica RB50
MPGRGCVPRFFSSDSIDMTISPLQLLNDPSLLRTDALVDGRWIAASRRFAVHDPATGRKLADVANLDAAHAREAIAAAQAAWPAWRARTVKERSAILRKWFDLLLANQDDLARLLTAEQGKPFGEARGEIAYAASFVEWFAEEAKRINGETLPAFDNNRRLLVLRESIGVCAAITPWNFPLAMITRKVAPALAAGCPVIVKPAEHTPLTALAAAQLAVRAGVPAGVLGVLPADGANSIAIGKELCANDAVRHLSFTGSTEVGRILMAQSAATVKKLSLELGGNAPFIVFDDADLDSAVEGAMQSKYRNAGQTCVCANRIYVQDGVYDAFVEKLADAVRALKVGPGFDEGVTQGPLIEPEAVDKIERHIEDAVSKGGRVVAGGRRLGGLFFEPTVLVDATSQMLCAREETFGPLAPVFRFHADEDAIAAANATEFGLASYLYSRDVGRIFRAAEALESGMVGVNVGILATEHVPFGGVKQSGLGREGGRHGIDDYVEIKYMCVGDILK

SEQ ID NO: 13071 - protein, 402 aa, Burkholderia pseudomallei K96243
MKAVVFHGIGDIRIDTVPDPGLAQTTDAVVRLTSSAICGTDLHMVRGTLGGMKPGTILGHEGVGLVEEVGRDVRNLRRGDRVLIPSTISCGHCAYCRAGYTAQCDTANPGGPLAGTAFFGGPQASGAFDGLQAEYARTPFAHASLIRLPDSLDDERAILMSDIFPTGYFGAQLAEVRMGDTVAVFGAGPVGQFAIASAKLMGAGRVIAIDRVVSRLEMACAQGAEVINFDDDDPVDTILQLTGGIGVDRVIDAVGVDAVRPTRGPAAPHDAQSRRAFDDEVRELAPRTRADGGHWVPGDAPSQVLQWAVRAVAKAGTVSIIGVYPMNDRFFPIGAAMNRNLTVKMGNCNHRAITPKLIEIVRSGAFDPITVLTQAEPLTSAIDAYRAFDTREPGWIKVKLEP

SEQ ID NO: 13072 - protein, 507 aa, Burkholderia pseudomallei K96243
MRVACFVDFMQPHPGNIRTHIGVPTDVGTAKENVMDLEEGIRRLYPYAEEFGVMRGFPEQGTPRDELLAQLRSMAEREDRNWESGHSSGAMYSGDRDHHAWLNEAYSVFSHVNALRRDMCPSMNRMESEIVGMTVAMLHGDAVAAHHPGQRACGMITLGGTESILGATLAYREKARAERGIERPRMIWPASAHPVFRKAAHLFGFDVTVAPIDPVTMQVDADFVRDAVDANTVMLVGSACNYPYGTIDPIGALSAIAVEKDVWLHVDGCLGGWMLPWGEALGYPDIPAFDFRLPGVTSISADTHKFGYGPKGGSVLAWRDASFRRHQYFLMTDWVGGVYGSPGLTGSRSGGLIAATWAALRGLGREGYLARAKAIFETAFDMQAAVRAIPELRVLGKPTFCFAFTSDAFDIYHVNDFMRQRGWRLNGLRRPDALQMCVTGPQTQPGVAEQFRCDLGAAADYARAHAQERPKTSGVYASDAAGVDLSDDARTRAFFTQVIDLFTDCPL

SEQ ID NO: 13073 - protein, 153 aa, Oryza sativa (japonica cultivar-group)
MAKLIFLLAMVAFASTLLVSIAGAADNSTSPSSPSADPTAYDMLQRFGFPVGILPQGVQGYKLGDDGSSFEVYLAGDCEFRAAKKYVLHYSSRVAGQIAAGSITSLEGVKVKEAFAWFRISEVDVDGDQIKLHVGLYTATVAADQLAVSPQCN

SEQ ID NO: 13074 - protein, 275 aa, Triticum aestivum
  misc_feature (173)..(173): Xaa can be any naturally occurring amino acid
SPPGRRRSRRPSHLRGHRAGRSAQLLSETAKEIHRQQPDACLEAFQVDLSSHRSIKKFEASLNQWIRDSNLEPSIQLLINNAGMLAKSHRVTEDGIDEVMQTNYIGPFILTSILLPLLKNSLVPSRVVNLTSFTHRCVSEIDVSEEALQGVKFGQHSVGGSYPLASTYEYTKXAADPGVVETRIMRELPPCLSRFAFFILRTLNLLQQPDTGIDAVLDAALAPREASGKYFFGGKGRTIRSSVLSYDIEIAKKLWAASSALLRELRLRDCESRTG

SEQ ID NO: 13075 - protein, 141 aa, Zea mays
  misc_feature (101)..(101): Xaa can be any naturally occurring amino acid
MVRISVLNDALKSMFNAEKRGKRQVMIRPSSKVIIKFLIVMQKHGYIGEFEYVDDHRSGKIVVELNGRLNKCGVISPRFDVGVKEIEGWTARLLPSRQFGXIVLTTSAGIMDHEKARKKWPREIPPFLLLKTSIWGKTSPF

SEQ ID NO: 13076 - protein, 183 aa, Fragaria x ananassa
SREMLIDFVPTTNGLSLADAPAFKKAAGGAPANVAVGIARLGGSSAFIGKVGEDEFGYMLADILKENNVNNEGMRFDPGARTALAFVTLRSDREREFMFYRNPSADMLLQEAELDLDLIRKAKILHYGSISLITEPCKSTHIAAAKAAKELVLFWSYDPNLRLPLWPSAKSARKRNFEYVGNC

SEQ ID NO: 13077 - protein, 486 aa, Gluconacetobacter diazotrophicus
MAKKAPSSAPTTTPSPSAEAVAKVFSLIQEHSVELVDLRFTDPRGKWHHTTQHISTIEQDTFRDGFMFDGSSIVGWKAINESDMVLLPDPTTAVMDPFSAKPQLILICDIIEPSTGQFYNRDPRATAKLAEAYLKSTGLGDTAFFGPEAEFFVFDSVKFGTGPNFGIYQLDSIEGPGASLKDYPEGNMGHRPTVKGGYFPVPPVDSENDLRAEMLSTMGEMGLPIEKHHHEVAQSQHELGTKFATLVKSADFMQIYKYCVHNVAHSYGKSATFMPKPIYGDNGSGMHVHQSIWKSGKPVFAGNGYADLSDQALYYIGGIIKHAKALNAFTNPSTNSYKRLIPGFEAPVLLAYSARNRSASCRIPYATSPKAKRVEVRFPDPTANPYLAFAAMLMAGLDGIKNKIHPGDAMDKDLYDLPPDELKQIPTVCGSLREALEALTADHEFLLAGGVFTKDQIESYIDIKWQEVFKFEHTPHPAEFEMYYSV

SEQ ID NO: 13078 - protein, 359 aa, Oryza sativa (indica cultivar-group)
MPGQAQMLPAGRMDFYGTRTLANNLLEDQCQIESGPLSFLDSGPYGTFVGVYDGHGGPETACYINDHLFHHLKRFASEQNSMSADVLKKAYEATEDGFFSVVTKQWPVKPQIAAVGSCCLVGVICGGILYVANVGDSRVVLGRHVKATGEVLAVQLSAEHNVSIESVRKELQSMHPEDRHIVVLKHNVWRVKGLIQVCRSIGDAYLKRSEFNREPLYAKFRLREPFHKPILSSEPSISVQPLQPHDQFLIFASDGLWEHLTNQEAVDIVHSSPRNGSARRLIKAALQEAAKKREMRYSDLKKIDRGVRRHFHDDITVIVVFLDSSLVSRASTYRGPSVSLRGGGVNLRSNTLAPYASQM

SEQ ID NO: 13079 - protein, 371 aa, Acetobacter pasteurianus
MDVRAAVAFEAGRPLEIERVQLEGPRAGEVLVEVKATGLCHTDKYTLSGADPEGLFPAILGHEGAGVVVEVGAGVQHLRPGDHVIPLYTPECRECKSCLSRKTNLCTAIRATQGKGLMPDGTSRFSFKGQPIHHYMGCSTFANYTVLPEIALAKIRPDAPFDKVCYIGCGVTTGIGAVLFTAKVEPGSTVVVFGLGGIGLNVIQGAKMVGADRIIGVDINPAREAMARQFGMTDFVNPRDLGPNGDVVGHLVELTGGGADYTFECVGNPTLMRQALECAHRGWGVSTIIGVAAAGQEISTRPFQLVTGRRWIGSAFGGARGRTDVPKIVDWYMENRINIDDLITHKLPLERINEGFDMMERGESIRTVVEF

SEQ ID NO: 13080 - protein, 487 aa, Allium cepa
MATKNQVAGPQQQKKVEFLPRGERKNAAPVPDGKNRRALGDIGNVLEAKPHNKITRPITRSFGAQLLANAQAAAVPNKKPGNVNGEREVRKACTKEDRGKAVVNTKPAVCIKEDKGKEAANPKPTVCIKEDKGKEVVNPKPAVCIKEDKGKVVVNPKPTAVIEISPDTVEKVRERSGSKKSRKKKVKTMSQVLSARSKAACEITKKPKDTIPDIDASDAGDQLAVVDYVEDLYKFYKHAENAFMPCHYMDIQVEINEKMRAILGDWLIEVHCKFELMPETLYLTFYIIDKYLSMEKVIRRELQLVGISSMLIASKYEEIWAPQVEDFITISDRAYNQEQILGMEKLILNKLEWTLTVPTPYVFLVRFIKAAMSDKQLEHMVYFFAELGLLQYKMVMNCPSMLAASAVYAARCTLSRSPLWTETLRRHTGFSEPELKECAKMLVSSHIAAPEGKLNAIYKKYSRSEHGAVALHPPAMKVVEESKETKA

SEQ ID NO: 13081 - protein, 535 aa, Magnaporthe grisea 70-15
MGLVEVVLEHVSVKAAVLWIVGSWVLYLVVKNVLEERKINKLGARAARMPSRLPLSLDNIIRAVRANIQNRNLQMWRSHMSHSITYTVEGRLLFQRIILTADPENIKAILATQFTDYGKGEPFHQEWKPFLGDSIFATDGEKWHTSRQMLRPQFVKDRVSDLECFESHIKTLFKAMANGGALEGEHQHVELSAINGKRFEITDLFFRFSLDVATDFLLGYDVKSLSTPHAEFAEAFNEVQHVQSTITRSGPAQALVPKGSYYRGLKVMDNFINPFIDRALRLSPDELASKTKSDHGYTFLHELASFTRDRKVLRDQIVAVLLAGRDTTAATLSWTIYELGRHPECVKRLRQEIAEVVGFGRTPTYADLKSMKYLQNVMHETLRLYPAVPFNVRLALHDTTLPRGGGPDGTLPVPVLKDTPIGYSTLLMQRRRDLYPPVSENFADPDVFSPERWFHWQPRPWQYVPFNGGPRICIGQQFALTEMGYVLVRMFQQYERVVSYMDEIDGGNPTIKADIVMQPGDGVIVAFWEGDNEKI

SEQ ID NO: 13082 - protein, 461 aa, Mycobacterium smegmatis str. MC2 155
MTITPLDAHRQANATSPDLAAVLETIAERGVEFVYFQAVTITGRVVGKVAPAKHFERLAVRGVQQHQTAVANLQGTREGVLLAGGVNAPEYTAIPDLETFAVLPWDTSFARVFCRLYEPDHLAERAGAEFACDSRGLLRRLHAGFTDRTGLELRTGCEPEMTWQGEGLEAQFRPGSSPAYHIEHLERNRPIVKKVVEYAQALGLDMIEGDYEDEFQVELNFMYDRADLTADRLTTYRQICKQVARELGIQASFMPKPATGMMGNGCHHNFSLWRDGVNVLAEPGVTELHLSELGQHALGGLLAHSAGAMLINGSTVNSYKRYWDAGQFAPSRINWGLDNKTCTVRLSAVGRLEYKLPDAAVNPYLSHAVILAACEDGMKNEIDPGAPTQGSSYDAPVDTRFPALPLTLGEAIEAFRADEVLTQALGPDLSSLLIDFHADEWARFCGYVTDWEREMYWSDAP

SEQ ID NO: 13083 - protein, 390 aa, Methylobacillus flagellatus KT
MRALTYHGSKDVRIETVPDPVLQADDDIIIRVTSTAICGSDLHLYRGKIPQLHDGDILGHEFMGIVEDTGHGVTEVRKGDRVIIPFVIACGHCFFCAQQQFAACETTNPGPGPSLNKKSGTPPAALFGYSHLYGGIPGGQAELVRVPHGNVGPFKINGSLADEQVLFLTDILPTGYQAVLNAGVGKGSSLAIFGAGPVGLMAAACARMMGVETIFMIDDLQYRLDFAQAQYNTISINLDEVEDPADYILEHTAHRGVDGSIDAVGFEAKGSVVESALTALKLETSNGKVIRQCIAATRRGGTVSIPGVYAGFIHGFLIGDAFDKGLTFKMGQTHVHRFLPELLEFIENGDLHPADIITHRMALEDAPLGYRIFNDAEENCRKVVLTPGLH

SEQ ID NO: 13084 - protein, 1279 aa, Aspergillus nidulans FGSC A4
MVYRSTFPHLEIPKSNILSYLYPPNQTVSDQPIWIDASNPNNSLSPRQMLTWVRRLGYGLDRLGIRKGEVVIILTPNHIFVPVAYQGIVGSGRVFSGANPTYTQLEIEHQLKDTGSKLILVHPSLVKTAVDAASRVGILKERIFQFADHPCETLDGVQDWRDFIGSEDEAREWRWDDMADTSTTTVATINYSSGTTGLPKGVCVSHRNLIANVEQTIFMRDQGFPHALVPASRPPERWVGFLPLYHAYGQLYACLMAPKLGFPVYIMRKFVYEEFLATIERYGITHLQVAPPILIMLDKRSETARYNLSSVRNILCGAAPLSRELQNTIQNRFKTNVVQGWGMTEVTCGAIHVPGGLYDESGSVGMLDPNCECKLLDEEGRPVRPGEPGELHVRGPNVCLGYWRNDKATKESLDSDGWLKTGDIMVAKDDCFWVVDRKKELIKVNALQVSPAELEAVLLGHDGIADAGVVGFIANGQECPRAYVQIKEEASGLTEADIQSYMKDRVAKHKQITGGIQLVDEVPRLASGKLHRRVLKEWAQRDAAGYYGRNASYEIRPWLPSHLSGDGYLEALVQPNVNPVFGEIKKANQEGTDPWFEDYEIKYCYRNQFAFLGNGTVKAEVKQGTLGLATVDYSNTLASAPLLYVLCLSALRPSSRLCSMGFVCNERSFIPPRPFKNIGFVAIVADAAVGAMVYYAFTVLWPQLIESIYTTDSIQIGLQSSVVGGGVLLGQILGGMALGFVPGVKYQCIIDYCFLPCHGFYYPTECFGLGYLVNGYSVGHLGLHDIGLAAGVLGSLRALGGAVAQAVYVSVLNNEVAKNIPKYVGAAATAAGLPESSLSSLLEAVSSGSSLQGIDGVTESVVTALLTAHKVAYSESFRIVFLCTIPFSVLLVISSCFVPTIANNLQLEISSREAVGKRRSRLAAFPICKETMKAAQWDPKLQKVVVNRVPIRTPGPNQILVKLASASLCHSDILAINQPNMAEPFTLGHEGAGYVAELGTKCTDKGFREGDPVGFLHINGCCFECEGCMVHNNNCTQGTPVVSGFGGIRDFGFFQEYAAVDWQNIIHLPYQLDSKRSSAIFCAGITAFHAVDSCNLTAGQWFAAIGAGGLGQLAVQYANAMGYRVIATDINDGALETCKRQGADVIINSLSRPDYANEVKKLTPGGVHPTAVFSGAPAAYRGAPLLELSTFDLAIGTYVVKSESTSIPQRMAKAVDFTAKHGITPEIKVRSGLEDVDEMQASYIHALDYLFTTPFTARELHLLRPVHPDHDIILETSMR

SEQ ID NO: 13085 - protein, 465 aa, Bradyrhizobium japonicum
MRLAFVFAREGVFGSVDPSLVPPPGQLALKLARIVERRGPKHGPRLSRALTRMGPAYLKLGQFLATRPDVVGVIMARDLESLQDRLPPFSQAEAEAAIAASLERPLKDVFASLGPPVAAASIAQVHRGEVVRDGIRKAVAVKVLRPNVASRFRRDLSDFFYVAHKAETYSAEARRLRLIEVINTMSRSVAMEMDLRLEAAAMSEMAENTGDDLDFRVPTVDWDRTTHNVLTMEWIDGIALNDHKRLAEAQVDLPDLGRKVIQSFLRHALRDGFFHADMHPGNLFLDDTGRLVAVDFGIMGRLGMKERRFLAEILLGFITRDYRRVAEVHFEAGYVPVHHSVENFGASAIRAIGEPIHNRTAEEISMARLLTCCSRSPDLFDMTTRPELILLQKTMVVVEGVARGFDPRLDIWKTADPVVREWIERNLGPIGGCRARSPAAATSPRADAPARYRAAPLQCSSSSRP

SEQ ID NO: 13086 - protein, 406 aa, Exiguobacterium sibiricum 255-15
MVSQPIVPVERLKKRHYIGPAFVAAVAYLDPGNFAMNMTAGAQYGFLLLWVIVAANLMAVMIQTLSAKLGLVSNTSLAEVIRDELSPVMRILYWAQAELVAMATDLAEFVGAALGFNLLFGIDLKIAALLTAVASFVILGFERKGLRHFEAVIGALVLVIALAFAIQVIEVKPVLRDVAGGLIPGFSGTSSIVLAAGMLGATVMPHAIYLHSDLTKRRMGTIADKKGLLRIQKMDIWAAMLIAGAVNGAMLVIAATVFFGTSQQAETLESIFHGLGTSLGGAAPYLFGGALLISGLASSSVGTMSGDAIMRGFLKMEIPIFLRRSVTMLPAILLLLSGFDPTRALIWSQVALSFGIPFALIPLIRATSSERIMGKYKNQPLTKGISWTIVSIVIVFNVYLLGDLLF

SEQ ID NO: 13087 - protein, 453 aa, Oryza sativa (japonica cultivar-group)
MPTGKEGMEEPLPTDADHIGALPDTVLHHVLSFLPSQDAVRTCVLAKRWLDLWKSVTALRIGDRDKRKLWTVKGLQGFVDHFLLLRESVPLHTCVLRFIVFSEDLNETSRLNLWIKHALLRMVQFLQVSIRQNTAFYHQINLGILPFVSRHLSMLELHGVRMVGSFLDFSRCPALQHLEFDRCELPCDKILSESLKLLRITRCKFSQTSRVRICVPSLVSLRLDDFYRRTPVLERMPSLVEAFVRVVHRTYDCCGYDYINSGDCGNEHCKSCHGIKDDNNCVLLDGLSEAKTLALIDGTISFIFNRDLKWCPTFSKLKTLLLNEYWCVPDEFSALACILEHAPVLENLILQLYSEGPKHTMKIKGNCHPMDRSAAISGHLETVEIRCEVVDKRVLKVLKYLSTFNILFSFEQVKISEEDDSDDNDQEDEEDDDDDFYGEEEEEEEEDDEDEDD

SEQ ID NO: 13088 - protein, 404 aa, Arabidopsis thaliana
MKNSIPIDLIYEILSRLPAKSVARCRCVSKRWRSILRHQVFTELFLTRSNARPRLLIGVQQDGEWSFLSTPQPQNRHESSSLVVAAADFHTKFSSGKSRHQCTYASGGSYSYLGFDPIDKEFKVLFMDTCDFIASKDEDHYILTLGTGELKWRKIQCPFTHEPFWERICINGVLYYSAYYSDSNGRSHLIACFDVRSEKFNFIATKHRYDQLINYKGKLCGINLEYARHVGGFPVKLSMWVLEDVEKPEWSKHVYSLWTESEVVKVNRNLSVSGMTATGDIVLSMEDATNPFYVFNFNPDRNTLQVQSVEIQGLGANRDHIACHAFVDYVEDFSVSDAVLQLKSSPLQQQGQDTSHDLSKSVKNKQLDNYEFLANKLNHSVSLAILFCLFFLLFNYLIRLCWVR

SEQ ID NO: 13089 - protein, 399 aa, Geobacter sulfurreducens PCA
MNTTQWIAKADKYIMKTYGRYPLVPVRGEGCRVWDADGKEYLDFLAGVAVNNLGHCHPKVVEALRTQAAEIIHCSNYYHIPNQIELAELLCAHSFADKVFFCNSGAEANEAAIKLARKHAREKTGDAERYGIITALASFHGRTMATISATGQEKVQKFFDPLLHGFTYVPFDDAAALEAAVTPTTCAVMLEPIQGEGGVVVPSADYFRKVREICDRHGLLLIFDEVQVGIGRTGKLFAHEHFDVTPDIMTLAKALAGGAPIGAMLARDEIAASFSPGTHGSTFGGNPLVTAAGLAAVRAVLEEGLLNRAEEMGEYLVGELERLKGKYDIITDVRGIGLMVGMELSVPAGDIVLKGLERGVLLNVAQDRVLRFVPPLVVTKQEVNDMIAVLDGILEEMTK

SEQ ID NO: 13090 - protein, 473 aa, Zea mays
MAGAAAAAVASGVSARPAAPRRASAGRRARLSVVRAAISLEKGEKAYTVQKSEEIFNAAKELMPGGVNSPVRAFKSVGGQPVVFDSVKGSRMWDVDGNEYIDYVGSWGPAIIGHADDKVNAALIETLKKGTSFGAPCLLENVLAEMVISAVPSIEMVRFVNSGTEACMGALRLVRAFTGREKIIKFEGCYHGHADSFLVKAGSGVATLGLPDSPGVPKGATYETLTAPYNDVEAVKKLFEDNAGEIAAVFLEPVVGNAGFIPPQPGFLNALRDLTKQDGALLVFDEVMTGFRLSYGGAQEYFGITPDVTTLGKIIGGGLPVGAYGGRRDIMEMVAPAGPMYQAGTLSGNPLAMTAGIHTLKRLTEPGTYEYLDKITGELVRGILDVGAKAGHEMCGGHIRGMFGFFFTGGPVHNFGDAKKSDTEKFGRFYRGMLEEGVYFAPSQFEAGFTSLAHTSQDIEKTVEAAEKVLKRI

SEQ ID NO: 13091 - protein, 289 aa, Oryza sativa (japonica cultivar-group)
MDTDKVKIYGARVRVDSMAKVAEIEAAEKQKMREKVQKIIGHGINCFVNRQLIYNFPEELFADAGILAIEHADFEGIERLALVTGGDIASTFDNPESVKLGHCKVIEEIMIGEDRLIHFSGVEMGQACTIVLRGASEHVLDEAERSLHDALCVLSQTVNDTRVLYGGGWPEMVMAKEVDGLARKTPGKKSHAIEAFSRALQSIPTIIADNAGLDSADLISQLRAEHHKEQSTAGIDVISGGVGDMEKLGISESFKAKQAVLMSATEAAEMILRVDEIVTCAPRRREDRM

SEQ ID NO: 13092 - protein, 251 aa, Cytophaga hutchinsonii ATCC 33406
MRKKVIAGNWKMNKTLEEGLSLASEVANMAKDEVPADVNLVMCIPYISLAAVSKVINDKVAIGAQNVYQKESGAFTGEISAPMLKSVGVKYVIIGHSERREYFGETNQQLADKVTISLANGLTPLFCCGETLAQREAGIHINFVNAQLTESLFHLSPEDFKKVVIAYEPIWAIGTGVTASDEQAQEMHAKIREHLASKYGAAVADEISILYGGSMKPDNAKGLLACKDIDGGLIGGASLKSRDFIDIAKSY

SEQ ID NO: 13093 - protein, 755 aa, Hyphomonas neptunium ATCC 15444
MPVSWLIEGTSLMGASVQESFAITDGVARWLSQADSGRKELSAPALYAVNDGSPWADYVYARALLSDEDHRMPVLPGGEISLETVQEMDVPSGKSVEAVTVYRLSGIDMSPSLLALDADGALFATFSESSAVVRKGHEGSVEPLLNLARDLNAERTEKLAQRLLHRYGAPYSILNVRVLDVRDGSLSAPSVVTVSGNVITGVAPYVEGVMPEGEGAVFDAAGGTLMPGLADMHSHASANSGLYYLAAGVTSTRDMGNENTFLASLLDRMKADKVAGPRITPAGFIEGRSPFSARHGIIAASEEEALAAVDWYAEQGYGYVKSYNSMNPAWMPAVAERAHAKGMRMIGHIPAFTNADAMIDAGFDEVTHINQLMLGWLLDVSEDTRTPLRLTGMARGATLDLDSDKVQSTVRRMQENDTAIDPTAVILERLMLSRAGTVAQGDAAYLDHMPIAYQRYRRRSFVSLADTAEDEAYQEGFRRVLETLKMLHEDGITILPGTDDGTGFTVHREIELYTLAGIPVADALRIAAWNPIEYMGYSDTLGSIETGKLADFILLSGNPLEDINAIRAPRMVVRNGDVYFPSEIYEALSVKPFASPPEQLRAGPEVVAEPAAAEASPDAAPDAPSMVEHYPMIVEGLPIKAEDLPFSGAVRVGNIIYLSGQIGGAEGGRSSDFRDHAVEVMDSVRQVAASAGADMDQIFKCTVMLEDMSNWPAFNEVYAGYFTKGRMPARSAFGADGLALGASVEVECMAYAENP

SEQ ID NO: 13094 - protein, 417 aa, Geobacter sulfurreducens PCA
MNHFQYKGNELHAEEVSLKEIVARVGSPVYVYSHATLTRHFTAFDEAFAGVPHTICYSVKANSTQAVLRTFITLGGGADIVSGGELYRALQAGVDPKKVVYSGVGKKDDEIEYALNTGILMFNVESEQELTRISEIASRMGKKAGIAIRVNPDVDPQTHPYITTGLKNAKFGITIDRAMAEYARAKTLPGIDVIGIDMHIGSQLTKVTPFVDSIEKLKTMIANLRGQGIDLQYFDCGGGLGIQYSTEEPPLPADYGKEIVAATKELGMHLLFEPGRNIVGNAGILVATCLFTKERDEKNFIMIDAGMNDLARPALYGSFHGVQPVVKDQDGMIVADIVGPICESGDFLVKDREVPMFRQGDLMAFMSAGAYGFAMSSTYNSRPRVAEVMVKGNQFEVVRERETVEDLIRGERVPSFL

SEQ ID NO: 13095 - protein, 303 aa, Burkholderia pseudomallei K96243
MPRSAVRLDRRIAAVVTLLPALGTLAAIALWIGGHGPGAVEWIVFALFYFATALGLEVGFHRHVTHKAFKAKPWVRTALIALGSMGAHGPVNWWASTHRRHHSTSDGDGDPHSPHLSGEGFGGRLRGLYHSHMGWLFVGESTRPAGWEKYVPDLYQDPLVFRQHMAYYRWVAIGLVLPPLVCGLASRSWTGVLLGFLWGDMARIFAVSHCIWALNSLCHVIGRRDFHTTAHDRSRNSLLLAIPTFGQGWHNNHHAFPASAFTGLHWWQIDPGGLLVRVLERLHLVYDVHRPNAELIEKKRIAP

SEQ ID NO: 13096 - protein, 346 aa, Burkholderia pseudomallei K96243
MKHASAESPDSAGCAETPARAPAGSAADTAAPPAPDERASGHLSRASSARHLGVAALPAAGTAAAIALWAGFGLAPRVQDIAMLAVFYVLNILGMELALHRYFAHRTFKAKPAVKIALAILGSLAYMGPLMWWVAIHRLHHANADRPGDPHTPQLGGRGFAGRAKGILHGHVGWLFDPSSARPKGWNQYANDMYRDPTLLRIHLAYDYWLLLGLLLPGALGWLLDPSWRGALLGLLWGGTVRIFLATNAIWAVNSIGHALGGRRPFPGRDQSRNAAWLALVTLGAGWHNNHHAFPQYASTRLTRWQIDVTGMLIALLERLGLVWDVQHPDRDAVRERLANARRDDA

SEQ ID NO: 13097 - protein, 322 aa, Xanthomonas campestris pv. phaseoli
MTASPSKLAQLRELSVVVADTGDYDAIKRLQPVDCTTNPTLVKKALDLPVYADLIERELAWGREHGGDDRTATVNEVADRLTIGVGVKLAGLVPGRVSTEVDADLAHDTQATIAKARKFIAMYAERGVSKDKILIKIAATWEGIEAARQLQKEGIDCNLTLIFNRSQALACAEAGVFLISPFVGRILDYYVGKGQTPASIDEDPGVVFVRTVYNEFKQRGYSTVVMGASFRSTAQIEALASCDRLTISPDLLEKLDAEHGELPRKLSPAKADNAQFTPIDSDSFASGLAADPMATEKLAGGIDTFAKDLHALRKTIADKLAG

SEQ ID NO: 13098 - protein, 405 aa, Allium cepa
MAGADENHGAVKLANFRETTNRRALKDIKNFVGAPSFPCAANKRQLKEVVCGNNDSVIPRRPITRQFASTLASKSQQSHGETSNKHGQITGNEKHNPIIIDEDVPMVEESEEMEECELVEEITMEDIVIDSAQDIDIGDVGNPLAVVDYVDDIYNYYRRVEASSCVHPDYMSNQFDINDKMRAILIDWLVEVHYKFELMEETLYLTVNIIDRFLSRQAVVRKKLQLVGVTAMLLACKYEEVSVPVVDDLVTISDRAYTRKEVLDMEKSIVKTLQFNTSVPTPFVFLRRFLKAAGSEKKLELLSSFIIELSLVEYQMLKFQPSLLAAAAIYTAQCSLKGFKFWTRTCEQYTMYTEDQLLECSKMMVGFHRNAGSGKLTGVHRKYSTSKFGFAGKSYPALFLLDNRL

SEQ ID NO: 13099 - protein, 575 aa, Exiguobacterium sibiricum 255-15
MSKYPSKMKRLSFHKLSNEQRMKRAETVFFIFLSRIIVSGDMLLYNGECKRLKASIKGGIEMIPYKHEPFTDFSQEANKKAFEEALELVSKELGKDYPLVIGGERVTTEDKIVSVNPANKEEIVGRVSKATQAHAEDAMQAAVKAFETWKFVNPSVRADVLFKAANIIRKRKHEFSAYLVKEAGKPWNEADADTAEAIDFLEYYARQMLVLKEGKKVESRPGEYNRYDYIPLGVGVIISPWNFPLAIMAGTAVAAIVAGNPILLKPASTTPVVAAKFVEVMEQAGLPAGVLNFIPGPGAEVGDYLVDHPKTRFISFTGSRDVGLRINERASKLNDGQIWLKRVIAEMGGKDTMVIDESADLDYAADMITKAAFGFSGQKCSACSRVVALDSVYDELLAKVVENTNKLSIGNPVDVTNNVGPVIDAAAFKKITSYFDVAKQEGRIAAGGTADDSTGYFVAPTIVADVQPTDRLMQEEIFGPVVAFTKAKDFKEAIDIANNTEYGLTGAVITQDRTNQEYARANFHVGNLYFNRGCTGAIVGYQPFGGFNMSGTDSKAGGPDYLTLHLQAKTTSEMF

SEQ ID NO: 13100 - protein, 221 aa, Gracilaria lemaneiformis
MPASGKSSSIPTALPRSCTTPVLTVPSFLSKSNLLSRFTRNEFSLESKSTIGVEFATRSIQCEGKIIKAQIWDTAGQERYRAITSAYYRGAVGALLVYDITKKDSFDNVQRWLKELKDHADANIVIMLVGNKSDLQHLKAVTTDDASAFAESNGLSFIETSALDNSNVEEAFRSILSEIYRLGSKKALEKGSTSNFAPNATQTIVINPPADEGKTEKAKCC

SEQ ID NO: 13101 - protein, 393 aa, Gossypium hirsutum
MNLSATEKDLMIVNMGPHHPSMHGVLRLIVTLDGEDVVDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELVYDLFEAATGMRMMHNYFRIGGVAADLPYGWLDKCLDFCDYFLTGIVEYQKLITRNPIFLERVEGIGVIGGEEAINWGLSGPMLRASGIKWDLRKVDHYECYDEFDWEIQWQKEGDSLARYLVRISEMTESIKIIQQALEGIPGGPYENLEIRCFDRERDPEWNDFEYRFISKKPSPTFELPRQELYARMEAPKGELGIFLIGDQSGFPWRWKIRPPGFINLQILPQLVKRMKLADIMTILGSIDIIMGEVDR

SEQ ID NO: 13102 - protein, 386 aa, Solanum lycopersicum
MALHATAFSFTGVSTSSKSSRSALLSLPRRCAVKATSQYPHSFPRCKIQGRALPSDNGLVEKDESSLVVCFGEMLIDFVPTTSGLSLAEAPAFKKAPGGAPANVAVGISRLGGSSAFIGKVGEDEFGYMLAEILKENNVNSDGMRFDPGARTALAFVTLRKDGEREFMFYRNPSADMLLQEDELDLELIRKAKVFHYGSISLITEPCKSAHIAAAKAAKDAGVILSYDPNLRLPLWPSAESAREGILSIWNTADIIKISEEEISFLTQGEDPYDDNVVRKLYHPNLKLLLVTEGPEGCRYYTKDFSGRVKGIKVDAVDTTGAGDAFVAGILSQLASDVSLLQDEGKLRDALSFANACGALTVMERGAIPALPTKEVVLNTLLKSVA

SEQ ID NO: 13103 - protein, 532 aa, Pseudomonas aeruginosa UCBPP-PA14
MCGILGYVGTGFSVSRFAGALRLLAHRGPFGEGIAALPNGAIGMTRLPMSGAAAVPLPPQEGLRRVAYNGEVYQAGCEIHGEIRLLLDGLQRGVLPDGMYALASWDPQTRQLTLLRDEFGIKPLYYSYQPERGLLAFASEPRALLHLLGGARADAEAIAQVVAAGVPLEGQTLFQQVRLLLPGEVLRFDLSQERPRLCQRQRLATAPASEADSLDEQLGETLERCRQTFRPCALLVSGGVDSNLLGSYLDPQLQRFHLCLEGDEESLLPHPRLQRFELRQEAFMPLLRRAVGNFGGATRMSSLLMYQRLADGIGEQGYHCVLLGEGADELFWGYPRHLELWRRRDAPEPRRFAAAWFGEYRRKAALLAEPAGRRVAERIEELAHEALGQGLEAAIGQFDLHYSLEPLLRRADHLLMSRTIEARTPYLHGALAQRAGRLQRIVGDTAKAPLVALLEQREKRWQAQPKRHFRLPFERWPQALGEMRRHLAERLPALHDLGLEGLDAPSVAALPGDQLFTLTTLSLWQQEYGASL

SEQ ID NO: 13104 - protein, 937 aa, Cytophaga hutchinsonii ATCC 33406
MPKDTSIKHILIIGSGPIVIGQACEFDYAGSQAARSLREEGIEVTLINSNPATIMTDKVVADNVYLLPLEKKSIIKILENHKIDAVLPTMGGQTALNLAMECDKAGVWKKFGVRMIGVDINAIETTEDREKFRLKMIEIGVGVCKGATATSFLQGKEIAQEIGFPLVIRPSFTLGGTGGGFVHTADKFDEALTKGLHASPTHEVLVEQSILGWKEYELEILRDSIGNMIIICSIENFDPMGIHTGDSITVAPAMTLPDTIYQEMRDQSIKMMKAIGNFAGGCNVQFSVCPDTDHIIGIEINPRVSRSSALASKATGYPIAKISAKLAIGYNLDELKNQITKTTSAFFEPALDYVIVKVPRWNFDKFKGADRTLGLQMKSVGETMGIGRNFQEALQKACQSLEIKRNGLGADGKELTNQDQILDSLANPSWNRLFHIYDAFKLGVQFKTIQKLTKIDPWFLTQIEELVLLEKEIQKTTIQNISREMLKTAKQKGYADRQIAHLLRCMESEVFSKRHEFGIKRIYKIVDTCSAEFEAKTPYYYSTFEGENESIPSDKKKIIVLGSGPNRIGQGIEFDYSCVHGVLAAKECGYETIMINCNPETVSTDFDIADKLYFEPVFWEHIYEIILLEKPVGVIVQLGGQTALKLAEKLERYGIKIIGTDFQSLDLAEDRGRFSSLLKEINIPYPEFGVIENADEAVAISKKLNFPLLVRPSYVLGGQSMKIVINEQELEQHVVNLLKDHPGNQVLVDHFLENAIEAEADAICDGENVHIIGIMEHIEPAGIHSGDSHSVLPPFDLSDDVIRQIEEHTKKIAIALKTVGLINIQFAIKNEIVYIIEANPRASRTVPFICKAYDEPYVNYATKVMLGENKVTDFTFNPKKNGYAIKIPVFSFNKFPNVNKELGPEMKSTGEAILFIDDLHDDAFVKLYSERNLYLSR

SEQ ID NO: 13105 - protein, 290 aa, Geobacter sulfurreducens PCA
MFKGSIVAIVTPFTNGAVDQEKLRELVEFQITNGTDAIVPCGTTGESSTLDYDEHMDVVKIVIEQVNKRVPVIAGTGSNSTAEAIELSRKAKEAGADGVLLVTPYYNKPTQEGLVRHYTAIADAVAIPQILYNVPGRTGVNMLPETVARLAPHKNIVAIKEATGSLQQASEILALCGDQIDVLSGDDFITFPMMACGAKGVISVLANIMPKAVADLTDAFFAGDLETARRLHLNTLKISNAMFIESNPIPVKTALGLMGKCSDEVRLPLCPMSEGNKAKLTAIMKEYQLI

SEQ ID NO: 13106 - protein, 167 aa, Gossypium hirsutum
MFPMVTGFMNYGHQTVRAARYIGQGFMITLSHANRLPVTIQYPYEKLITSERFRGRIHFEFDKCIACEVCVRVCPIDLPVVDWKFETDIRKKRLLNYSIDFGICIFCGNCVEYCPTNCLSMTEEYELSTYDRHELNYNQIALGRLPMSVIDDYTIRTVLNSIQRKTQ

SEQ ID NO: 13107 - protein, 369 aa, Triticum aestivum
  misc_feature (124)..(124): Xaa can be any naturally occurring amino acid
  misc_feature (268)..(268): Xaa can be any naturally occurring amino acid
YQLLRLITPRYLCDTIEYSSYASNALGALPYGRPAGGRTSDSRPRCHFRDKLGQGCYGSVYKGVLLPGGVHVAVKMLEGNSNCNGEDFISEVSTIGRIHHVNVVRLVGFCSVEMRRALVYEYIXSGRPGRYIFSTEKSFSWDKLNEIALGIARGINYLHQGCDMQILHFDIKPHNILLDSNFVPKVADFGLAKLYPRGDSFVPLSAMRGTIGYIAPEMISRSFGVISSKSDVYSFGMLLLEMAGGRRNADPNMGSSSQAYLRPPPRVXTKLTREEAGEEISPVAAHMHELEKKLCVVGLWCIQMRSCDRPTMGEVIEILEAGTDSLQMPSRPFFCDEGHIHVEDSYHFTSELTVVSEEESTAVSEEDNV

SEQ ID NO: 13108 - protein, 194 aa, Saccharomyces cerevisiae
ISDDILSVLDSHLIPSATTGESKVFYYKMKGDYHRYLAEFSSGDAREKATNASLEAYKTASEIATTELPPTHPIRLGLALNFSVFYYEIQNSPDKACHLRKQAFDDAIAELDTLSEESYKDSTLIMQLLRDNLTLWTSDMSESGQAEDQQQQQQHQQQQPPAAAEVKHQSKYSDKSKEKLLKKRKKKERGCNNL

SEQ ID NO: 13109 - protein, 315 aa, Hyphomonas neptunium ATCC 15444
MTQYFEPIPYPLWHTDKAGFAEKLGKSFRETGFAVITGHPIQQPVIDDNLAATKAFFALPEAAKETYHDAPGGRQRGYTPFGTENAKGQAQADLKEFWHTGRDLPPGSPYRATMKDTPSVSEVADFDRATHTLYTALDDFGADLLKGVALHLNLPEDWFADKVNFGNSILRLLHYPPQMNPPPEGSVRAGAHEDINVITLLLGAEEAGLEVKHRSGKWLAVNPPPGALVINCGDMLQRYTGGVLPSTTHRVVNPAPERARFPRYSTPFFLHFNQDFMIEALPGCLAEGGKAQPPITAQDFLMERLREIGLVKERS

SEQ ID NO: 13110 - protein, 425 aa, Clostridium perfringens
MDRNKEIFEESKKYMPGGVNSPVRSFGSVGINPPVIKSGKGAMIKDENGNEYIDFVLAWGPMILGHCDEDVVEAIKKTSEESIAFGASTKLELDLAKLLCETLDNVDMIRMVNSGTEATMSAVKLARGYTKKDKIIKFAGCYHGHFDGFLIEAGSGVLTEGIPGCLGVPEESIKNTLIGIYNDEKQVEELFEKYGNDIAGIIIEPVAGNMGVVKCDPKFMRKLRELCDKYGALLIFDEVMCGFRVAYKGAQTLFDVKPDLVTYAKIMGGGLPCGAYGGRREIMENLSPLGGVYQAGTMSGNPIVMSAGLATVKKLYENPSYYNHIEKIGSKLEKGVLEIAKKKGLGLVVNRQGGMITLFFTDLKEVKCYDDVKTCDGERFKRYFLHMLNKGFNIPPSQFEAMFLSVKHTEEHIDKFLEAFETFEG

SEQ ID NO: 13111 - protein, 450 aa, Staphylococcus aureus subsp. aureus N315
MNNKRHSTNEQLSLDEINNTIKFDHRSSNKQKFLSFLGPGLLVAVGYMDPGNWITSMQGGAQYGYTLLFVILISSLSAMLLQSMTVRLGIATGMDLAQMTRHYLSRPIAIIFWIIAELAIIATDIAEVIGSAIALNLLFNIPLIVGALITVLDVFLLLFIMKYGFRKIEAIVGTLIFTVLFIFIFEVYISSPQLNAVLNGFIPHSEIITNNGILYIALGIIGATIMPHNLYLHSSIVQSRTYSRHNNEEKAQAIKFATIDSNIQLSIAFVVNCLLLVLGASLFFNSNADDLGGFYDLYHALKTEPVLGATMGAIMSTLFAVALLASGQNSTITGTLAGQIVMEGFLRLHIPNWLRRLITRSLAVIPVIVCLIIFKGNAAKIEQLLVFSQVFLSIALPFCLIPLQLATSNKDLMGPFYNKTWVNIISWTLIIILSILNVYLIVQTFQELQS

SEQ ID NO: 13112 - protein, 344 aa, Oryza coarctata
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKDNVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAKLEHNH

SEQ ID NO: 13113 - protein, 350 aa, Listeria innocua Clip11262
MAYKITSLAGDGIGPEIMASGIKILEAIAAKYNHTFEIESHPFGGAGIDAAGDPIPPETLKACQNADAILLGAIGGPKWDNAPKRPEDGLLALRKALGLFANIRPIQVPSSITHLSPLKKEIVENTDFVVVRELTGGLYFGEPKHWDDVAAVDSLTYTRVEIERIIEKAFEIASTRNKKVTSVDKANVLASSKLWRKIAEEVASRHPDITLEHLYVDAAAMLMIQRPTTFDVIVTENLFGDILSDEASVITGSLGMLPSASHAENGPSLYEPIHGSAPDIANQNIANPMSMISSVSMMLRQSFSLFKEADAIDAATARTMQAGFLTADLGGNTSTTDFTNEVLKQIEGGE

SEQ ID NO: 13114 - protein, 470 aa, Rickettsia prowazekii str. Madrid E
MSFLRKKSFESVKEIGSSSGLSKTLGAFDLILLGLGAMIGTGVFVVTGIIAAKFSGPAVMISYMIAGITCIFVALVYTELAAMLPTSGSIYTYSYVAFGEVFAWMIGSVIILELGVSAGIVAAGWSGYVQGILEAGGIYLPKVLTTVPSNGGVINLPAFLISAFIGFILFLGTKDSKKINAILVFIKMVAIFAFVLAAAPHFDATNWSNFMPFGFGSVVMGSSILFLAFTGFGTIATAAEECKNPKRDIVIGIIGSLILTTLVYVIMSGLVTGIAPFDQLNNDRPLAYALTINNSKIGSAIVSTGAVCGMMTVLMMNIYGTSRIFYAIARDGLLPKSFAKLHPKYDSPYITIIIFSALAAFLGGFCPTEIITQLTSMGALIDYIAVAIIVMMFRIKLPTAQRAFKCPIVFIIAPFILFACIYLLLTQMYGDEIYKGNFNLLTSGRVLIYWFITIFILYLVRSFFMGKEQH

SEQ ID NO: 13115 - protein, 425 aa, Bradyrhizobium sp. BTAi1
MGANEELLARRHQAVVRGVSYATPLFADRALNSEVWDVEGKRYVDFAGGIAVLNTGHCHPHVVAAIRAQLDRFTHTCFQVLQYEPYVRLTERLNAIAPISGPAKSILLTTGAEATENAIKIARAATGRSGIIAFTGAFHGRTALANAMTGKVMPYKKHFGPPLPGIWHAPFPIAGSGVSVEDTLSYINFIFKADIDASQVAAIIIEPVQGEGGFHQAPPELMSGLRRLCDTHGIVLIADEVQTGFGRTGKMFAMEHYDVQPDVICVAKSLAGGMPLSGVIGRAAIMDAAEPGGLGGTYGGNPLACAAALAVLDVFEQDKLLDRANAIGARLRAAISKFSRANTLVPISEPRGPGAMIAFDILKQRGSHEPDAEMTKRVTRVAYENGLILLSCGVTASTIRILVPLTASDEIVDEGLAILEKCLAA

SEQ ID NO: 13116 - protein, 175 aa, Triticum aestivum
MAPTVMASSATSVAPFQGLKSTAGLPVCRRSNGASLGSVSNGGRIRCMQVWPIEGIKKCETLSYLPPLRTEALLKQVDYLIRSKWVPCLEFSKVGLIFREHNTSPGYYDGRYWTMWKLPMFGCTDATQVINEVEEVKKEYPDAYVRIIGFDNMRHVQCVSFIAFKPPGCEESGKA

SEQ ID NO: 13117 - protein, 251 aa, Triticum aestivum
  misc_feature (81)..(81): Xaa can be any naturally occurring amino acid
  misc_feature (96)..(96): Xaa can be any naturally occurring amino acid
  misc_feature (246)..(246): Xaa can be any naturally occurring amino acid
MGRKFFVGGNWKCNGTTDQVEKIVKTLNEGQVPPADVVEVVVSPPYVFLPVVKSQLRPEFHVAAQNCWVKKGGAFTGEVSXARCSVNLGVPWVILXGHSERRALLGESNEFVGDKVAYALSQGLKVIACVGETLEQREAGSTMEVVAAQTKAIAEKISDWSNVVVAYEPVWAIGTGKVATPAQAQEVHASLRDWLKINVSPEGAESTRIIYGGSVTAANCKELGAQPDVDGFLVGGASLKPEFIDXQRGPP

SEQ ID NO: 13118 - protein, 113 aa, Zea mays
MGCAGSTPKVDENSKKLKRPKAWKHTQPITPARLKQMRDEFWDTAPHYGGQKEIWDALRVAAESDLALAQTIVDSAGIIVSNPDMTLCYDERGAKYELPKYVLSEPANLIRDG

SEQ ID NO: 13119 - protein, 357 aa, Oryza sativa (japonica cultivar-group)
MLSVSCPRVYMSRKALDFGQLASCRCRWAGRSGMRVAPRRRMPCVCFVASPSQPENPVLVSAAEQIFGAGGKRLRPALVFLVSRATAELAGLLELTTEHQRLAEIIEMIHTASLIHDDVIDDSGMRRGKETIHQLYGTRVAVLAGDFMFAQSSWFLANLENIEVIKLISQMMCSQVIKDFASGEIKQASTLFDCDVTLDDYLLKSYYKTASLLASSTRSAAIFSGVSTTICEQMYEYGRNLGLSFQVVDDILDFTQSAEQLGKPAGSDLAKGNLTAPVIFALQDEPKLREIIDSEFSESDSLATAIDLVHRSGGIRRAQELAKEKGDLALQNLQCLPKSQFRSTLENVVKYNLQRID

SEQ ID NO: 13120 - protein, 451 aa, Mycobacterium smegmatis str. MC2 155
MAMRVDQTCGSEEHSPASTQRSAQLFADACAVIPGGVNSPVRAFNSVGGTPRFITSAGGYWLTDADGNRYIDLVCSWGPMLLGHAHPAVVEAVRKVAEHGLSFGAPTPSETELAAEIIDRVAPVEMMRFVNSGTEATMSAIRLARGFTGRAKIVKFSGCYHGHSDALLADAGSGVATLGLPSSPGVTGAAAADTIVIPYNNVAAVEDVFAHFGDEIACVISEASPGNMGTVPPLPGFNAALRRITAEHGALLILDEVMTGFRVSRSGWYGLDPVEADLLTFGKVMSGGLPAAAFGGRTEVMSRLAPLGPVYQAGTLSGNPVAMAAGLTTLRHADDAVYAKLDANADRLAGLLTGALTEAGVAHQVQRAGNMLSVFFTDAPVHDFAAAKATETWRFPPFFHALLERGVYPPCSAFETWFVSAALDDDAFARIAEALPAAARAAAAATPEGTA

SEQ ID NO: 13121 - protein, 116 aa, Bdellovibrio bacteriovorus HD100
MGKKIYVGNLSYSLDDQSLADTFAEFGNVESARIVIDRETGRSKGFAFVEMSTDDEAATAIAKLNGVELMGRAMNVSEAKPMAPRENRGGFGGGRGGGGGGNRGGGFGGGNRGGRF

SEQ ID NO: 13122 - protein, 469 aa, Arabidopsis thaliana
MDRISSLPDEILEHILSFLSTKEAALTSSLSTRWKNVFVFVPSLHLDYARQHENPREFIDFVDFVNTLFNRKGNSPIKKLALKIHLKDNQSLQNQTHVQSWIHRVLSRGGVTDLDLFITFKGKFQLVPLLIFKSNTLVKLRLGRGFTIKLCHENVYLPMLKTLCLDTVDFDGDHNVFETLLPRCPLLEELVLEDQRWKQWCGSVSSPSLKRLRIRFFHIPIISLDVPGLVYLELSCIFGSKYANVNLDSLVEARLNHWVEEQELRKLRDGSSHLVPADMMDLITGIRKVKVLHLTSDALEVSLLFLFYCSSKDLFMLQSSDAKTGFLFYFSGQELPMFDNLVYLSIASDKKQGWQILPLLIKNSPNLETLVFKGLEHYTTKQCGDACVCSGILGKSSSCLSSSRVKVLEIWSYQGTSKELKQMGHFLMKLQFLELVKIRAVSNLQVPIDIQYLLKLPRASSNCKIQAIF

SEQ ID NO: 13123 - protein, 294 aa, Glycine max
MEQYEKVEKIGEGTYGVVYKARDRVTNETIALKKIRLEREDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEDTWPGVTSLPDFKSTFPKWPSKDLANVVPNLDAAGLNLLSSMLCLDPSKRITARSAVEHEYFKDIKFVP

SEQ ID NO: 13124 - protein, 410 aa, Cytophaga hutchinsonii ATCC 33406
MQVTNRTYEFQGVSLTELATEYGTPLYVYNSEKILSQYKRLHDAFSGVNVRIKYAAKALTNQAILKLLKGAGAGVDVVSIQELQLALKAGFDKKDIMFTPNCVDFSEIEEAVGYGVQINIDNIPFLKQFGQVYGSSVPCCVRINPHIDAGGNVKIMTGHKGSKFGISIEQVNEIYEVVDEYEILVNGVHVHSGSDFKSADAFVRAAEVVYSVAMQFDKLTFLDFGSGFKVSYKEGDYVTDIEELGKKMTDSFNAFCLNYGKKLDIWFEPGKFLVSESGMLLVTCTVIKETPACNFIGVNSGLNHLIRPMMYGSHHDIVNVSNPDGDKKMYTVVGYICETDTFGSDLFIEETKAGDIIGLKNAGAYGFSMSSNYNSRFRPAEVLVHKGKHQLIRKRETMEDLLKNQIDVEL

SEQ ID NO: 13125 - protein, 232 aa, Bartonella sp. AN-nh1
DSIDITDPHQRMIASVRLISKVPTLAAMAYKYSIGQAFVYPRNDLSYAANFLRMCFSVPCEDYKSNPVLTRAMDQIFILHADHEQNASTSTVRLAGSSGANPFACIAAGVACLWGPAHGGANEACLKMLQEIGSIERIPEFIARAKDKNDPFRLMGFGHRVYKNYDPRAKIMQKTCHEVLKELNIQDDPLLDIAIELEKIALNDEYFIEKKLYPNVDFYSGITLKALGFPTE

SEQ ID NO: 13126 - protein, 174 aa, Brassica napus
MVYHSSFVEEEGITKACGCPLLPLKSHIKGPAPVSEQDRTDIVDEAITFFRANVFFTNFPIKSPADKLLIYLTFYINVALKRLEGCRTLAVGTKAIINLGLEDIPVPGETGFPFPGLFSLPSSQEEADLFRNYLKQVREETSGRLLSVAYRANGTPNKWWLAFAKRKFINVVLL

SEQ ID NO: 13127 - protein, 407 aa, Escherichia coli
MEALTFKPEEWGMKRGTENEDFMFLNLGPNHPSAHGAFRIVLQLDGEEIVDCVPDIGYHHRGAEKMGERQSWHSYIPYTDRIEYLGGCVNEMPYVLAVEKLAGITVPDRVNVIRVMLSELFRINSHLLYISTFIQDVGAMTPVFFAFTDRQKIYDLVEAITGFRMHPAWFRIGGVAHDLPRGWDRLLREFLDWMPKRLASYEKAALQNTILKGRSQGVAPMARKEALEWGTTGAGLRATGIDFDVRKARPYSGYENFDFEIPVGGGVSDCYTRVMLKVEELRQSLRILEQCLNNMPEGPFKADHPLTTPPPKERTLQHIETLITHFLQVSWGPVMPANESFQMIEATKGINSYYLTSDGSTMSYRTRVRTPSFAHLQQIPAAIRGSLVSDLIVYLGSIDFVMSDVDR

SEQ ID NO: 13128 - protein, 129 aa, Zea mays
MDLFIFVYACADFPGAKVVSEAVAKSGTSPLLPAITFILDKVAPFIPKEEPKEEPAAEATSREVAVEEKKEEAEPAAATEAAPAPAETPSEAAVVEEKKEEEKKEEEDKPAAEEAAPPAAAAAAAAEEK

SEQ ID NO: 13129 - protein, 136 aa, Burkholderia pseudomallei K96243
MSIQAQTSAITCANAPDIPPPAGHYSHVCVANGFVFVSGQLPIDPTGKPLSDAPFDAQAKQVLHNVDATLKAAGVTRDDLVQVRVFVSDIEHWPIFNGLYAEWIGAHKPARAVAESASLHYGSAVEVEAIALASAI

SEQ ID NO: 13130 - protein, 509 aa, Bordetella bronchiseptica RB50
MDLSDLKKLGLDVAYPFKEQYENYIGGQWVPPVGAEYFDNLSPITGQPFCRVPRSGAADIELALDAAHRARAAWARTSPAERANILLRIADRIEGQLPMLAVAESIDNGKPLRETTAADLPLAIDHFRYFAGCIRAQEGAISEIDANTVAYHFHEPIGVVGQIIPWNFPLLMAAWKLAPALAAGCVVVLKPAEQTPASILVLAELIGDLLPPGVLNVVNGYGKEAGQALATSKRIAKIAFTGSTPVGKHILHAAADNLIPATVELGGKSPNIFFDDVMDHDDEFLDKALEGLAMFALNQGEVCTCPSRILIQESIYERFIEKAIARVQSIKTGHPLDAGTMVGAQVSQVQMDKILSYIDIGRQEGAQCLTGGARNDMLPGGLDQGFYVQPTMLLGKNSMRIFQEEIFGPVAAVATFKDEEEAIAMANDTFYGLGAGVWSRDGARAYRVGRGIEAGRVWTNCYHLYPAHAAFGGYKQSGIGRETHKAALSNYQQTKCLLVSYSAKALGFF

SEQ ID NO: 13131 - protein, 207 aa, Oryza sativa (japonica cultivar-group)
MAIATTTLPLAPLALAPPSSPISQCSLLLLRPRAPAALSLRPSARLLVAVAASEPELGGSGGGGAGDGSGSGGGGDSEKPRGGGGDEEGEGEEEKMGQGLSMSQKITLAYAALVGAGGAMGYMKSGSQKSLAAGGISALVLYFVHTQLPVRPVFASSIGLGISAALLSVMGSRFKKSGKIFPAGVVSLVSLVMVGGYIHGILRSTHA

SEQ ID NO: 13132 - protein, 120 aa, Rickettsia prowazekii str. Madrid E
MYNKENVFAKIITKNLPAEIIYEDKQILAFKDIAPIAPVHIIVIPKNEYIDYTDFISKASIDEIKHFFSKIADIANEAGLDKVGYRLITNKGEKSGQTIFHFHFHIIGGKKLIGLINNND

SEQ ID NO: 13133 - protein, 259 aa, Oryza sativa
  misc_feature (59)..(59): Xaa can be any naturally occurring amino acid
  misc_feature (70)..(70): Xaa can be any naturally occurring amino acid
MHAYVSLDPLERRYNLCEDMKFFATPPVHGSLANQIVHPGDLCFKLPENVSLEEGAMCXEPLSVGVHACXRADVGPETGVLIMGAGPIGLVTLLAARAFGAPRVVIVDVDEHRLSVARSLGADAAVRVSARAEDVGEEVERIRAAMGGDIDVSLDCAGFSKTVATALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 13134 - protein, 128 aa, Legionella pneumophila str. Paris
MQPINTKLAPKAIGTYSQAIRSGEIVFLSGQIPLDPETMQICSDDIKLQITQVLENLSAVCEEAGGSLANIVKLNVYLTDLSHFPLINEAMSRYFSEPYPARAAIEVSALPKGAKVEMDGILVLSASA

SEQ ID NO: 13135 - protein, 322 aa, Malus x domestica
ILPFKLPAIGPNDVRIRIKAVGICGSDIHYLKTMKCGDFQVKDPMVIGHECAGIVDKVGSEVKHLVPGDRVAVEPGISCAHCQQCKGGRYNLCPDMKFFATPPVHGSLANQIVHPADLCFKLPENVSLEEGAMCEPLSVGVHACRRANVGPETTVLIVGAGPIGLVSVLAARAFGAPRIVIVDMDDRRLAMAKSLGADGTVKVSTKMEDLDDEVAKIKEAMGSEVDVTFDCVGFNKTMSTGLNATRPGGKVCLVGMGHGVMTVPLTPAAAREVDVVGVFRYKNTWPLCLEFLRSGKIDVKPLITHRFGFTEKEVEEALEPVL

SEQ ID NO: 13136 - protein, 181 aa, Zea mays
  misc_feature (52)..(52): Xaa can be any naturally occurring amino acid
LYATSCRHTTLCSDCGRTLALASGRCTQCNAPVTRLIREYDVRVDTSAEKEXPLSNERSAGNRWTLRKDVPHGQQLTGNMRDMHYSKRPWILEDETGEHQYQGQTEDPPATYYSLTQKGNDMIAVQVGSWYNFSKIAQYKQLTLEEAEEKMNRRRSSASGYERWMMKAATNGPDAFSSVVK

SEQ ID NO: 13137 - protein, 100 aa, Triticum aestivum
  misc_feature (91)..(91): Xaa can be any naturally occurring amino acid
MAPTVMASSATSVAPFQGLKSTAGLPISRRSSSAGLSSVSNGGRIRCMQVWPIEGIKKFETLSYLPPLSTEALLKQVDYLIRSKWVPCLEXFTRLGFVFR

SEQ ID NO: 13138 - protein, 232 aa, Bartonella sp. AN-nh3
DSIDITDPHQRMIASVRLISRVPTLAAMAYKYSIGQAFVYPRNDLSYAANFLRMCFSVPCEDYKSNPVLTRAMDQIFILHADHEQNASTSTVRLAGSSGANPFACIAAGVACLWGPAHGGANEACLKMLQEIGSIERIPEFIARAKDKNDPFRLMGFGHRVYKNYDPRAKIMQKTCHEVLKELNIQDDPLLDIAIELEKIALNDEYFIEKKLYPNVDFYSGITLKALGFPTE

SEQ ID NO: 13139 - protein, 216 aa, Triticum aestivum
  misc_feature (125)..(125): Xaa can be any naturally occurring amino acid
  misc_feature (133)..(133): Xaa can be any naturally occurring amino acid
  misc_feature (143)..(143): Xaa can be any naturally occurring amino acid
  misc_feature (181)..(181): Xaa can be any naturally occurring amino acid
MADAKQQQAAAPTGVWKTIKPFVNGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGRXVGSPADLXALIRMQADSXTLPAAQRRHYKNAFHALYRITADEGVLALWKGAGPNCXGEAMSLKMGNACLPMNQGVKLFKEKIGCPGEYQNW

SEQ ID NO: 13140 - protein, 395 aa, Exiguobacterium sibiricum 255-15
MKHFAPSIAIDRLPAPVFAELAQRIGAVKAAGHDVITLGQGTPDQTTPVHILDALKEAINDASNLQYPPFRGHDFLKQAVADFYQSEFGVNIDPASEVAILLGSKAGIVALPQTIVNPGEGVIVPDPGYPDYLSGAALAGAYPITLPLLAENAFLPDYTLLDTTDVERARMLFLNYPSNPTGATATAEAFEQTVSFADANDICVVHDLAYGGISFDGPTRSFLQTEGAKDVGIELFSLSKRFNMSGFRIAFAIGNPSVIASIETYQEHLYVSAFTPIQQAATVALSSDQTCVRELSALYEARRDALFGKLQEIGWDGPIPGGSFFVWLPVPSGYTSQSFTDHLLDEAHVAVTPGHFFGEYGEGYVRISLIADAERLVEAAERIGQLNLFRQTVAE

SEQ ID NO: 13141 - protein, 351 aa, Oryza sativa (japonica cultivar-group)
MEEEGFYTNLMNEGNDSLDWDSLSSMPVEDDMSNQLDENGMSSEPVTQQFPTAERTTVARPNQKRSKNFSEQEDKILVSAWLHVSLDPVLGTNQTRAAYWTRIYEHFYKTSKSTPDRSQNSLMHRWKTIQENVNKFCGHLSQIEGRRQSGVSIHDKIAQAIAVFKELEGKPFQFLHCWSLLRSQSKWHDKMKQITSQKPCATNRQKPSTDGSAKATPTNDETTNHVGEDNEPTETEEPKRPMGKKRAKEQLRRGETCTDAFDHLWEKKKEADAEKKKERDERHQKSYELDKQRLELDKKKVANETDEIQLKRMLEEERIMKMDISSKPLSQQQFYKSVQDEIIARRMNSSG

SEQ ID NO: 13142 - protein, 304 aa, Arabidopsis thaliana
MAATLPLSPINHQLCRFGNNSLTTHRFCSPGFLISSPCFIGLTGMGSATQLRARRSLISSAVATNSLLHDVGAAVAVLGGAYALVLSFESLTKRNVIQQSLSRKLVHILSGLLFVLAWPIFSGSTEARYFAAFVPLVNGLRLVINGLSISPNSMLIKSVTREGRAEELLKGPLFYVLALLFSAVFFWRESPIGMISLAMMCGGDGIADIMGRKFGSTKIPYNPRKSWAGSISMFIFGFFISIALLYYYSSLGYLHMNWETTLQRVAMVSMVATVVESLPITDQLDDNISVPLATILAAYLSFGY

SEQ ID NO: 13143 - protein, 232 aa, Bartonella sp. AN-io2
DSIDITDPHQRMIASVRLISKVPTLAAMAYKYSIGQAFVNPRNDLSYAANFLRMCFSVPCEDYKSNPVLTRAMDQIFILHADHEQNASTSTVRLAGSSGANPFACIAAGVACLWGPAHGGANEACLKMLQEIGSIERIPEFIARAKDKNDPFRLMGFGHRVYKNYGPRAKIMQKTCHEVLKELNIQDDPLLDIAIELEKIALNDEYFIEKKLYPNVDFYSGITLKALGFPTE

SEQ ID NO: 13144 - protein, 414 aa, Hyphomonas neptunium ATCC 15444
MDLSGAKRIVIVGAGQAAAQAVQSLRLGGYAGELTIVGEETALPYQRPPLSKAYMKGEMAEERLYFRPAAWYEDNKIEVMLGSRVTSIDRAARVAHLEHGAELPYDALVIATGSRPRTLPCQGADLTGVHDLRSLSDVERIRPQMVEGRRMVIIGAGYIGLEAAAVARTMGLDVTVLEMAPRVLARVTSPVMSEFYAAEHIAKGVKILTSTALSHLEGKDGHINAAALADGTKLPADIVLVGIGILPNEELAKDAGIACSNGILTDRDGRTSDPHVFAAGDCASRPLVHYGRTGRLESVHNAIEQGKLVAAAILGQNRPAEDCPWFWSDQYDLKLQIAGLSTDYDTIVLRGDPEDRKFAAFYLRNGTLIAVDAVNSPPEFLASKKLIMTGAKIAPEVLSDTSIPMKDIAAKAAA

SEQ ID NO: 13145 - protein, 218 aa, Methylococcus capsulatus str. Bath
MTQDELKRKVAEAALDYVKDVTILGVGTGSTVNHFIDLLADLKGGIEGAVSSSQASSERLKKIGIPVLDLNAAGTLDVYVDGADEVNAAKQMIKGGGAALTREKIVAEASRKFVCIVDETKCVDVLGKFPLPVEVIPMARSLVARRLVELGGTPVWRENCITDNGNVILDVHNLTITDPVELERRINDIPGVVCNGVFALRPADVVLIGSPSGVRTLP

SEQ ID NO: 13146 - protein, 321 aa, Malus x domestica
ILPFKLPAIGLNDVQIRIKAVGICGSDVHYLKNMKLADFEVKEPMVIGHECAGIVEKVGSDVKHLVSGDRVAVEPGISCSRCQQCKGGRYNLCPDMKFFATPPVHGSLANQIVHPADLCFKLPENVSLEEGAMCEPLSVGVHACRRANVGPETTVLIVGAGPIGLVSVLAARAFGAPRIVIVDMDDKRLAVAKSLGADGTVKVSAKMEDLDDEVAKIKETMGAEVDVTFDCVGFNKTMSTGLNATRPGGKVCLVGMGHSMMTVPLTPAAAREVDVVGVFRYKNTWPLCLEFLRSGKIDVKPLITHRFGFTEKEVEEASLEF

SEQ ID NO: 13147 - protein, 493 aa, Mesorhizobium sp. BNC1
MSTSARNRFPGVSFDPKALRSNLFIGGAWKEGATGNRIPVYDPSTGTVIAEVADAEVEDVMGAIDAAHEALPGWAATPPRHRSEVLRRCFELMIENRDMLAELISLENGKTLADAQGEVAYAAEFFRWFAEETVRLNGELYKAPSGANRILVQHQPIGVSVLVTPWNFPAAMATRKIGPALAAGCTVILKPATETPLTAYALAALCAEAGVPDGVVNVYTSSRSGKTVSAMLHDPRVRKLSFTGSTEVGRILLREAADKVISCSMELGGNAPFIVFDDADLSAALDGAMVAKMRNGGEACTAANRFYVQSGIADAFAKGLAERMKALAIGKGYETGSQCGPLINKDAVERISGLVEEAQSRGARVLAGGKALNREGYYFPPTVIDNVDPASAIMSEEIFGPVAPIIRFDSEDEVLSAANGTEYGLMAYVYTQDLSKGLRVSEKIESGMVGLNRGLVSDPAAPFGGVKQSGLGREGSHHGILEFTETKYIATNW

SEQ ID NO: 13148 - protein, 488 aa, Oryza sativa
MGENVVGTYYYPPSAAAMDGVELGHAAAGSKLFDDDGRPRRNGTMWTASAHIITAVIGSGVLSLGWAIAQLGWVAGPAVMVLFSLVTYYTSSLLSDCYRSGDPVTGKRNYTYMDAVNANLSGFKVKICGFLQYANIVGVAIGYTIAASISMLAIGRANCFHRKGHGDPCNVSSVPYMIVFGVAEVFFSQIPDFDQISWLSMLAAVMSFTYSVIGLSLGTVQVVANGGLKGSLTGISIGVVTPMDKVWRSLQAFGDIAFAYSYSLILIEIQDTIRAPPPSESAVMKRATVVSVAVTTVFYMLCGSMGYAAFGDDAPGNLLTGFGFYEPFWLLDIANAAIVVHLVGAYQVFCQPLFAFVEKWAAQRWPESPYITGEVELRLSPSSRRCRVNLFRSTWRTAFVVATTVVSMLLPFFNDVVGFLGALGFWPLTVYFPVEMYVVQKKVPRWSTRWVCLQMLSVGCLVISIAAAAGSIAGVMSDLKVYRPFKGY

SEQ ID NO: 13149 - protein, 356 aa, Limnanthes douglasii
LRLSLYFPISISLSLSLEAMASFIATTTPAMPAFASVLDPKIPTKPEPKTETPKPKDDLERFRTSEVVLERKAKGFWRRKWNPRDIQNAVTLLVLHALAAMAPFYFSWDAFWISFILLGFASGVLGITLCFHRCLTHGGFKLPKLVEYFFAYCGSLALQGDPMEWVSNHRYHHQFVDTERDVHSPTQGFWFCHIGWVLDKDLFVEKRGGRRNNVNDLKKQAFYRFLQKTYMYHQLALIALLYYVGGFPYIVWGMGFRLVFMFHSTFAINSVCHKWGGRPWNTGDLSTNNMFVALCAFGEGWHNNHHAFEQSARHGLEWWEIDVTWYVIRTLQAIGLATNVKLPTEAQKQKLKAKSA

SEQ ID NO: 13150 - protein, 408 aa, Rhodococcus sp. RHA1
MCNPRRHTDYAAVMPATPRNRTVQRLQPFASTIFAEMTALAVRHHAINLGQGFPDTDGPASMLDTARRAIADGLNQYPPGPGMPVLRQAVAADRLARYGLDHDPDSEVLVTVGATEAISAAILGLVEPGEEVVLIEPYYDSYAASVALAGAVRRSVPLARSGTKFVVDLDALRAAITPKTRMLVINTPHNPTGTVFTPEEIAAVAEVACEHDLLVLSDEVYEHLVFDGRTHTALATLPGMYERTVSVSSAAKTFNVTGWKIGWACGPAELIDAVRTAKQYMSFVGGGPFQPAVAHALSHEQQWVKELRDSLQAKRDVLYDALVASGLEVHSGGGTYYLCADITAIGERDGIDFCRRLPERIGVAAVPVSVFTDHPVPWNPLVRFAFCKQDHVLEEAARRLRTLGEPGS

SEQ ID NO: 13151 - protein, 130 aa, Oryza sativa (japonica cultivar-group)
MAGKASIALFLAVNLVVFSLASACGGRCPTPTPSTPSTPTPTPAAFGKCPRDALKLGVCANVLGLIKAKVGVPPAEPCCPLLEGLVDLEAAVCLCTAIRGNILGINLNLPVDLSLILNYCGKRVPTGFKC

SEQ ID NO: 13152 - protein, 100 aa, Zea mays
  misc_feature (66)..(66): Xaa can be any naturally occurring amino acid
  misc_feature (83)..(83): Xaa can be any naturally occurring amino acid
MSGRGKGGKGLGKGGAKRHRKVLRDNIQGITKPAIRRLARRGGVKRISGLIYEETRGVLKIFLENXIRDAVTYTEHARRKTVXTAMDVVYALKRQGRTLY

SEQ ID NO: 13153 - protein, 1119 aa, Aspergillus nidulans FGSC A4
MKLLFRTLPQLPRQRWHSVRTLSTDVLEKPRDDKERVVILGSGWGGYTMSRKLSPKRFAPVVVSPRSYFVFTPLLTDTAGGDLDFSHIVEPVRDPKIRVDFIQAAARAIDLHRKTVLCEPTIVKSGVTLTHTEEDEVGSEPANIWEKSETFEIPYDKLVISVGAISRTFKTPGVKDNAIFFKDIGDSRRVRRRVRECFELATLPSTSPEMRKHLLHFAIVGAGPTGTELAAALRDFITSDLITLYPTLEGLPRISLYDVAPKVLSMFDESLSRYAQETMKKEGIEVQTSHHIQDLRWGAPGAEPPYQKDPRGCLTLTTKEEGQIGVGMCVWVTGNSMNELLRDSLRDVEVFPFNSAVMKDGTEVSKDASQGSWAYKKAPRSGALLVDGHLRVQLENDTGATAVLQDVFAIGDNAMLEGASPPATAQVTAQEAKWLATHLNQRDLQSSPPFSFRNMGTLAYIGNEKALMQLPNEERGYLPQKLTGRTAWLVWNSAFIYVFELQYFVLFFFEPMCFMRIIMLADAPNVMSGDLRRPRAGACVTCRSRKRRCIPTPNGDGCQLCHETAKPCSLKIVSRFERARNGGRYQSIGGNAPLNLPSNGCEAPEAPLGGLASRDIWVELVQLYFRFIHDIAHTIFHKPSFLCRLYNGTAPMIQVYAIFSSNPTFEGSAPCDRGKAFVAEAVRLCQPYMISPSLETAQAFLLIGYYFSGESNVDGKHIYVGLARLHAERLSLSDNLSAVYQEEYRRTWLSIHITSHWSAWDMAMEPLNLPNGSDFLPRIDDATFRTTNAALLNANHIQDEFRCDMWAQMARTIGIFAKVNNVLRRLSRNMISFDDYCVEAAELEASLDRWAESLSPMLTWSFENLMLLAGRRLGQLYLAMHVGFFHFKQMLFFPFLDARASKNPKPSGADKCKDSASVVSSILQYSKNIKDCELENFIYGHIGVVSSCVHLHTLLFSDDYRELSITRQRLVSNFQYLMALKSYWPIVEHFAIQLRTFQNSCRDSISDPFMLDNWMARFLTEHSSLLSERQLSQPAEPGGPLASDPKTSSGTATPEMLPTIESMTTYANGNHGSSITEDELSQWNDLSRLLHDQDITGEALVDSALTWLLDDRGNQVASI

SEQ ID NO: 13154 - protein, 232 aa, Bartonella sp. RP-io111
DSIDITDPHQRMIASVRLISKVPTLAVMAYKYSIGQAFVYPRNDLSYAANFLRMCFSVPCEDYKSNPVLARAMDQIFILHADHEQNASTSTVRLAGSSGANPFACIAAGVACLWGPAHGGANEACLKMLQEIGSIEKIPEFIARAKDKNDPFRLMGFGHRVYKNYDPRAKIMQKTCHEVLKELNIQDDPLLDIAIELEKIALNDEYFIEKKLYPNVDFYSGITLKALGFPTE

SEQ ID NO: 13155 - protein, 416 aa, Candidatus Rickettsia principis
DSEFAELKIRGKIFKLPILKASIGEDVIDISRVSVEADCFTYDPGFMSTASCQSTITYIGGDKGILRHRGYDIKDLAEKSDFLEVAYLLIYGELPSSEQYNNFTKQVAHHSLVHERLHYLFQTFCNSSHPMAMMLAAVGSLSAFYPDLLNFKDADYELTAIRMIAKIPTIATMSYKYSIGQPFIYPDNSLDFTENFLHMMFAMPCTKFKVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYNAMGIPTQMFTVLFAIARTVGWMAQWKEMHEDPEQKISRPRQLYTG

SEQ ID NO: 13156 - protein, 232 aa, Bartonella sp. RP-io114
DSIVITDPHQRMIASVRLISKVPTLAAMAYKYSIGQAFVYPRNDLSYAANFLRMRFSVPCEDYKSNPVLARAMDQIFILHADHEQNASTSTVRLAGSSGANPFACIAAGVACLWGPAHGGANEACLKMLQEIGSIEKIPEFIARAKDKNDPFRLMGFGHRVYKNYDPRAKIMQKTRHEVLKELNIQDDPLLDIAIELEKIALNDEYFIEKKLYPNVDFYSGITLKALGFPTE

SEQ ID NO: 13157 - protein, 416 aa, Candidatus Rickettsia principis
DSEFAELKIRGKIFKLPILKASIGEDVIDISRVSVEADCFTYDPGFMSTASCQSTITYIGGDKGILRHRGYDIKDLAEKSDFLEVAYLLIYGELPSSEQYNNFTKQVAHHSLVHERLHYLFQTFCNSSHPMAMMLAAVGSLSAFYPDLLNFKDADYELTAIRMIAKIPTIATMSYKYSIGQPFIYPDNSLDFTENFLHMMFAMPCTKYKVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYNAMGIPTQMFTVLFAIARTVGWMAQWKEMHEDPEQKISRPRQLYTG

SEQ ID NO: 13158 - protein, 780 aa, Alkaliphilus metalliredigenes QYMF
  misc_feature (54)..(54): Xaa can be any naturally occurring amino acid
MPGMMDTILNLGLNDASVIGMAAATKNERFAYDSYRRFIQMFGDVVLGIEKYKXDTLLEKRKLDKGIEQDTDLTTEDLQYLVEAFQKIVLRESKMSFPQDVRVQLLMSVEAVFKSWNNPRANVYRKLNDIPKSLGTAVNIQSMVFGNMGETSGTGVAFTRNPSTGEKLLYGEFLMNAQGEDVVAGIRTPRVIQELGDKMPEVYQEFVDVADLLEAHYKDMQDIEFTIENSKLYLLQTRNGKRTAAAAINIAVEMVGEGVLTKKEAIMRVKPSQLDQLLHPTFDEKALNVATLITKGLPASSGAATGQVYFNGEDVVRINSAGGKAILVRQETSPEDIEGMVASQGILTARGGMTSHAAVVARGMGKCCIAGAGEVRIDEGQKYFKVGNQRYEEGQWISLDGNIGNVYEGKVPTKEPKLIGNFGVLMEWADQFRQLKIRANADTPRDTRQAIKFGAEGIGLCRTEHMFFEGTRINTVRKMIVANNIKDRQRALDQLLPMQKADFIEIFKEMGDRPVTVRLLDPPLHEFLPHGDEDIKELAQALEMTYQSLKEVVSDLKEFNPMLGHRGCRLAVTYPEIYEMQVKAIIEAAIEVKEQHGYNIVPEIMIPLIGEIKELQYIKNVIIKVIDGVIEEKNADLKYLIGTMIEVPRAAITADEIAEEAEFFSFGTNDLTQMTYGFSRDDAGRFISEYREKNILDHDPFQRIDRRGVGRLMEIAVELGRKVKPELKIGICGEHGGDPDSIDLCQELGLDYVSCSPYRVPIARLAAAQSVIKNKDQSKE

SEQ ID NO: 13159 - protein, 605 aa, Zymomonas mobilis subsp. mobilis ZM4
MSLRNVAIIAHVDHGKTTLVDQLFRQSGTFRENQRIDERAMDSGDLEKERGITILAKCTSIEWNGKRINIVDTPGHADFGGEVERILSMVDGVILLVDAAEGPMPQTKFVTSKALALGLKPIVVVNKIDRPDARAAEVLDEVFDLFVTLGASDEQLDFPVLYASGRNGYAGESEEVREGTLAPLFEKIVSHVNAPKVDADAPFRFLVTLLDRDNFVGRILTGRIDAGKLSLNQPIHAIDMDGNILETGRASKIMAFRGLERVPVEEASAGDIISLAGLTVATVANTIADPSVKEPIAAQPIDPPTLSMRFSVNDSPLAGKEGTKVTSRMIRDRLMVEAESNVAIRVTESDEKDSFEVAGRGELQLGVLIETMRREGFELSISRPRVLFTEGENGREEPYETVVIDVDDEFSGTVVEKMSLRKAELVDMRPSGGGKTRITFSAPSRGLIGYHGEFLSDTRGTGIMNRLFEKYGPYKGPISGRQNGVLISLGTGASVAFALGSLEERGVLFIGAGETVYEGMIIGENAREGDLEVNPLRAKQLTNMRSSGKDDAIRLTPPRAMTLEQAIAYIADDELVEVTPKSVRLRKRWLDPNERKRHARASKNL

SEQ ID NO: 13160 - protein, 107 aa, Zea mays
TLGQASSDLPVPEPRNTTNPPACFAEEDGALVNSGRWLQWHWKGSEPPGEAKSDIEIMSLIFTRLRKMYQEEGGKYPDPIVNLSWPYSNPQSPTAEELAKEYSGKVQ

SEQ ID NO: 13161 - protein, 1529 aa, Saccharomyces cerevisiae
MSSDIRDVEERNSRSSSSSSSSNSAAQSIGQHPYRGFDSEAAERVHELARTLTSQSLLYTANSNNSSSSNHNAHNADSRSVFSTDMEGVNPVFTNPDTPGYNPKLDPNSDQFSSTAWVQNMANICTSDPDFYKPYSLGCVWKNLSASGDSADVSYQSTFANIVPKLLTKGLRLLKPSKEEDTFQILKPMDGCLNPGELLVVLGRPGSGCTTLLKSISSNSHGFKIAKDSIVSYNGLSSSDIRKHYRGEVVYNAESDIHLPHLTVYQTLFTVARMKTPQNRIKGVDREAYANHVTEVAMATYGLSHTRDTKVGNDLVRGVSGGERKRVSIAEVAICGARFQCWDNATRGLDSATALEFIRALKTQADIGKTAATVAIYQCSQDAYDLFDKVCVLDDGYQLYFGPAKDAKKYFQDMGYYCPPRQTTADFLTSITSPTERIISKEFIEKGTRVPQTPKDMAEYWLQSESYKNLIKDIDSTLEKNTDEARNIIRDAHHAKQAKRAPPSSPYVVNYGMQVKYLLIRNFWRMKQSASVTLWQVIGNSVMAFILGSMFYKVMKKNDTSTFYFRGAAMFFAILFNAFSCLLEIFSLYETRPITEKHRTYSLYHPSADAFASVLSEMPPKLITAVCFNIIFYFLVDFRRNGGVFFFYFLINVIATFTLSHLFRCVGSLTKTLQEAMVPASMLLLAISMYTGFAIPKTKILGWSIWIWYINPLAYLFESLMINEFHDRRFPCAQYIPAGPAYQNITGTQRVCSAVGAYPGNDYVLGDDFLKESYDYEHKHKWRGFGIGMAYVVFFFFVYLILCEYNEGAKQKGEMVVFLRSKIKQLKKEGKLQEKHRPGDIENNAGSSPDSATTEKKILDDSSEGSDSSSDNAGLGLSKSEAIFHWRDLCYDVPIKGGQRRILNNVDGWVKPGTLTALMGASGAGKTTLLDCLAERVTMGVITGNIFVDGRLRDESFPRSIGYCQQQDLHLKTATVRESLRFSAYLRQPSSVSIEEKNRYVEEVIKILEMQQYSDAVVGVAGEGLNVEQRKRLTIGVELAARPKLLVFLDEPTSGLDSQTAWDTCQLMRKLATHGQAILCTIHQPSAILMQQFDRLLFLQKGGQTVYFGDLGEGCKTMIDYFESKGAHKCPPDANPAEWMLEVVGAAPGSHATQDYNEVWRNSDEYKAVQEELDWMEKNLPGRSKEPTAEEHKPFAASLYYQFKMVTIRLFQQYWRSPDYLWSKFILTIFNQVFIGFTFFKADRSLQGLQNQMLSIFMYTVIFNPILQQYLPSFVQQRDLYEARERPSRTFSWLAFFLSQIIVEIPWNILAGTIAYCIYYYAVGFYANASAAGQLHERGALFWLFSIAFYVYIGSMGLLMISFNEVAETAAHMGTLLFTMALSFCGVMATPKVMPRFWIFMYRVSPLTYMIDALLALGVANVDVKCSNYEMVKFTPPSGTTCGDYMASYIKLAGTGYLSDPSATDICSFCAVSTTNAFLATFSSHYYRRWRNYGIFICYIAFDYIAATFLYWLSRVPKKNGKISEKPKK

SEQ ID NO: 13162 - protein, 516 aa, Triticum aestivum
MDLRRPRGHRAALASRPAARPAVVAAEAAGAGAPLPGPPRHAVPLPPRRRQRLRPADQGGVVGAADAAALPRRRPPRHAVPLQHHPGARRAVHLLVRAGPQGEHHRPCPGPGGDVQQARPRRREVQVPGLTRLLADGVGNYEGDRWAKHRRILNPAFHTEKLKLMLPAFAACCEELVGRWERSLGPDGSWEVDVCPELQSLTGDVISQTAFGSSYLEGRRIFQLQTEQIGRFMAAVSKIMIPGYMSFPTKNNRRMHQINNEIESILRGIIAKRMQAMQEGESTKDDLLGLLLESNMSDTDENGQSTLGMSADEVMEECKLFYFAGMETTSILLTWTMIVLSMHPEWQDRAREEVLGLFGKHKLEYEGVNRLKIVTMILYEVLRLYPPATVFTRKTYKKIEIGGITYPAGVMFEMPVLYIHHDTDIWGEDVHQFKPDRFAEGISKASKDPGAFFPFGWGPRICIGQNFALLEAKMALCMILQHFEFELAPSYTHTPHSVMMLRPMHGAPIRLHTISS

SEQ ID NO: 13163 - protein, 309 aa, Bordetella bronchiseptica RB50
MNQPSSLAADLRGAWHAQAQSHPLITLGLAASAAGVVLLLVAGIVNALTGENRVHVGYAVLGGAAGFAATALGALMALGLRAISARTQDAMLGFAAGMMLAASAFSLILPGLDAAGTIVGPGPAAAAVVALGLGLGVLLMLGLDYFTPHEHERTGHQGPEAARVNRVWLFVLTIILHNLPEGMAIGVSFATGDLRIGLPLTSAIAIQDVPEGLAVALALRAVGLPIGRAVLVAVASGLMEPLGALVGVGISSGFALAYPISMGLAAGAMIFVVSHEVIPETHRNGHETTATVGLMAGFALMMFLDTALG

SEQ ID NO: 13164 - protein, 411 aa, Glycine max
  misc_feature (156)..(156): Xaa can be any naturally occurring amino acid
SQCWCGRGLWDHSPAQTGIMDDLNVGVAEYSLFGSILTIGAMIGAIISGRIADYAGRRTVGWWLYVGRLFVGCGMGLLSYVVPIYIAEITPKNLRGGFTTVHQLMICCGVSLTYLVGAFLNWRILALLGIIPCIVQLLGLFSIPESPRWLAKFGHXKESDSALQRLRGKNADVYQEATEIRDHTEAFQKQTEASIIGLFQMQYLKSLTVGVGLMILQQFGGINGIVFYANSIFISSGFSESIGTIAIVAVKIPMTTIGVLLMDKSGRRPLLLVSAVGTCVGCFLAALSFILQDLHKWKGVSPILALVGVLVYVGSYSIGMGAIPWVIMSEIFPINVKGSAGSLVTLVSWLCSWIISYAFNFLMSWSSAGTFLMFSSICGFTVLFVAKLVPETKGRTLEEIQASLNSFSSKR

SEQ ID NO: 13165 - protein, 376 aa, Oceanospirillum sp. MED92
MSEQMIKSRAAIAWGPNQPLSIEEVDVMPPQAGEVLVRIVATGVCHTDAFTLSGEDPEGIFPAILGHEGGGIVEAVGEGVTSLQVGDHVIPLYTPECGECKFCKSGKTNLCQKIRETQGKGLMPDGTTRFYKDGEPIYHYMGCSTFSEYTVLPEISLARVNKEAPLEEVCLLGCGVTTGMGAVMNTAKVEEGATVAIFGLGGIGLSAVIGATMAKASRILAIDINDSKFELAKQLGATDCINPKEFDKPIQEVIVEMTDGGVDYSFECIGNVDVMRSALECCHKGWGESVIIGVAGAGQEISTRPFQLVTGRVWRGTAFGGVKGRSELPEIVERYMAGEFKLNDFITHTMGLDKINEAFDLMHEGKSIRSVIHYDR

SEQ ID NO: 13166 - protein, 202 aa, Brassica napus
MASSNTTPGVDNTFRKKFDTEEYRERARKREEKEADRSKSQPKGPPVQRAPLKHRDYHVDLESRLGKTQVVTPVAPLSQQAGYFCRVCDCVVKDSANYLDHINGKKHQRALGMSMRVERSSLEQVQERFEVLKKRKTPGTFSEQDLDERIRKQQEEEEEHKRQRREKKKEKKKGKVIEEEPEMDPEVAELMGFGGFGSSKKS

SEQ ID NO: 13167 - protein, 240 aa, Triticum aestivum
  misc_feature (93)..(93): Xaa can be any naturally occurring amino acid
PLFSPRGEFLPINLESWIQCFPQVRGKGLGVSRLAQEGKRRFFLKEKVYQQMRDSDLFRVVHELQYPKGLCGSGSSSNDEDSLPEIAATVCCXGAAFLSGNLVSRDGFCCRETCIKCIEANGDGLKTVISGTVVSKGNAQGVDLLLPTSSSKTSLCNSNLRSKIVKYPSSTDVLTVLLLVLQPNTWLGIKDENVKAEFQSLVSTDNLPDLLKQEILHLRRQLHYLAGCKGQEACQEPPSP

SEQ ID NO: 13168 - protein, 473 aa, Bacillus anthracis str. Ames
MMNQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTDTTEVDSL

SEQ ID NO: 13169 - protein, 457 aa, Zea mays
MPLGCHDVAPRAMPLFHHTMKEHGKTSITWFGPVPRVTITEPELVREVLSNKFGHYEKLKFGRLQRMLHNGLGSLEGEKWAKHRRIINPAFHLEKLKGMLPAFAACCTELVQRWEGLVADGQPCEVDVWPEMQNLTGDVISRAAFGSSYLEGRRIFQLQGEQVQLVVQAMHKLHIPGHLYLPTKTNRRMKQIASEVEELLKGIIAKRENALRSGSAAGDDDLLGLLLESNMEHCRGDGSDAARAGITTDDVIGECKLFYFAGMETTSVLLTWTMVVLSMHPDWQHRAREEVLHVLGPHDDGRRDYDALSRFRIVTMVLYEVLRLYTPLTALQRQTYKPMELGGVRYPAGVMLMLPLLCIHHDKDVWGPDASEFWPERFAEGVSKASRDAPAFFPFGWGPRTCVGQNFALLEAKMGLAMILQRFAFELSPAYTHAPFPHGMLQPEHGAQIVLRARGLP

SEQ ID NO: 13170 - protein, 206 aa, Xylella fastidiosa 9a5c
MCNEPATSDVALPDLDWAKGDGLLPVIVQDADTLRVLMLGYMNSQALEVTQRSRLVTFYSRSKQRLWTKGERSGHVLHLVAIDADCDADTLLVQARPRGPTCHLGRTSCFPAAPGQFLGALDALVAERERERPQDSYTTALFEQGVRRIAQKVGEEGVETALAGVVQVDDALLDESADLLYHLIVLLRARGLSLADAVTVLEARHR

SEQ ID NO: 13171 - protein, 102 aa, Brassica napus
KFRNAQFSWVTEDGKQERHVVATVGKFSVIWNFQQVKNGSHECYHDQEGLKKCYCYKIVLRNESIVDSRFMNDNFAVSGSPEAPLVIATPMKVSSFSLSSKR

SEQ ID NO: 13172 - protein, 309 aa, Bacillus anthracis str. Ames
MQCIETNNLQQLLEQVKPYTKKGKLATYIPELGNANPDDLGIAIFHKETEYIHAGNSQTLFTLQSISKVITLALALLDRGEEYVFSKVGMEPTGDPFNSIIKLETTSPSKPLNPMINAGALAITSMLAGKDNEEKMERILHFVREITDNPTINYSSKVANSELETAYLNRSLCYYMKQNGIIDCDIEELMDLYTRQCAVEVNCIDLARIGLIFAMDGYDPYKKKQIIPKHITKICKTFMVTCGMYNESGEFAIRVGIPAKSGVAGGIFGCVKGEMGIGIFGPALDANGNSIAGFKILELLSAQEGWSIF

SEQ ID NO: 13173 - protein, 232 aa, Bartonella sp. MN-tr4
DSIDITDPHQRMIASVRLISKVPTLAAMAYKYSIGQAFVYPRNDLSYAANFLRMCFSVPCEDYKSNPVLTRAMDQIFILHADHEQNASTSTVRLAGSSGANPFACIAAGVACLWGPAHGGANEACLKMLQEIGSIERIPEFIARAKDKNDPFRLMGFGHRVYKNYDPRAKIMQKTCHEVLKELNIQDDPLLDIAIELEKIGLNDEYFIEKKLYPNVDFYSGITLKALGFPTE

SEQ ID NO: 13174 - protein, 375 aa, Xylella fastidiosa 9a5c
MTPIVFIDRDGTLIEEPPDFQIDAYEKLRLVNGVIPALLKLRDAGYHFVIVTNQDGLGSPAYPQASFDGPNALMLQIFSSQGIVFRDVLIDRSWPTDNAPTRKPGIGLMVAYLQDRDIDWARSAMVGDRPTDLQFAENLNIRGFQLRTPQFGGDWDWDGIAHTLADAPRRAVVQRHTKETTIRVEIDLDGAPQARITTGLPFFDHMLEQIAKHAGISLQISAVGDLHIDEHHTIEDTGLALGQAVRQALGDKRGIGRYGFDPPQLPWQVSGAAAHGGFTLPMDETQASAVLDFSGRPYCVFEGTFVRERVGDMPTELVPHFFRSLCDASGMNLHLSVHGDNDHHKVEACFKALARALRQALQRHGHVLPSTKGAL

SEQ ID NO: 13175 - protein, 115 aa, Alkaliphilus metalliredigenes QYMF
MIGEIKELQYIKDVIIKVIDGVIEEKNADLKYLIGTMIEVPRAAITADEIAVELGRKVKPELKIGICGEHGGDPNSIDLCQELGLDYVSCSPYRVPIARLAAAQSIIKNKDQSKK

SEQ ID NO: 13176 - protein, 146 aa, Oryza sativa
RVDEYGNPVGTGVGHGQMGTAGMGTHGTTGGMGTHGTTGGMGTHGTTGTGGGQFQPMREEHKTGGVLQRSGSSSSSSSEDDGMGGRRKKGIKEKIKEKLPGGAYGQQGHGTGMTTGTTGAHGTTTTDTGEKKGIMDKIKEKLPGQH

SEQ ID NO: 13177 - protein, 380 aa, Vitis vinifera
MSGTAGQVICCKAAVAWEAGKPLVIEEVEVAPPQAMEVRLKILYTSLCHTDVYFWEAKGQTPLFPRIFGHEAGGIVESVGEGVTDLKPGDHVLPIFTGECKDCAHCKSEESNLCDLLRINTDRGVMIHDGKSRFTIKGKPIYHFLGTSTFSEYTVVHVGCVAKINPLAPLDKVCVLSCGISTGLGATLNVAKPTKGSTVAVFGLGAVGLAAAEGARIAGASRIIGVDLNPKRYEGAKKFGVTDFVNPKDHEKSVQEVIVEMTGGGVDRSLECTGNVNAMISAFECVHDGWGVAVIVGVPNKDDVFKTHPINLLNERTLKGTFFGNYKPRSDIPAVVEKYMNKELEVEKFITHSVPFSEINKAFEYMLKGEGLRCIIHMEP

SEQ ID NO: 13178 - protein, 380 aa, Vitis vinifera
MSSTAGQVIRCKAAVAWEAGKPLVIEEVEVAPPQVMEVRLKILFTSLCHTDVYFWEAKGQTPLFPRIFGHEAGGIVESVGEGVTDLQPGDHVLPVFTGECKECRHCKSEESNMCDLLRINTDRGVMLSDNKSRFSINGKPVYHFVGTSTFSEYTVIHVGCVAKINPAAPLDKVCVLSCGISTGLGATLNVAKPSKGSSIAIFGLGAVGLAAAEGARIAGAARIIGIDLNPKRFNDAKKFGVTEFLNPKDHDKPIQEVIAEMTDGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 13179 - protein, 382 aa, Vitis vinifera
MSNTAGQVIKCKAAVSWEAGKPLVIEEVELAPPQANEVRIKILFTSLCHTDVYFWEAKGQKPAFPRIFGHEAAGVVESVGEGVTDLKPGDTVLPVFTGECKECRHCKSEESNMCDLLRINTDRTVMLSDGKSRFSAKGKPIYHFLGTSTFSEYTVAHVGSVAKINPAAPLDKVCVLSCGISTGLGAAINVAKPKKGSSVAVFGLGAVGLAAAEGARISGASRIIGVDLNASRFEQAKKFGVTEFVNPKDHDKPVQEVIAEMTDGGVDRSIECTGSVAAMISAFECVHDGWGVAVLVGVPNRDDSFKTHPINLLNERTLKGTFFGNFKPRTDLPRLVEKYVNKELDLQLEKFITHEVSFSDINKAFDYMLKGEGLRCIIRMGA

SEQ ID NO: 13180 - protein, 523 aa, Oryza sativa (japonica cultivar-group)
MLMMLGAASQWILAAAAAAAVAALLWLAVSTLEWAWWTPRRLERALRAQGIRGNRYRLFTGDVPENVRLNREARKKPLPLGCHDIIPRVLPMFSKAVEEHGKPSFTWFGPTPRVMISDPESIREVMSNKFGHYGKPKPTRLGKLLASGVVSYEGEKWAKHRRILNPAFHHEKIKRMLPVFSNCCTEMVTRWENSMSIEGMSEVDVWPEFQNLTGDVISKTAFGSSYEEGRRIFQLQAESAERIIQAFRTIFIPGYWFLPTKNNRRLREIEREVSKLLRGIIGKRERAIKNGETSNGDLLGLLVESNMRESNGKAELGMTTDEIIEECKLFYFAGMETTSVLLTWTLIVLSMHPEWQERAREEVLHHFGRTTPDYDSLSRLKIVTMILYEVLRLYPPVVFLTRRTYKEMELGGIKYPAEVTLMLPILFIHHDPDIWGKDAGEFNPGRFADGISNATKYQTSFFPFGWGPRICIGQNFALLEAKMAICTILQRFSFELSPSYIHAPFTVITLHPQHGAQIKLKKI

SEQ ID NO: 13181 - protein, 487 aa, Nocardia farcinica IFM 10152
MTDREGALLATAPHQLFIGGEWVDATGGATFAVHDPATGEIVREVADATAEDAVRALDAAVAAQESWAATAPRTRGEILRRAWELVQERAEDLALLMTLEMGKPLAEARGEVTYGGEFLRWFSEEAVRIHGRYGLNPEGTGQMIVSQRPVGPCYFITPWNFPFAMATRKIAPALAAGCTVVVKPPQLTPLTTLFFTGLLAEAGLPAGVVNVVTSTSSRRVSAPIIADSRLRKLSFTGSTEVGRQLIAQAADNVLRVSMELGGNAPFVVFEDADLDKAVEGALAAKFRNIGQACTAANRFIVHEQVAEEFAARVTERVAAMKIGRGTEDGVTIGPLIDDDAVAKAHELVTDATARGAVVRTGGERIDGPGSFYRPTVLTGVTEGSAILREEIFGPVLAIATFTTEDEAVRLANNTEYGLVSYVYTRDLARGHRMIDKLETGMMGLNAGVVSNAAAPFGGVKQSGVGREGGFEGIHEFLSTKYTLIPTS

SEQ ID NO: 13182 - protein, 273 aa, Streptomyces antibioticus
MNQPWPATRADRPNICREGARMSLGADTVAIVTGAGRGIGAATAQRLAAEGATVAVVDRTEADTADTVASIRAAGGRALGIGCDVTVTDLVEAAVDRTVAEFGRLDVLVNNAGVTRDSLVFMMGDEDWDTVIDVHLNGAARTVRAARRQMVRQGSGRIVNLSSIAALGNQGQANYATAKAAIQGYTRTLAVELGPHGITVNAIAPGFIATTMTDDTARRMGSDPVALRKAVASRVPMRRVGRPEDIAGLVAFLAGPDASYLTGQTIYVDGGPQ

SEQ ID NO: 13183 - protein, 500 aa, Nocardia farcinica IFM 10152
MADSAGHHVPAELPDRIRHYIDGAFVDSVDGDTFDVLDPVTNETYVQAAAGKKADIDRAVAAARKAFTEGPWPKLLPRERSRVLHRIADLVESRDARLAELESFDSGLPITQALGQARRAAENFRFFADLIVAQSDDTYKVPGRQINYVNRKPIGVAGLITPWNTPFMLESWKLAPALATGNTVVLKPAEFTPLSASLWAGIFEEAGLPQGVFNLVNGLGEEAGDALVKHPEVPLISFTGESRTGQIIFANAAPHLKGLSMELGGKSPAVVFADADLDAAIDATIFGVFSLNGERCTAGSRILVQREIYDEFVERYAAQAERVKVGYPHDPATEVGALVHPEHYAKVTEYIEIGKSEARLVAGGDRPAEFPTGNFVRPTVFADVKPDARIFQEEIFGPVVAITPFDTEEEALELANGVKYGLAAYIWTNDLKRAHNFSQAVEAGMVWLNSNNVRDLRTPFGGVKASGLGHEGGYRSIDFYTDQQAVHITLGKVHNPTFGK

SEQ ID NO: 13184 - protein, 261 aa, Emericella nidulans
MGHEDAVYLAKLAEQAERYEEMVENMKVVAASDVELTVEERNLLSVAYKNVIGARRASWRIVTSIEQKEESKGNKSQVALIKEYRQKIEGELAKICQDILDVLDQHLIKSAQSGESKVFYHKMKGDYHRYLAEFAVGDNRKAAADASLEAYKSATEVAQTDLAPTHPIRLGLALNFSVFYYEILNSPDQACHLAKLAFDDAIAELDTLSEESYKDSTLIMQLLRDNLTLWTSSEAEPAAENAPAEKKEEAPAAEGEEKPAE

SEQ ID NO: 13185 - protein, 118 aa, Zea mays
MSQLARASLTAMAMLLLLAAAAAAAGPAAGGAAVADPAGCQDDVVALNEACYKYVQKGAPTVPPSQECCDAVKSVDVPCVCSYLGSPGVRDNISMEKVFYVSQQCGVSIPGNCGGSKV

SEQ ID NO: 13186 - protein, 521 aa, Bdellovibrio bacteriovorus HD100
MGTSAELKGPNLSKGVDLSELREDKSLLGYVGEEPVILVRHDEEYFAIGATCSHYGGPLADGLVVGETVHCPWHHACFDLRTGEALKAPALNPVSAYNVEVRGSKVFVTSKKESTVRPREWSESQRYVIVGSGAAGTAAAIMLRKQGFIGSITIVSEDKSLPYDRPNLSKDYLAGNIPEDWVPLETEEFYQTHKIHFELSTKAEKVDAHRRSVFLSNGKTLRYDRLLLATGGEPIHPPIPGIKQDHVFYLRTLQDCQRIIGRTSWAQKVVIVGAGFIGLEVAAALRQRNLEVHVVAPEEMPLLKVVGVHVGSVLHKLHEEHGVIFHLGHTIKEIRQRSVLLDDGHSVDCDFVIVGTGIHPNTQLAEQAGCWVENGVLVNEYLETSVPGIFAAGDIARWPDPHSQRSIRVEHWEVAERQGQTAALNMMGDRIKFQDVPFFWTQHYDLSLGYVGHSDRFDRMDVMGDLNSRDFAVAYYEDQKVAAVLTLGRDRESLLVEEAIGQYDEKKIHEIFHQHERDHHP

SEQ ID NO: 13187 - protein, 422 aa, Legionella pneumophila str. Paris
MHIHKIQAREILDSRGNPTIEADVILTTGIIGRASVPSGASTGSREACELRDNDPKRYAGKGVQKAVKHVNNEINQALQGLSVEDQENLDRILCQLDNTENKSHLGANAILATSLACARARALSLNQPLYITLNQGDMMTMPVPMMNILNGGAHADNNVDIQEFMIMPIGAPDFPVALQMGTEIFHVLKSVLKKQGLNTAVGDEGGFAPNIQSNRQALDLLSEAIEKAGFRLGEDIVFALDVAASELFNEGFYHMYSENQKFDSHQLIEYYANLISSYPIVSIEDGLDEKDWSGWKQLTTHLGNKVQLVGDDLFVTNPKILREGIAQGIANAILIKVNQIGTLSETRQAIKLAYDNGYRCVMSHRSGETEDTFIADLAVASGCGQIKTGSLCRTDRTAKYNQLLRINELASLPYAGKNILKR

SEQ ID NO: 13188 - protein, 349 aa, Clostridium thermocellum ATCC 27405
MNVKALFLAGGLGTRLRPITNDLPKPMVPIMGKPLLERNIEKLKSYGIDEVVLSTCYKPHKIDKYFGDGKKFGVKISYITEDKPLGTAGAIKNAEELLSDTFLVFNADILSDIDIANMIRFHKEKGALATIAVTKVDNPSAYGVIEHDDDNFITAFKEKPQPHESKSNLINAGVYIFEKELLNHIPRGRAVSIERETYPLLLEKGYKMAVYNKCGYWLDLGTPGKYLKVHKDILKGLVPIGNYDFGQNRTYISKSAKIDRSAKIRGPVYIGENVVIGPSAVIGPNAVLFDDAVVGMGAKVVDSVVWDNVNVERGATVVNSVIMSNCRVDEDSEKYNSVLTENFSEPIAV

SEQ ID NO: 13189 - protein, 511 aa, Burkholderia sp. 383
MSAIPKSDPSGSSANPPKLHRALKARHLTMIAIGGSIGTGLFVASGASISQAGPGGAMVAYMAIGLMVYFLMTSLGEMAAFMPVSGSFATYGAKYVDEGFGFALGWNYWYNWAVTIAVELVAAQLVMHYWFPDVPGVWWSAAFLGVMFLLNALTVRGFGEAEYWFALIKVVTVVAFIGVGLLMIFGILKGAPSNGWGNLTIGDAPFAGGLPALMGVAMIAGFSFQGTELIGVAAGESENPRTTIPRAVRQVFWRILLFYVFAIFVIGVLIPYTDPNLLKTDVTDIGVSPFTLVFRHAGLAFAAGVMNAVILTAVLSAGNSGMYASTRMLYNLATEGRAPKIFAKLSRGGVPRNALYATTAVGALCFFTSLYGDKTVYLWLLNTSGMTGFIAWLGIAVSHYRFRKGYVKQGYSLDQLPYQSKWFPFGPLFAFVLCLVIALGQDYQAFLANRIDWAGVAATYVGIPLFLVVWLGFRFLKKSRLVRYEDMEIAPWIAAGRGAQQQPVANRETAG

SEQ ID NO: 13190 - protein, 232 aa, Bartonella sp. TL-sv4
DSIDITDPHQRMIASVRLISKVPTLAAMAYKYSIGQAFVYPRNDLSYAANFLRMCFSVPCEEYKVNPVLARAMDQIFILHADHEQNASTSTVRLAGSSGANPFACIAAGVACLWGPAHGGANEACLKMLQEIGSIERIPEFIARAKDKNDPFRLMGFGHRVYKNYDPRAKIMQKTCHEVLKELNIQDDPLLDIAIELEKIALSDEYFIEKKLYPNVDFYSGITLKALGFPTE

SEQ ID NO: 13191 - protein, 112 aa, Spinacia oleracea
MEAIVGKVTEVNKDTFWPIVKAAGDKPVVLDMFTQWCGPCKAMAPKYEKLAEEYLDVIFLKLDCNQENKTLAKELGIRVVPTFKILKENSVVGEVTGAKYDKLLEAIQAARS

SEQ ID NO: 13192 - protein, 476 aa, Marinobacter sp. ELB17
MDTTKFYINGKWVTPEGTQTIDVINPSDETRFAKITLGSEADTNMAVSAAKSAFPAWSMSTREQRIDLLERLLETYSARAEEMAQTISKEMGAPINLARTAQVGAGATHLKNTIRALKTFNFEHALGDHAPENRIMHEPVGVCALITPWNWPMNQIMLKVPAAIAAGCTVVLKPSEISPLSAMLLAEMIDSTGFPDGVFNLVNGDGEGVGSQLSKHPDIDLVSFTGSTRAGKAITIAAADTVKRVGLELGGKGANIIFADSDEKAITRGVRHCFANSGQSCNAPTRMLVEKSLYKQAVETAALVASQTDVGPADVDGRQIGPVVSEQQFQKIQALIKKGIAEGATLVSGGEGRPEGLNKGYFVRPTVFADVTREMTIWSEEIFGPVLAITPFETEEEAVKLANDTHYGLTNYIQTSDKEKAHRLARQLRSGMIEINGKSGSSGFPFGGMKQSGNGSREGGVWGLEEFLEVKSVTDW

SEQ ID NO: 13193 - protein, 385 aa, Bacillus licheniformis ATCC 14580
MSHLFQTYSRWNINIKKAKGTIVQDEKGNAYLDFVQGIAVCNLGHCPDSVTAALKKQLDDVWHVSNLFQNELQEKVAQLLAKNSAGDLVFFCNSGAEANEGAVKLARKHTKKTKIVTFQQSFHGRTYAGMAATGQEKIKHGFGPMLEGFHYLPYNEPKAFAELQDEKDIAAVMLEPIQGEGGVIPASREFLQSVQDFCRDKQALLIIDEVQTGIGRTGKAFGYEHEGLSPDIVTVAKGLGSGFPVGAVIGKKELSEAFSPGSHGTTFGGNMLAMAAANATLETIFDRSFLEEVSAKGAFLHQQLKDKLQFPLVKDIRGKGLIAGIECKEPVQPLIEALQKEGLLVLPAGPNVIRLLPPLTVAKSEIKAAVEKLKDVMANHSAVKQ

SEQ ID NO: 13194 - protein, 428 aa, Desulfovibrio desulfuricans G20
MTGSTGNSRTRVVVAGGGFAGVWAVRRLARDKNLDIILVDRNNYHTFLPLLYQVAAAELEPGQIAYPLRAIFRKYPNVHFVIGDVRSIDMKNKVLHTDGPHIPFDKLVVAMGSFTAFYGVPGADKHCFRLKNLEQAITLRNHIVSCFEQATHERNPDRKDRILTYTVVGGGPTGVEYAGALAELIRQPLTKDFPTLNTGQARVVLLEAGDGLLAGFPDHLRRYAFERLTHMGVDVRLNAKVTAVTPDSVELEGSSPLRTETVVWTAGVQGHALAGQMGLPTGRGGRVPVLPTLQVEGHPDVFVAGDMALPQGDSPAPLIAPNAIQQGALAADNIRAALAGRPLRAFRYRDKGSMATIGRAAAVVRMGKEHTATGFVAWVMWLFIHLLYLVGFRNRLFVLFTWAWDYIFFERAARIIIPRGPIEDDDAP

SEQ ID NO: 13195 - protein, 349 aa, Oceanospirillum sp. MED92
MNTVLFDHPEFDGHVNIFAHFDEKTGLKAMSAVHRSWNGKPAVGGCRLRNYASADEAFTDLLRLSKGMTYKSVLAGLDYGGSKSVMIANPETMDRRDTFLAMGDFVESLGGKISTGVDVGLTAADVEVMGERTSYLGGRGALAPDLVTAYGVLTSILAAVRHRKGNDDLTGMHVAVQGLGKVGYKLVELLLERGAKVVAAEVNEDSVARARDNYSIDIVDPSVIHAQDVDIYSPCALGMVINDQSINEISAGIVAGAANNQLTLPGHGVSLAKKGVLYVPDYISNCGGLLAVANDLEKSDESWVWDKVAEIAGTLDEVFTLADREGIATSDAADQIGAARIAAFDKQQG

SEQ ID NO: 13196 - protein, 527 aa, Burkholderia thailandensis E264
MNKHWIRVSPIALAAAIGLTACGGDDVTSPGLSAVENVVVIYAENRSFDNLYGNFPGANGLQNVTAASAPQVDRDGTPLATLPKIWTGLTAAGVTPAVTEAMTANLPNAPFAIDDPNGFNTPMSVTTRDLVHRFYENQMQIDGGKNDKYAAWTDAGGLVMGHYTADPSKLPLWKLAQQYTLADNFFMGAFGGSFLNHQYLICACAPFYPNADKSPAASQISVVNPDGVTLTTASNSPASALSGPPKFVKSGGLTPDFYAVNTMQPPYQPSGNAAATGGDPNLADPSNPSTLPPQTQQNIGDLLTSAGVSWAWYAGAWGAALQAAQRGTSGVIYGPNMTSPNFQPHHQPFNYYANQAPGSTNRAQHLLDAGSNGAALIQAIDAGKLPQVTFYKPQGNLNEHPGYTDVASGDQHIADVIAHLQKSSQWNNMVVIVTYDENGGFWDHVAPPKGDRWGPGTRIPAFVISPFAKRGFVDHTQYDTASILRFITRRFSLPKLAGLKQRDDALVANGFKPMGDLTNALTLSTGN

SEQ ID NO: 13197 - protein, 352 aa, Arabidopsis thaliana
MAALLGRSCRKLSFPSLTHGARRVSTETGKPLNLYSAINQALHIALDTDPRSYVFGEDVGFGGVFRCTTGLAERFGKNRVFNTPLCEQGIVGFGIGLAAMGNRAIVEIQFADYIYPAFDQIVNEAAKFRYRSGNQFNCGGLTIRAPYGAVGHGGHYHSQSPEAFFCHVPGIKVVIPRSPREAKGLLLSCIRDPNPVVFFEPKWLYRQAVEEVPEHDYMIPLSEAEVIREGNDITLVGWGAQLTVMEQACLDAEKEGISCELIDLKTLLPWDKETVEASVKKTGRLLISHEAPVTGGFGAEISATILERCFLKLEAPVSRVCGLDTPFPLVFEPFYMPTKNKILDAIKSTVNY

SEQ ID NO: 13198 - protein, 388 aa, Bacillus anthracis str. Ames
MIKNPKVLILTAHYGNGHVQVAKTLEQTFRQKGIKDVIVCDLFGESHPVITDITKYLYLKSYTIGKELYRLFYYGVEKIYDKKIASWYANFGRKRLKLLLQAEKPDIVINTFPIIAVPELKKQTGISIPVYNVLTDFCVHKIWIHREVDRYFVATDHVKKVMVDIGVPAEQIVETGIPIRSSFELKINPDIIYNKYQLCKNKKILLIVAGAHGVLGSVKELCQSFMSVPDLQVVVVCGKNEALKQDLVGVQETNPDALKVFGYVENIDELFRVTSCMITKPGGITLSEAAALQVPVILYKPVPGQENENAMYFERKGAAVVIRDDSEVFAKTEALLQDDMKLLQMKEAMKSIYRPEPADHIVDTILAENHVEPNHIPIKSPALAQSFT

SEQ ID NO: 13199 - protein, 430 aa, Coxiella burnetii RSA 493
MNTRATTAILVNQVVQKKCSLTALLSANKKNQSLIQELCYGTLRWYFKLKLIAEKLLHAPLRDKDHDIFCLILTGFYQLNYLNIPTHTIVNQTVGAAEILKKPWAKGLINKLLRRFIAEKDELLTFTEKTIEGQYAHPLWFIQHIKKAWPDHWESILIANNARPPMTLRVNLTKISREIYLEMLDQKNISAKPLDFLPAAIQLEKPCSVHQLPGFNEGYCYIQDAAGQFAAYLLKLENNQTVLDACAAPGSKTSHILEVNPHLKTLVAIDNNKQRLNRIKENITRLGLRQEHLQCLLADVSQIDQWSSGELFDRILLDAPCSATGVIRRHPDIKLLRQPGDISQYHQKKLQLLNALWTVLKAGGFLLYSTCSVLPDENEKVIEEFLSTHDKVELSPTNVHGGLQLKYGVQQLPGQDNKDGFYYSLLFKNP

SEQ ID NO: 13200 - protein, 232 aa, Bartonella sp. TL-sv2
DSIDITDPHQRMIASVRLISKIPTLAAMAYKYSIGQAFVYPRNDLSYAANFLRMCFAVPCEEYETNPVLARAMDKIFILHADHEQNASTSTVRLAGSSGANPFACIAAGVACLWGPTHGGANEACLKMLQEIGSTKRIPEFIARAKDKNDPFRLMGFGHRVYKNYDPRAKIMQKTCHEVLKELNIQDDPLLDIAIELEKIALSDEYFIEKKLYPNVDFYSGITLKALGFPTE

SEQ ID NO: 13201 - protein, 364 aa, Arabidopsis thaliana
MSDLSPDLVGEILTRVPMTSLISVRCTCKMWNALSKEGIFFKAARKQFMGFTMMDSRVCSMKFDLQGIRNNEHDFVDPCIKQIAKLDQIEVSKVLQCDGLLLCVGQTRFIKPRKRFNKLEWYALGYDNNHNYKILMNYDTGHLFGYEIYDFSSDSWRVLDVSPDCHIPFHQQSVSLNGNTYFLAQEKIIVEGEEEEVVDEIEKFLLCFDFTTERFGPRLPLPFHSDVLETVAISCVRDDQLAVLYQRFETWEIWVTTKIDPTAVSWSMFLSVDMEPPTGCQFDDEAGSFFIDEENKVAVFFNSDLFNPRVENRNRRYPTAYIIGQDGYFKSATLREAPDLVKPDPYVYCCPLVWSSYAPSLVQL

SEQ ID NO: 13202 - protein, 335 aa, Coprinopsis cinerea okayama7#130
MEAQNANSLVKTIDFGDFLEGNDSKRVASEILESFKSIGFVCLTNHGLQQEKVDKMFEWSKRFFSLPMETKQLAPHPPSGTHHRGTRGYSAPGVERISQHVYDEAELEALRLKGQDVKESFEAGREDDPLMPNIWLPDGVLPGFKEACLEFYWACYELEKSILRAMAVAFSLPEDYFIQFHKVADNQVRLLHYPSIPNAHLASEAFSRIGAHSDFGTITLLFQDEVGGLEVEDPHNPNTFLPIPVIPNSVVVNAGDFMARWSNDVIKSTIHRVRSPPGSDINGEAPERYSIPYFCCCDLATVVDAVPGTWDETNPKKYKPISAKEYILKRLAALY

SEQ ID NO: 13203 - protein, 410 aa, Blumeria graminis
MSDMQGRKVFKVFNQDFVVDERYNVTKELGQGAYGIVCAATNISTQEGVAIKKVTNVFSKKILAKRALREIKLLQHFRGHRNITCLYDMDIPRPENFNETYLYEELMECDLAAIIRSGQPLTDAHFQSFIYQILCGLKYVHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHVLGTPNEETLARIGSPRAQEYVRNLPFMAKRPFAQIFPNANPDALDLLNRMLAFDPASRISVEEALEHPFLQIWHDVSDEPCCPTTFNFDFEVTDDVGEMRKMILDEVARFRHHVRVQPGMQSPSNDPSVPTLQTSVAWGSEDPRPQENNDQEITGLERDLTVGLDR

SEQ ID NO: 13204 - protein, 498 aa, Zymomonas mobilis subsp. mobilis ZM4
MIFGRVKPLDAILETAKKKSLHRSLGAFQLTMLGIGAIIGTGIFVLTAEAAQKAGPGMMLSFIIAACVCGVAAFCYAEMAAMVPVSGSAYTYSYAVMGELVAWMVGWALILEYAVAASAVSVGWSGYVVGLIEHLTGSHLPASVLVFTKGPFNGGIINLPAAFIALLIMSLLIRGTKESATASAILVVIKITALSLFIFLAIPAMKMENFHPFAPLGFSGISAAAASIFFAYVGFDAVSTAAEETKDPQRNMPIGLVGSLAICTLFYMLVSAGVIGGVGAQPVFDAAHQHALPAGSSEMAAACSTLKDSHVVCSNEALAWSLRKIGWNKVGNLIALAAGFALPSVILMMIFGQTRIFFVMSRDGLLPGFFAKVHPRFKTPYIVTVMTGLAVATFSAFFPVGILADISNAGTLFAFAMVAIAVLVLRHTDPKRHRPFKTPCVYLIAPLAALGCLYLFVSLPLMTLKMFFGWTVVGLVVYFLYGYRHSNIARNISDDEEA

SEQ ID NO: 13205 - protein, 125 aa, Zymomonas mobilis subsp. mobilis ZM4
MTVDIHQPYDDNNIFARIIRGEIPCKKVFENDQVLAFHDINPQAPVHILVIPKGRYVSWDDFSEKASDTEIAALTRAVGQISRDPALNNGYRLIVNCGHDADQLVPHLHIHILSGKELGAKLIQS

SEQ ID NO: 13206 - protein, 371 aa, Zea mays
MESVLKMSRRTFDYICSLVKKDLTTKTYGFRNFRFGDKKVLGVEDQVAVALMRLTTGESLQNIGMWFGMNHSAISNITWRFIESVEERAICHLKWPSPEEMATIKTRFDKVYGLPNCCGAIDTTHILMCSSAQPNSKVWLDNENKNSMVLQAVVDADLRFRDVVSGWPGSMDDTCILRTSGLYRLCEKGLRLGGQMELPGGSAVREYLVGDASYPLLPWLMTPYREHGLQAAKVEFNKRHTAAAAVVQTALATLKGRWRVIQGELWRPDKHRLPRIIFVCCLITNIIIDMEGTPSRDELVSGNHDLGYKQQFSDAADDNAIKQRDDLSRHVDNAIKRRDRSVSPCHRRRVNTHRHPLLFAPINIKNMDTKL

SEQ ID NO: 13207 - protein, 130 aa, Glycine max
  misc_feature (61)..(61): Xaa can be any naturally occurring amino acid
MSSEKEAALAAVLDDSPTIFDKIIKKEIPSTVVYEDEKVLAFRDINPQAPTHILIIPKVKXDGLTGLAKAEERHIEILGYLLYVAKVVAKQEGLEDGYRVVINDGPSGCQSVYHIHVHLLGGRQMNWPPG

SEQ ID NO: 13208 - protein, 365 aa, Yersinia pseudotuberculosis IP 32953
MNMTKTYHIAVLPGDGIGPEVMAQASKVLDAVRQRFGLKISTSVYDVGGAAIDRHGSPLPAATVAGCEQADAILFGSVGGPKWEHLPPAEQPERGALLPLRKHFKLFSNLRPARLYQGLEDFCPLRSDIAARGFDILCVRELTGGIYFGQPKGREGQGMHERAFDTEVYHRFEIERIARIAFESARKRRSKVTSIDKANVLQSSILWREVVNGIAADYPDVALSHMYIDNATMQLIKDPSQFDVLLCSNLFGDILSDECAMITGSMGMLPSASLNEQGFGLYEPAGGSAPDIAGKNIANPIAQILSLILLLRFSLGKDDAADAIERAINQALEQGYRTADLAGDGHAIGTHEMGDIIAKFVVEGV

SEQ ID NO: 13209 - protein, 1029 aa, Bacillus licheniformis ATCC 14580
MPKDQTIKSILVIGSGPIIIGQAAEFDYSGTQGCMALKSEGYRVILVNSNPATIMTDESFADEIYFEPLTVESLTQIIKREKPDGLLANLGGQTALNLAVELEKAGILKAYGVKLLGTSVDTIEKGEDREKFRALMKELNEPVPDSEIVDNQDDALRFALSIGFPIIVRPAYTLGGKGGGIAATKEEFLPLIESALLASPIHQCLVEKSIAGFKEIEYEVMRDSNNTCITVCNMENIDPVGVHTGDSIVVAPSQTLTDADYQMLRSASLKIISALDVVGGCNIQFALDPESKNYYVIEVNPRVSRSSALASKATGYPIAKMAAKLAVGYTLAELKNPLTDSTYASFEPALDYVVVKFPRWPFDKFKQADRKLGTKMKATGEVMAIDRNLEAALQKAVASLELKTSGTHLPELGGVSSEVLWKLLETPDDRRFFAVMELLSRGTSISEIHEKTKIDDYFLHVFSNIIQLENTLMEQGDSLSVSLLKKVKEKGFTDFTIASLTGKTEEEVRALRKKMGIAASFKIVDTCAAEFDAKTNYFYSTYFGKSDGDISQKTKKRALIIGSGPIRIGQGVEFDYSAVHGVMTLKSLGFETIMLNNNPETVSTDYEMADRLYFEPITPEHILNVAEAEDIDFAIVQFGGQSAINVAQAIEKAGITLLGTSSETLDILEDRDQFYQLLDELGISHAKGETASSKAEAVKKANEIGYPVLIRPSYVIGGMGMMIVHSEAELRELLGGASQMPYPILIDQYVSGKEFEIDLVSDGGDLYIPTYIEHIEKAGVHSGDSYAILPGPSVTPEMKSAARDAAAKIVRKLGFKGIMNIQFIADSDELLILEVNPRASRTVPVVSKVMGVPMIPLAAKLLAGSSLKELKPAAKNSRGVAVKFPVFSSHAIQDVDLKLGPEMKSTGEGMYVGFNPESALKKIFAGIWQTKGCIYMEGAGELRSLAEQAGFTVQSDDFPGWIKRKDKALHIHLAESKEARKQRIEAVTHGVAVMTEEETVRAFLTSGHGTTKAVSLKDLYKKEVETCLL

SEQ ID NO: 13210 - protein, 206 aa, Zymomonas mobilis subsp. mobilis ZM4
MKARVGYSDFMQRIASIHRQTAETDVHIHLNLDGHGQYNVKTGIGFFDHMLDQLFRHSLIDCDVTVKGDLHIDPHHTIEDCALALGQAVQQALGDKAGITRFSHAYAPMDEALSRVAIDISGRPYLVWHSAFTQPRLGDLDTEMLEHWFLSFAQGAGLTLHVETLYGRNNHHIAESLFKALALALRQAVAIDAGKQGRIPSTKGSL

SEQ ID NO: 13211 - protein, 124 aa, Spinacia oleracea
MYYLELALGTQEMEAIVGKVTEVNKDTFWPIVKAAGDKPVVLDMFTQWCGPCKAMAPKYEKLAEEYLDVIFLKLDCNQENKTLAKELGIRVVPTFKILKENSVVGEVTGAKYDKLLEAIQAARS

SEQ ID NO: 13212 - protein, 476 aa, Campylobacter upsaliensis RM3195
MGKFVNNIEEFFTYCKENEVVFVDFRFTDIIGTWHHITYNFHSINEETFELGIPFDGSSLKGWQPVNKSDMILKPDAPSAFLDPFTADQTIIVFCDVYDIYKGQMYEKCPRSIAKKALQFLQESGVADMAYFGPENEFFIFDSVKIVDNANCSKYEVDTEEGEWNDNKEFVDSYNTGHRPRNKGGYFPVAPIDSLVDIRAEMVQTLEKVGIKTFVHHHEVAQGQAEIGVHFGTLVEAADNVQIYKYIVKMVAHLNGKTATFMPKPLYGDNGSGMHVHMSLWKNGVNLFYDKEGYGELSQDAIHYIGGILKNARSVAAFTNPSSNSYKRIVPGFEAPCILTYSCQNRSASCRIPYGMGKNSARVEIRFPDSTANPYLAFVSLLMAGLDGIKNKHIPVGPMEENLFDLTLDEVREKGIEQLPHTLRGSLEALIRYNSFLKPVMSDLFIDDYQHLKFATQVWPVEARPTAYEFKTCYSC

SEQ ID NO: 13213 - protein, 181 aa, Saccharomyces cerevisiae
MSISESYAKEIKTAFRQFTDFPIEGEQFEDFLPIIGNPTLFQKLVHTFKTHLEEKFGKEKIDFIAGIEARGLLFGPSLALALGVGFVPIRRVGKLPGECASITFTKLDHEEIFEMQVEAIPFDSNVVVVDDVLATGGTAYAAGDLIRQVGAHILEYDFVLVLDSLHGEEKLSAPIFSILHS

SEQ ID NO: 13214 - protein, 183 aa, Halobacterium sp. NRC-1
MTHILVVDNHGQFTHLEHRLLRDMDGVTVDLTDNTTPPADIDADGLVLSGGPTMADIGHCREYLTLDVPILGVCLGHQLIADELGGRIEAGDYGGYADVTVSISDADDPLVGSLAPDTRVWASHADEVVAVPDGFTITAESDICGVEAMGDTDRDLYGVQWHPEVAHTEEGEAVFENFVAICE

SEQ ID NO: 13215 - protein, 744 aa, Shewanella oneidensis MR-1
MLNTLRDITQAVASAHSLETALEVLVSSTKAAMETQCCSVYILEQQELVLSATDGLEKSAVGRVRMPLTQGLVGLAAEREEAVNLADARLHPRFKLFPEVAEEEYRAFLAVPIIYQKAVVGVIVVQQASARQFSEGEEAFLMTLAAQLAMAIRGLKQKAQVSSLHQQILFQGTSASSGIAIAHAFVLGGEISLEQPDIRCEDIVLESNRLVAAMGRCKEAIGALSQRFDREQDEEVASIFNALQLLLDDASLGGEYAREVLLGWEAESAVSRVSLRYIQQFLAMEDPYLKERASDIRDLGQKVLRQLIEPERLELEPDKPVILVTKEADATMLAEFPRQKLAGIVTELGGVNSHAAILARALGVPAITGVEQLLSADIDQKLLVVNASRGQLMVSPSPAIVSEYRSLISAQKALQRQYAQELTLPSVMLDGKRIRLYLNAGLLSGVASEIAEGADGIGLYRTEIPFMLQQRFPSESEQVKVYQQVLSAASGRPVVMRTLDVGGDKPLPYFPIKEDNPFLGWRGIRLSLDHPELFLVQLRAMLQAGAEGKQLSILLPMVSNLDEIDQALAYLEQAHVELKNDVNSNIKMPRIGIMLEVPAMLYQLDEVAKRVDFVSVGSNDLTQYLLAVDRNNPRVSSLFDSYHPGILRALHQARLDCEYHHLDISICGELAGEPMGAILLVAMGYHQLSMNQGSLARINYLLRRVSGEDLAQLLAQALSLSNGFQVRELVKEYLTLQGLVTILN

SEQ ID NO: 13216 - protein, 421 aa, Oryza sativa (japonica cultivar-group)
MQERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFSTVEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 13217 - protein, 67 aa, Oryza sativa
MSLGYAEKLSYREDVGNVGMPEIFDSPELLHKKIEELAVMVRESKHLVVFTGAGISTSSGIPDFRGP

SEQ ID NO: 13218 - protein, 106 aa, Glycine max
MGRKKGYVEFEESPPDDFDPANPYKDPVAMLEMREHIVREKWIQIEKAKIIREKLRWCYRIEGVNHLQKCRHLVNQYLESTRGIGWGKDGRHPSLHAPKVDPVESE

SEQ ID NO: 13219 - protein, 206 aa, Mycobacterium smegmatis str. MC2 155
MSALANRRARVERKTKESEIVVDLDLDGTGVVDIDTGVPFFDHMLTSLGSHASFDLTVHAKGDIEIEGHHTVEDTAIVLGQALGQALGDKKGIRRFGDAFIPMDESLAHAAVDVSGRPYFVHTGEPESMVSFTIAGTGAPYHTVINRHVFESLAFNARIALHVRTLYGRDPHHITEAQYKAVARALRQAVEYDARVTGVPSTKGTL

SEQ ID NO: 13220 - protein, 434 aa, Bacillus anthracis str. Ames
MVVKFTKSEALHKEALEHIVGGVNSPSRSFKAVGGGAPIAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAAKHNIDITLNRLKGALTVYFTTNTIEDYDAAQDTDGEMFGKFFKLMLQEGVNLAPSKYEAWFLTTEHTKEDIEYTIEAVGRAFAALADNK

SEQ ID NO: 13221 - protein, 320 aa, Arabidopsis thaliana
MDRQPERENDELPSPAIISDRVLVNGVVTPLTLTAEGELRSTESGRRKSTLAKEILSFVVEGNKVRVKTLVEKGGGICCRGSAGDYARNDFVFEPLSDESRKLWSDKFHQHLVSLGRPKKLLVFVNPFGGKKTARKIFQEEVKPLFEDANIQLEIQETKYQLHAKEIVRSMDVSKYDGIVCVSGDGILVEVVNGLLEREDWKTAIKLPIGMVPAGSGNGMIKSLLEPVGLPCSATSATISIIRGRTRSLDVATISQGTTKFFSVLMLAWGLVADIDIESEKFRWMGSSEDNMLKTIPWTNSICASSWVRKLWATSQLQYR

SEQ ID NO: 13222 - protein, 200 aa, Zea mays
MPYTAPRPSPQQHSRVLSGGGAKAASHGASCAAVPAEVARHHEHAARAGQCCSAVVQAIAAPVGAVWSVVRRFDRPQAYKHFIRSCRLVGGGDVAVGSVREVRVVSGLPATSSRERLEILDDERRVLSFRVVGGEHRLANYRSVTTVHEAGAGAGTGTVVVESYVVDVPHGNTADETRVFVDTIVRCNLQSLARTAERLA

SEQ ID NO: 13223 - protein, 485 aa, Arabidopsis thaliana
MDRQPERENDELPSPAIISDRVLVNGVVTPLTLTAEGELRSTESGRRKSTLAKEILSFVVEGNKVRVKTLVEKGGGICCRGSAGDYARNDFVFEPLSDESRKLWSDKFHQHLVSLGRPKKLLVFVNPFGGKKTARKIFQEEVKPLFEDANIQLEIQETKYQLHAKEIVRSMDVSKYDGIVCVSGDGILVEVVNGLLEREDWKTAIKLPIGMVPAGSGNGMIKSLLEPVGLPCSATSATISIIRGRTRSLDVATISQGTTKFFSVLMLAWGLVADIDIESEKFRWMGSARFDIYGLQRIICLRQYHGRILFVPAPGFESYGQRASCSIDKEPSGSDKTLVYQGPDSKLENLDWREMKGPFVSVWLHNVPWGAENTLAAPDAKFSDGFLDLIVMKDCPKLALLSLMTKLSDGTHVQSPYASYLKVKAFVLEPGARIDEPDKEGIIDSDGEVLARGRKSYKCDQKALMSYDKLQISVDQGLATLFSPE

SEQ ID NO: 13224 - protein, 489 aa, Marinobacter sp. ELB17
MSHSIPRLQNFIHGHFFANHTGEVFPVVNPATGKVIYEVEIADESVQQAAIESARAGFIEWAAMPAVQRSRILLKAVALLRERNDELAAIEVLDTGKPLQEAQAVDIVTGADSIEFFAGLAPSIEGNQQDLGGDFYYTRREPLGICAGIGAWNYPLQIACWKSAPALACGNAMIFKPSEETPMGATKLAQIYIEAGVPAGVFNVVQGAAEVGSWLTHHSEIAKVSFTGEVGTGKKVMAAAATTVKSVTMELGGKSPLIIFDDADLENAISAAMVGNFYTQGEICTNGTRVFVHEDIYPKFMERLLERTRNNILPGDPMNPKTNFGALISDKHRKLVLSYIAKGVAEGATLRHGGHAFEPEDSKGGYFVEPTIFTDCTDDMAIVREEIFGPVMSVLTFTTENEVIDRANATETGLAAGVFTNDIRRAHRVVHQMQAGICWINSYGASPAEMPVGGYKLSGIGRENGRETISHYTQLKAVYVGMEDIDAPF

SEQ ID NO: 13225 - protein, 310 aa, Arabidopsis thaliana
MTEEFEIAGISTGAWWSSPTNTAAVFSGYSLPCSTEISPDVTNFGWQNFDNKINDHNDGCMNMHNSFFEGLLIDPNDQLLPDPWSKSTIPNAKSELLENFPFLDNMFLVDSEAESLLDHEIRNHKSSKEQITQDYKNLTSKARNKHKNLTIFVRSEELEENSDEYSPRLLKRPRLETLSPLPSFKVRKEKLGDRITALQQLVSPFGKTDTASVLNEAVEYIKFLQEQVTVLSNPEQNTIGSVQQQQRPLRLPSCTQGEVEEDECSPRRYVDLSSRGLCLMPISASYPVAAAAASAAEMNVHLVSGIFHSL

SEQ ID NO: 13226 - protein, 311 aa, Zea mays
  misc_feature (144)..(144): Xaa can be any naturally occurring amino acid
  misc_feature (176)..(207): Xaa can be any naturally occurring amino acid
MAQGINFPDFIGAVGGHDGGVDRIRGRVDMAFYQKLGEGTNMSVDSLNSMQTSMHGGSIAMSVDNNSSVGSNSDSRTGMLGHPGLKGPAIVGSYSVGHSIFRPGRVSHALSEDALAHALMDNKFPTETLKDYEEWTIDLGKLHXGMPFAQGAFGKLYRGTYNGMDVAIKLLERPEXXXXXXXXXXXXXXXXXXXXXXXXXXXXXXXXGACRKPLVWCIVTEYAKGGSLKNFLSKRQNRSVPLKLAVKQALDVARGMAYVHGLGFIHRDLKSDNLLISGDKSIKIADFGVARIEVKTEGMTPETGTYRWMAP

SEQ ID NO: 13227 - protein, 520 aa, Medicago truncatula
MEASLAIYYGIILITVTLGLVYTWRVLNWIWLKPKRLEKLLREQGCNGNSYRLVLGDLKDSYKMGKKAKSKPMELSDDIIPRVIPYIQQLVQIYGKNPFIWSGTTPRLILTEPELIKDVLNRTSELQKPKYEIFKFLFSGLIIHEGEKWRKHRRLMNAAFQLEKLKIMAPSFLTSCIDMISKWESTLSSDGSGEIDIWPSLQNLTSDVISRNAFGSSYEEGKRIFDLQREQGELVMKNLVKSLIPLWRFIPTATQRRMHEIEKDIDSSLRYIINKREKAMKAGEATENDLLGLLLESNHQEIRDHGNNKNMGMSLEDVVGECKLFYLAGQESTSTMLVWTMILLSRYPDWQERAREEVLQIFGNKKPDYEGLNKLKILPMILYEVLRLYPPAFGVTRYVGKDIKFGNMEVPAGVEVFLPIILLQHNNELWGDDAKMFNPERFAEGISKATNGRFIYFPFGGGPRVCMGQNFSLLEAKMAVSMILQNFYFELSPTYAHTPNLVMTIQPEKGAHVILRKVKA

SEQ ID NO: 13228 - protein, 555 aa, Frankia sp. EAN1pec
MAAENRRRAASIRGTRRLIPSPPHADGPSPARCLLDAGRGGGRAVGQRGLNHPRDFQSATVVPPTVAPPTAVPPPPSATVVPPTVGPPTAVPAPPATVVPPTVGPPTAVPPPPAPPATVVPPTVGPPTAVPAPPATVVPPTVGPPTAVPPPPAPPATVVPPTVGPPTAVPAPPATVVPPTVGPPTAVPPPPAPPATVVPPTVGPPTAVPAPPATVVPPTVGPPTAVPAPPATVVPPTVGPPTAVPAPPATVVPPTVGPPTAMPPIPMPLPRPATVVPPTVGPPTATPRPLATVVPPTVGPPTAMPPIPMPLPRPATVVPPTVGPPTATPRPLATVVPPTVGPPTAVPAPPATVVPPTVGPPTAVPPPPPATVVPPTVGPPTAVPPPPPATVVPPTVGPPTAVPPPPPATVVPPTVGPPTAVPPPPPATVVPPTVGPPTAVPPPPPATVVPPTVGPPTAVPAPPATVVPPTVGPPTAVPPPPAPPATVVPPTVGPPTAVPAPPATVVPPTVGPPTAVPPPPAPSATVVPPTVGPPTAVPPPSATVVPPTVGPPTAV

SEQ ID NO: 13229 - protein, 347 aa, Prosthecochloris aestuarii DSM 271
MTISAMRDLSMTPATENGLRRKPILRKIGVFTSGGDAPGMNAAIRAVTRAAIANKLKVTGIRRGYQGMIEGDFIPLRSSDVSGIIQLGGTILRTARSKEFRTPEGREKAWQQLQNAGIDAVVVIGGDGSFTGALTMSQEYNISFVGIPGTIDNDIYGTDYTIGYETALNSVVCAVDKIRDTAVSHGRIFMVEVMGREAGLLALNSGIACGAEVILIPESKEQHDALKRFLDKGYKRKERSGIVIVAEGDEPGGALKLAENVRCEHPELDVRVSILGHIQRGGSPTANDRINATRMGVAAVDALLDDQKSIMIGIDNGRIVQVPFNKAVKLNHSFDRELLEIQKMLNI

SEQ ID NO: 13230 - protein, 520 aa, Medicago truncatula
MELSWETKSAIILITVTFGLVYAWRVLNWMWLKPKKIEKLLREQGLQGNPYRLLLGDAKDYFVMQKKVQSKPMNLSDDIAPRVAPYIHHAVQTHGKKSFIWFGMKPWVILNEPEQIREVFNKMSEFPKVQYKFMKLITRGLVKLEGEKWSKHRRIINPAFHMEKLKIMTPTFLKSCNDLISNWEKMLSSNGSCEMDVWPSLQSLTSDVIARSSFGSSYEEGRKVFQLQIEQGELIMKNLMKSLIPLWRFLPTADHRKINENEKQIETTLKNIINKREKAIKAGEATENDLLGLLLESNHREIKEHGNVKNMGLSLEEVVGECRLFHVAGQETTSDLLVWTMVLLSRYPDWQERARKEVLEIFGNEKPDFDGLNKLKIMAMILYEVLRLYPPVTGVARKVENDIKLGDLTLYAGMEVYMPIVLIHHDCELWGDDAKIFNPERFSGGISKATNGRFSYFPFGAGPRICIGQNFSLLEAKMAMALILKNFSFELSQTYAHAPSVVLSVQPQHGAHVILRKIKT

SEQ ID NO: 13231 - protein, 340 aa, Prosthecochloris aestuarii DSM 271
MDSQTLSSVAKAIVAPGKGVLAADESTPTIRKRFDSIQVESTEENRQQYREILFTAQNIERSIGGVILFDETLRQSAKDGTPFPTLLSKRGIVPGIKVDKGAKALALYAGEKITEGLDGLRERLLEYKELGAQFAKWRAVIGIDERDIPSPFGIRANAHALARYAALCQELDIVPIVEPEVLMDGSHDIERCEVVTSQVLEAVFAELDAHHVLFEGMLLKPNMVIAGMQCSRQAGVEEVAEATMRCMTRYVPAAVPGIVFLSGGQSAEKATAHLNAMNATGPYPWEVSFSYGRALQAPVLAAWKGEENNAFAAQHALSKRCRLNGLARDGAYAQEMEQEA

SEQ ID NO: 13232 - protein, 518 aa, Medicago truncatula
MATTTTIILFTLMTLSLIWAWRILNWLWLKPKKLEKLLREQGLKGNSYRLLVGDMNDLLKMRKEATSKPMNLSDDIVPRVYSFVHQSVTKHGKNSFIWFGPTPRVNITDPDQIKDVLNKIYDFQKPNANPLVRLLANGLVSLEGEQWSKHRKIINPAFHLEKLKIMLPIFHKSCDDLISKWEKMLSSDGSCEMDVWPFLQNFASDVISRAAFGSSYEEGKRIFQLQTEQAELTTKIMMKVYIPGWRFLPTATPRRMKEIDRDIKASLTDMINNRERALKAGEATKDDLLGILLESNHKEMEEHGNNKDVGMSLDDVIEECKLFYFAGQETTSVLLVWTMVLLSRYPDWQARAREEVLQVFGNNKPDFDGLSHLKIVTMILYEVLRLYPPVIALARRVHKDVKLGNLALPAGVQVFLSIIMVHHDIELWGEDAKVFNPERFSEGVLKATNGRNSFFPFAGGPRICIGQNFSMLEAKMAIAMILQRFSFELSPSYAHAPATVITLQPQYGAHIILHKLEL

SEQ ID NO: 13233 - protein, 297 aa, Burkholderia thailandensis E264
MDLVVRSPRLPQPGETLAGRSFAQAAGGKGGNQAVAAARLGAQVAMLGRVGSDAHGAALRAGLVAEGIDCGALSVSTTATTGVALIVVDDASQNAIVIVAGSNGEVTPEAIAEHDAAIAAADVLICQLETPGDAVRAALAAGRRLGKTVVLNPAPAVGPLPADWLPLVDYLIPNEIEAAALTGSPVRDPASAEAAARALAAAGARNVIVTLGGQGAVALTADGVARHYPAPRVTPVDTTAAGDTFIGGFAARLAAGDTPHDAIRFAQRAAALSVTRAGAQPSIPTLAELDAFAPDPA

SEQ ID NO: 13234 - protein, 977 aa, Oryza sativa
  misc_feature (302)..(302): Xaa can be any naturally occurring amino acid
  misc_feature (392)..(392): Xaa can be any naturally occurring amino acid
MLQPRESDVPVLFVVFIVLPVIAYFLLGRWHDAVSKKARVSVLAQRAAEETFKVETMATPDVILPGPSLRPMPYMRSAPSARPEYHECATCHGPAKTRCSRCKSVRYCSGKCQIIHWRQGHKQTCQQWNGFGTSSSGGLPPTENTEQMPFLSNLNSPLRGSDVHLHDMDFDTMSEPSFVTTDSYNLDTSPFLSDRSNMNKPNQFLHTSENGAAIGSYEKNDYSIDGEVPSSEILSGNKGLNNSSGSGENCGNRDVIYPLNSVVHQPNNYAPEIRKRPKASITVYESDKGVYLTSDMISSGEXGPYASAAESLQRSNSSGNVTGKGNMIHKKPPYPSGKVSSSQKSQEKVLTSHQYDGHEKNPHNKNEQRSTKTAVSTNSSLQGCNGISKAGXASKVEALKKPSKFLKTSLVGLINDNKRSKVLFPYEDLVKFFQYEVRGISPRGLFNCGNSCYANAVLQCLMCTKPLMIYLLLRLHSKDCCSKNWCLMCELEQYASTLRESGGPVSPSRILSNLRNIGCRLGGGSQEDAHEFLRHLVMSMQGACLDGLGGEKQVEASLQETTLIQQMFGGRLKSKVKCLRCYHESERYENIMDLTLEIHGWVESLQDALTQFTAPEDLDGENMYKCGRCSAYVKARKQLSVHEVPNILTVVLKRFQTGKYGKINKCVTFPDMLDMVPFVTGAGDNPPLYFLYAVVVHVDTENASFSGHYISYVKDMQGTWLRIDDSEVQAVSLNQVMSEGAYMLFYMRSFPRPPKIYIEKGLSSVPTCSKRHSSKSSKGSKQDLNHTESLFASSDQTYGIYDFRPDNGYIQDQHAALRTRNFYHTDDAFADSISTDFSDATSSEWSLFTSSDESSFTTESTRDSFSVVDYGDNAGLDPISSIFGPYYAQDHPPGSFASCTRLSPSNPQTRYFQENTGFVSDSSMPAHLPGNVHRGRYPDRACSSSAEPPASANPRSVYGRYGLSREGFVQTSGFCQM

SEQ ID NO: 13235 - protein, 172 aa, Narcissus pseudonarcissus
QAEFGFAAHWRYKEGDSQHSSFVLQMVEWARWVVTWQCETMNADRPMSFGDADLLRRSCPFPSHYNECPYSSTPWCDHSGPIYIILLENEKMSVQELAPNSTVMDLLERVGRGSPRWSHYNFPLKEELRPRLNHEPVNDPKQKLSMGDVVQLTPSIPDESLTGVSGGNPTGC

SEQ ID NO: 13236 - protein, 203 aa, Triticum aestivum
QAIYLHIPALPPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESAPPSPAHSRQAIYKVPLQFCQL

SEQ ID NO: 13237 - protein, 578 aa, Oryza sativa
  misc_feature (356)..(356): Xaa can be any naturally occurring amino acid
MELSSLAALLHSPLLLAVLLLVFSWLIVSSTKKRPPPPCGDGGRRLPLPPSPPGVPLLGHLPLLGTLPHRKLRSMAEAHGPVMLLRLGRVPAVVASSAAAAEEVMRTRDLAFASRPRVRMSERLFYGRDMAFAPYGEFWRQARRVTVLHLLSPRRVLSFRGVREQEVAALLDRVRRRCGGGGETVNLSDLLMSYAHGVISRAAFGHGGAHGFDGDEGGEKLRKLFADFEGLLGTMTVGEFVPWLAWVDKLTGLDAKVARTSAAMDGLLERVIADHRERRRSRGQAVGDGEADADHRDFVDVMLDVSEAEEGAGAGAGGVLFDTVAIKAVILSKKVPRVTCMNERFIEQDMMAAGTXSSFTTTEWVMAELINHPRVMRKLQDEIRAVVGTSSASAAAAATGGGQVTEDHLGELPFLRAVIKEMLRLHAPGPLLLPRETVEDTELLGYRIPARTRVIINVWAIGRDAAAWGDSAEEFVPERWLDGGGGGGVEYAQQLGKDSRFVPFGAGRRGCPGAGFAALSVELALANLLYHFDWELPPPAASGIMATTRLDMDELFGLSVRLKADLNLVAKPWSPGAS

SEQ ID NO: 13238 - protein, 502 aa, Arabidopsis thaliana
MTVLWFVSLILLISILLVAVKHSKRRWVRQPPSPPGLPIIGNLHQLGELPHQSLCKLSKKYGPVMLLKLGRVPTVIVSTPGTAKQVLKDYDLHCCSRPSLEGTRKLSYNYLDIAFSRFDDYWKELRKLCVEELFCNKRINSIQPIKEAEMEKLIDSIAESASQKTLVNLSDTFLSLNVNVICKAVFGVNFQGTVLNNDKFQDLVHEALEMLGSFSASDFFPYVGWIVDWFTGLHARRERSVRDLDAFYEQMIDLHLQKNREESEDDFVDLLLRLEKEEAVLGYGKLTRNHIKAILMNILLGGINTSAITMTWAMAELIRNPRVMKKVQSEIRAQIGKNNKTRIISLDEINHLSYLNMVIKETCRLHPVAPLLVPREVISEFKINGYTIQPKTRLHVNVWAIGRDPEIWKDPEEFLPERFMDCDIDVKGQDYELLPFGSGRRICPAVYMGITTVEFGLANLLYHFDWKLPEGVAVEDIYMDEASGLTSHKKHDLLLVPVKSLV

SEQ ID NO: 13239 - protein, 408 aa, Kluyvera ascorbata
MADSSPERRFTRIDRLPPYVFNITAELKMAARRRGEDIIDFSMGNPDGATPPHIVEKLCTVAQRPDTHGYSTSRGIPRLRRAISRWYQERYDVEIDPEDEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVNALARIKSYHDYGTFTPLQVAAIAALEGDQQCVHDIAAQYKRRRDVLVKGLHEAGWMVDMPKASMYVWAKIPEQYAHMGSLEFAKKMLQDAKVCVSPGIGFGDYGDTHVRFALIENRDRIRQAIRGIKAMFRADGLLPSEHKSAG

SEQ ID NO: 13240 - protein, 344 aa, Calystegia sepium
MEVMAAHNNGFTNHQNGTTTNHQNGTTTNHHNGTANHQNGNGTAHEDGGKDFGCIKPGWFSEFSQMWPGEAFSLKIEKLLFQGKSDYQDVMLFESATYGKVLTLDRAIQHTENGGFPYTEMIVHLPLGSIPNPKKVLIIGGGIGFTLMEVSRYPTIEKIDIVEIDKMVVDVSRQFFPYLGAGFEDPRVTLHIGDGAAFVKDAQKGYYDAVIVDSSDPIGPAKDLFEMPFFEAVAKALRPGGVVCTQAESIWLHMHFIKQIIASCRQVFKGSVNYAWTTVPTYPSGVIGYMLCSTEGPDVDFKNPVNPIDKDTSHVKSKGPLKFYNAEIHKAAFTLPSFVQKLLE

SEQ ID NO: 13241 - protein, 340 aa, Datura innoxia
MEVISTQTNGSAIIMNYSHHNGNSDHRNGGATAHDHDNGRKLLGNSNSIKPGWFSEFSALWPGEAFSLKIEKLLFQGKSDYQDVMLFESATYGKVLTLDGAIQHTENGGFPYTEMIVHLPLGSIPKPKKVLIIGGGIGFTLFEVLRYSTVEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNPIDKDETHANSKLGPLKFYNTDIHKAAFILPSFARSMIES

SEQ ID NO: 13242 - protein, 315 aa, Glycine max
RSAMMLDCTIASRLDMERRIGSQLDVATLDDILIPSFRHAGDTLFDVDTVHRILVNFCQQDDSEEEPEDASVFESDSPISPSQTALVKVSKLMDNYLAEIAPDANLKLSKFMVIAETLPAHARTIHDGLYRAIDIYLKAHQGLTDLDKKKLCKLIDFQKLSQEAGAHAAQNERLPVQSIVQVLYFEQLRLRNSLSCSYGEDDPKPIHQSWRISSGALSAAMSPRDNYASLRRENRELKLELARLRMRLNDLEREHVCMKRDMAKSGSRKFMSSFSKKIGKLSLFGHNSSRGSSSPSRNSQRTDSKVIERTCASTE

SEQ ID NO: 13243 - protein, 132 aa, Arabidopsis thaliana
MSGSLAFHIIMSVTFMVFFFGGLCEARGVNVDLINDIGPNVQLGLHCKSKNKDLGSQSLVSDQHWGFRASLGFWTVTLFFCHFEWENQSKWFDIFVEDRDLTCGDHCVWSIRPSGPCRLTGREKCFPWNNKY

SEQ ID NO: 13244 - protein, 524 aa, Medicago truncatula
MEVFVFPTGTTIIICVLSVLLAVLPWHLFNNFWLKPKRLEKLLKGQGLQGEPYNLSVLKDKSKQNYMLKLQQEDKSKSIGLSKEVAPSIFSTLHEAVHKYGKNSFLWDGATPSVIITDPDQIKEIFNRMEDFPKSKFRSISKYFGVGIAHQEGEKWAKHRKIVNPAFHIEKLKGMLPAFSHSCNEMISKWKGLLSSDGTCELDVWPFLQNLTCDVISRTAFGSSYAEGAKIFQLLKKQGFILMTAPRTNIPLWRLLPTTAERRMKEIERDIRDSLEGIIEKREEALKNGEATNDDLLGILLQSNHAEKQGHGNSKNIGMTTHDVIDECKLFYLAGQETTSSLLVWTMVLLGRYPEWQERARQEVLQVFGNQNPNSEGLSQLKTVTMILYEVLRLYPPVIYFNRAVQKDLKLGKLLLPTGTNVALPIVLIHHDQDLWGDDAKEFKPERFAEGIAKATKGQVSYFPFGWGPRICLGQNFTLLEAKIAISLLLQNFSFELSPNYAHLPTMVLTLMPKNGAIIILHKL

SEQ ID NO: 13245 - protein, 341 aa, Datura innoxia
MEVISTQTNGSAIIMNYSHHNGNSDHRNGGATAHDHDNGRKLLGNSNSIKPGWFSEFSALWPGEAFSLKIENLLFQGKSDYQDVMLFESATYGKVLTLDGAIQHTENGGFPYTEMIVHLPLGSIPKPKKVLIIGGGIGFTLFEVLRYPTVEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNAIDKLDETHVNSKLGPLKFYNTDIHKSAFILPSFAKNLTES

SEQ ID NO: 13246 - protein, 334 aa, Oryza sativa
MARGAGDRAPSPGIAREIERNRPGSRGKGGDRAGAGWRGKGILIGYGGEGIGRAAGGEQQHLSNRVVGLVNLVTLVASVPIIGAGLWLQAHGGSSPCGSALQAPLLAIGFVTLLVSLAGFLGACYHVPSALWLYLAAMLLLVLALLGITVFGLAVTAGGGGTQVAGRPYREFRLADYSSWLQRHVRAERYWRPALACVLAARACDTLAAWTPLDYLRNDLTPVQSGCCKPPTACTYYDDAQQQQQQPDCYRWSNAPGVLCYGCDSCKAGVLEQLRRHWHNVTILNVVLLLLLILFYSCACCAFRNTATATSSKTIFHLHPRWEYRWSRWWHGRR

SEQ ID NO: 13247 - protein, 227 aa, Magnaporthe grisea
MASPRWAALARDTNETKVKLALSIDGGDLPPDTHPSLLEAAASGHASQSSSSQKISINTGIGFLDHMLHAFAKHAGFSLLLTCQGDLHIDDHHTAEDVCIALGDAFKTALGSAAGIARFGFAYCPLDEALSRAVVDVSNRPFAVVELGLRREKIGDLSCEMIPHCIMSFATAARLTIHVDCIRGENDHHRAESAFKALAVAVRTAVGKVAGREGEVPAQGYAERLGE

SEQ ID NO: 13248 - protein, 205 aa, Xanthophyllomyces dendrorhous
MSAGLPIRTATVTRNTNETQIVCSISLDHTPGVDQQIIDIQTGIGFLNHMLHAMAKHGNMSLTLHCKGDLEIDDHHTAEDCALALGEAFKLALGERRGIRRYGTGFAPLDEALSRAVLDISSRPYFCGDLPFTREKIGDLSTEMIPHVFESFATAAGVTLHVDCIRGVNNHHIAEASFKALALAIREAITRTGGNDVPSTKGVLL

SEQ ID NO: 13249 - protein, 445 aa, Campylobacter upsaliensis RM3195
MKLFGTDGVRGKAGEFLDSFLAMRLAMAAGIYFKNKAITNNILVGKDTRKSGYMIENAIVSGLTSIGYNVIQIGPMPTPAIAFLTEDMRCDAGIMISASHNAYYDNGIKFFDSHGNKLSEEIEEKIEQIYFDDKLLESSKVTMGQIGRAKRIDDVIGRYIVSIKNSFPKDLTLKSLRVVLDVAHGAAYKVAPTIFKELGAEVIVMSDKPNGLNINDNCGALHPTNLAEEVKKLRADVGFAFDGDADRLVVVDEKGVVANGDSLLGVLALHLKEQGKLKSKVVATIMSNGALREFLSKNSIELETCNVGDKFVLEKLKACGGNFGGEQSGHIIFSDYAKTGDGLIAALQFSALMLSKRKSASAVLGQIKPYPQLLHNLKISQKKDLAKLKGLKELKAELDKKGINSLFRYSGTENLIRLLLEAKDSKLLEKEMGGVEAFFRKALND

SEQ ID NO: 13250 - protein, 364 aa, Arabidopsis thaliana
MSALKNYGLISIDSALHFPRSNQLQSYKRNAKWVSPIAAVVPNFHLPMRSLEDKNRTNTDDIRSLRVITAIKTPYLPDGRFDLQAYDDLVNTQIENGAEGVIVGGTTGEGQLMSWDEHIMLIGHTVNCFGGRIKVIGNTGSNSTREAIHATEQGFAMGMHGALHINPYYGKTSIEGMNAHFQTVLHMGPTIIYNVPGRTCQDIPPQVIFKLSQNPNMAGVKECVGNNRVEEYTEKGIVVWSGNDDQCHDSRWDHGATGVISVTSNLVPGLMRKLMFEGRNSALNEKLLPLMDWLFQEPNPIGVNTALAQLGVARPVFRLPYVPLPLSKRIEFVKLVKEIGREHFVGDRDVQVLDDDDFILIGRY

SEQ ID NO: 13251 - protein, 352 aa, Triticum aestivum
  misc_feature (192)..(192): Xaa can be any naturally occurring amino acid
  misc_feature (306)..(306): Xaa can be any naturally occurring amino acid
MAASKQWTRVRTLGRGASGAEVFLAADDASGELFAVKSATAACASALKREEGLMACLHSPCVVSCLGGRSARDGSYHLFLEFAPGGSLADRVASNGGLDERAVRGYAADVAAGLAYLHGAGMVHGDVKARNVVIGADGRAKLADFGCARKVGAGVPIIGGTPAFMAPEVARGEEQGPAADVWALGCTVVEMXTGRAPWSGMDGHALAALHRIGYTEAVPELPQWLSAEARDFLGGCLVRQASDRCTAAQLLEHPFLASAGGHAKPKATESSWCRPRHPEGGFWESESKPGRGSTKPGPKRNKALAXPASGLPEVDPKGGWMGLLSGPTGAPKQGPVRPRSHRIYAGEVFKGK

SEQ ID NO: 13252 - protein, 489 aa, Spinacia oleracea
EDNHSTVEDDAANYDFDLFVIGAGSGGVRAARFSANLGAKVGICELPFHPISSEVIGGVGGTCVIRGCVPKKILVYGASFGGELEDAKNYGWELNEKIDFNWKKLLQKKTDEIIRLNNIYKRLLSNAGVKLYEGEGKIVGPNEVQVTQLDGTKLSYSAKHILIATGSRAQRPNIPGQELAITSDEALSLEEFPKRVVILGGGYISVEFASIWRGMGADVNLCFRKELPLRGFDDEMRAAVARNLEGRGVNVHPRTTLTELVKTDGGVVARTDHGEEIEADVVLFATGRSPNTKRLNLEALGVELDRTGAVKVDEYSRTSVPSIWAIGDVTNRMNLTPVALMEGTCFAKTVFGGQNSKPDYSNIACAVFSIPPLAVVGLSEEQAIEQASGDILVFTSSFNPMKNTISGRQEKTIMKLVVDAETDKVLGASMCGPDAAEIMQGIAIALKFGATKAQFDSTVGIHPSAAEEFVTMREPSRRVPGAGKPKTNL

SEQ ID NO: 13253 - protein, 353 aa, Streptomyces ambofaciens
MEHIDVAVIGGGQSGLAAAHALLRRGLRPVVLEASDRTAGSWPHYYDSLTLFSPARYSSLPGMPFPGADSDRYPHRDEVAAYLTAYADRLDADIRTGERVTSVRRDGSAFDVVLEGGGRLGARAVVAASGTFGRPHRPELPGLVEFTGQVLHAADYRSPAPFTGGRLVVVGAGNSAVQIAAELATTARATLATRGPVKFAAQRILGRDLHFWTARTGLDTAPLGRFLSRPPAQPVLDDGRYRAALAAGRPERRPLFTGADGTKLVWPDGQREEVDAVVLATGYRPDLPYLAGLGGAMDTEGKPRHREGLAADVPGLAFVGLEWQRSLSSNSLRGVGRDAERIARRLVAHLARR

SEQ ID NO: 13254 - protein, 498 aa, Pisum sativum
MARKMLNDGEPDLKKGEEQGKVYDFDLFIIGAGSGGVRAARFSSNFGAKVGICELPFHPISSETIGGVGGTCVIRGCVPKKILVYGASYGGELQDARNFGWELNENVDFNWKKLLQKKTDEINRLNGIYKRLLSNAGVKLFEGEGKIASPNEVEVTQLDGTKLSYSAKHILIATGSRAQRPNIPGQELGITSDEALSLEEFPKRAVILGGGYIAVEFASIWRGMGSSVNLVFRKELPLRGFDDEMRAVVARNLEGRGINLHPRTNLAQLIKTEDGIKVITDHGEELIADVVLFATGRSPNSKRLNLEKVGVEFDKAGAIVVDEYSRTNIPSIWAVGDVTNRLNLTPVALMEASLFAKTVFGGQASKPDYNDIPYAVFCIPPLSVVGLSEEQAVEQTKGDVLIFTSTFNPMKNTISGRQEKTVMKLVVDAQTDKVLGASMCGPDAPEIVQGIAIAIKCGATKAQFDSTVGIHPSSAEEFVTMRSETRRVTGGVKPKTNL

SEQ ID NO: 13255 - protein, 500 aa, Nocardia farcinica IFM 10152
MVRFPAAATGKITIMTTVRTRIPARLDRLPWSRWHWMIVVGLGSVWIIDGLEVTVVGSVAGRLSEPGSGLPISAAQVSGLAAAMYVAGACVGALLFGWLTDRYGRKRLFIITLAVYLAATALTALSFSVWWFVLCRFFTGLGIGGEYAAINSAVDELIPSKYRGRVDIVINGTYWLGASGGALLSVAALNPELFAPNIGWRLMFGIGVVFGLLVLVVRRHVPESPRWMFIHGRDRQAEELVDGIEEQVRRDTGAELPEVEEIVQVRQRRSTGFGEIASVMFRRYPRRSALGLSLFIGQAFLYNAVTFNFAVILGRSFDVPADRAGYYYAVMCLGSFFGPLLLGRYFDTVGRKPMITASYLGSGLLLLLTAVLLVRGDLTAVTLTACWAIVLFVASCGASSAYLTVSEIFPMETRAMAIAFFYAIGTAAGGIAGPLVFAELTGDGDPGRTALAFAIGATMMILAGLVELVLGVRAEQRSLESIAAPLSFQSDEPDTAGVRR

SEQ ID NO: 13256 - protein, 144 aa, Oryza sativa (japonica cultivar-group)
MVQGTLEVLLVGAKGLENTDYLCNMDPYAVLKCRSQEQKSSVASGKGSDPEWNETFMFSVTHNATELIIKLMDSDSGTDDDFVGEATISLEAIYTEGSIPPTVYNVVKEEEYRGEIKVGLTFTPEDDRDRGLSEEDIGGWKQSS

SEQ ID NO: 13257 - protein, 431 aa, Rhodococcus sp. RHA1
MPDNDTKPTLTYPGGEHTMSIARATEGNDGIELGKLLASTGYTTLDPGFVNTASTSSAITYIDGEHGILRYRGYPIEQLAEKSTFIEVSYLLIYGELPTTAQLESFTDRIRRHTLLHEDLKRFFDGFPRNAHPMPVLSSAVNALSAYYQDSLDPADPEQVELSTIRLLAKLPTIAAYAYKKSVGQPFLYPDNSLNLVENFLRMTFGFPAEPYEIDPEIAKALDMLLILHADHEQNCSTSTVRLVGSSDANLFTSISGGINALWGPLHGGANQAVLEMLDEIKASGSNADDFVRKVKNKEDGVKLMGFGHRVYRNYDPRAAIVKKTAHTILEKLGGDDELLDIAMALEEAALTDDYFVERKLYPNVDFYTGLIYRAMGFPTRMFTVLFAMGRLPGWIAHWREMHEDPATKIGRPRQIYTGYTERDYKDVTGR

SEQ ID NO: 13258 - protein, 410 aa, Oryza sativa (japonica cultivar-group)
MELLPRVGVAAPGPGRGGASPSPTRRHRAPSHPILKRSAAVCGAVAVCRGGAVARRSRWSTLVTAAYYTGTAELVDFNWETLGFQPVPTDFMYVMRCSEEGVFTKGELVPYGPIELNPAAGVLNYGQGLLEGLRAHRKEDGSVLLFRPDENALRMRVGADRLCMPAPSVEQFLEAIKLTILANKRWVPPTGKGSLYIRPLLIGSGAILGVAPAPEYTFVVFACPVGHYFKDGLSPISLLTEEEYQCAAPGGTGDIKTIGNYASAVYAKERAKERGHSDVLYLDPVHKKFVEELSSCNIFMVKDNIISTPLLTGTVLPGITRRSIIEYARSLGFQVEECLITIDELLDADEVFCTGTSVVLSSVGCIVYQGRRVEYGNQKFRTVSQQLYSALTAIQKGLVEDSMGWTVQLN

SEQ ID NO: 13259 - protein, 120 aa, Rhodococcus sp. RHA1
MTKPEIEFQDGPAPTDLVIKDVVVGDGAEAVPGGTVEVHYVGVEFESGEEFDSSWSRGESIQFPLRGLIKGWQDGIPGMKVGGRRQLTIPPELAYGPAGAGHQLSGKTLVFMIDLLDVKE

SEQ ID NO: 13260 - protein, 236 aa, uncultured environmental landfill bacterium
FTGDFHAITTSHNLISALLDNHIQQGNALQIDPRRVVWKRVMDMNDRALRNIVVGLGGKPNGMPREDGFDITVASEIMAIFCLAKDLEDLKERVANIIVAYKFNGDPVFARDLNAQGAVALLMRDAVNPNIVQTLENTPALIHGGPFANIAHGCNSMVATKLSLKLAEYTITEAGFGADLGAEKFFDIKSRFGDLKPDAAVIVATVRALKYNGGVKKEDLGTENLDALAEGFANLE

SEQ ID NO: 13261 - protein, 117 aa, Shewanella oneidensis MR-1
MNNIIKMLNDEQMKQDVPAFGAGDTVVVQVRVKEGDKERLQAFEGVVIAKRNRGLHSAFTVRKISNGEGVERAFQTHSPLIASIEVKRRGRVRRAKLYYLRDRSGKSARIREKLATK

SEQ ID NO: 13262 - protein, 894 aa, Oryza sativa (japonica cultivar-group)
MPPWWGKSFSKDAKKTTKENLIDTFHRLISPNDQKGSTKSKRSCRRGNDSSVEKSCRSTTVSRPTSPSKEVSRCQSFSADRPHAHPLPIPGVRPPVTRTVSDITESKPILEKRGKPPLLLPLPKPNRPPRRHGNSEVVSEIVVASPSSNCSDSDDHGDSQLQSPVGNDAENATLVTLKNKSSNARKECPGPITAKNMKEIHRPANQVHGSHILSTSPRGVAADSYQSNLQNPRPLVLDSAPNSLMSSPSRSPRRICPDHIPTSAFWAVKPHTDVTFVGSGQCSSPGSGQTSGHNSVGGDMLAQLFWQPSRSSPECSPIPSPRMTSPGPSSRVHSGSVSPLHPRSGGMAPESPTNRHDDGKKKQTHKLPLPPLSISHSSFHPNNSTPTSPISVPRSPGRTENPPSPGSRWKKGKLIGRGTFGHVYVGFNSDSGEMCAMKEVTLFLDDPKSKESAKQLGQEISLLSRLQHPNIVQYYGSETVDDKLYIYLEYVSGGSIHKLLQEYGQLGEQAIRSYTQQILSGLAYLHAKNTVHRDIKGANILVDPSGRVKLADFGMAKHINGQQCPFSFKGSPYWMAPEVIKNSNGCNLAVDIWSLGCTVLEMATSKPPWSQYEGIAAMFKIGNSKELPPIPDHLSEPGKDFIRKCLQRDPSQRPTAMELLQHPFVQKAVSLEKSVLSEPLEHLAVISCRSSAKMAAHTRNISSLGLEGQTIYQRRGAKFSSKHSDIRIRSNISCPVSPCGSPLLKSRSPQHSNGRMSPSPISSPRTTSGTSTPLSGGNGAIPFNHLKQSTYSNEGFAIPSRSPDDLFASRPTDPDLGQFIRVHQVSQGLQERVVSEADILSPQFGKRLGNVFDLRDKLSPSERFTHHAFVDHVKLNPSLDLTSGSPHLGLKHGN

SEQ ID NO: 13263 - protein, 198 aa, Coprinopsis cinerea okayama7#130
MSEIRRKLVIVGDGACGKRSVTAPAPPPRSTHPSNAVYVPTVFENYVADVEVDGKHVELALWDTAGQEDYDRLRPLSYPDSHVILICFAVDSPDSLDNVQEKWISEVMHFCAGLPIILVGCKKDLRRDPRVIEELRKTSQRPVSPEEGMAVAQKIGARHYLECSAKTGEGVREVFQYATRAALLSKPGKRKHSHCIVL

SEQ ID NO: 13264 - protein, 414 aa, Erythrobacter sp. NAP1
MNATGSTSADVVIVGTGHGGAQAAIALRQQGHESSILMIGRDAEPPYERPPLSKEYLAGDKSFERMMIRPEKFWADKGVQLRLGCAVIEIDWMRHEVTLSDGSKVGYRKLIWAGGGDPRRIDVPGAGLKGIFCVRDKRDADAMMGALEAGAKRAVVIGGGYIGLEAAAVLRKLGCEVTLLEVQDRVLARVAGEELSRFYEEEHRRQGVDVRLSQGISEILGEDGKVTSVQLDNGEMLACDMVVVGIGIVPAVAPLIAAGAAGANGVDVDVYCRTTLDDIYAIGDCAAHVNPFAESAVIRLESVQNANDMANTVARAIMGDKQPYHALPWFWSNQYDLKLQTAGLSLGYDATVVRGDPAERKFSVVYLKEGRPIAFDCVNAMKDYVQGRKLLERGIEKVDPALLADTEIQLKELI

SEQ ID NO: 13265 - protein, 543 aa, Debaryomyces hansenii CBS767
MALEDKLIGPALKFSTFLDKFPKVYNVYVIAMISCISGMMFGIDISSMSVFVSDKDYLSFFNSPNSELQGFITSSMALGSFFGAISASFVSEPFGRRPSLMICGFFWVVGAVIQSSAQNVAQLIIGRIIGGYGVGFGSSVAPVYGSEMSPRKIRGLIGGLFQFSVTLGILIMYFVSYGCHFINGVGSFRIAWGVQMVPGLLIILGTFFIPESPRWLAKQNLWDQAENIVAEVQAKGDREDPDVIIEVCEIKEQIFASEKLRSFTFADLFTKKYISRTIVAVSAQIWQQLAGLNVMNYYVVYIFEMAGYSGNNNLIASCIQYCLKVGVTGVALLFMDKFGRRPLLLFGAAGMMVWQYAVAGLFATYAVQIENPDNDTVRMRIPLDQKAVGKAIIASCFLFVCCYAGTWGVTIWVYCAEVWGDNAARQRGAAISTAANWIFNFALAMYTPSSFKNITWKTYIIYATFCACMFIHVFFFFPETKGKRLEELGLMWQEKVPAWRSRLWQPDVPFLSDKELHSKMEIEHFEGERNSENSHASQSLENK

SEQ ID NO: 13266 - protein, 303 aa, Helicobacter hepaticus ATCC 51449
MNIQFALERIKAYIHTYVQECKNEEVNALYGHLSYGKMLRSKLLLSISDMNEDALRVCALIEMIQSASLLHDDVIDESLTRRGIPSINATFGNKNAIMLGDVLYSKAFYELSCLDVRLAQSVSSAVVRLSVGEIEDVKLSLSFHTDKERYIRMCADKTAALIVAAAECGAILKGLNKNIYRIYGENLGIAFQIIDDILDITQDSQTLGKPSMSDFKEGKTTLPYMYLYEHLNADERSKLLECYGVHLNEEKQAWIRMQLQKYNIIAQSVADAQYYANKAIQSIVNEGNEKLKDIVTQMIERTF

SEQ ID NO: 13267 - protein, 215 aa, Plantago major
KRVLVVGGGDGGVLREICRHSSVELIDICEIDEMVIDVSKKFFPELAIGYEDPRVHLHVGDAIDYLKRAPQGKYDAVIVDSSDPVGPAQELVEKPFFETIARALRPGGVLCNMAESMWLHTHLIQDMMSACQDIFKGSVRYAWANVPTYPSGVIGFLLCSTEGPAVDFLHPVNPIEKLEDALKYRRELMYYNSEMHEAAFALPSFVKREVEALRD

SEQ ID NO: 13268 - protein, 336 aa, Odontella sinensis
MSINIGINGFGRIGRLVMRAAKGRSDINVVAVNDPFIPVNYMEYMYKYDTVHGKCGQEVSHDAEANTLTIDGKDVKVFGEMDPSKIQWGSAGADYVIESTGVFTSTEKASMHMKGGAKKVVISAPSGDAPMFVMGVNQEKYESSMDVVSNASCTTNCLAPLAKVINDEFGLKEGLMTTVHAVTATQQTVDGPSQKDWRGGRAACYNIIPSSTGAAKAVGKVIPELNGKLTGMSFRVPTANVSVVDLTARLDKGASYETICAAIKEASEGKMKGILGYQDEDIVSSDFIGDTHSSIFDEKAGIALTDDFVKLVSWYDNECGYSNRVLDLIKHIESDS

SEQ ID NO: 13269 - protein, 356 aa, Hypocrea virens
MSRSNPPNNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDTLSKEQLKQLIYQEIMR

SEQ ID NO: 13270 - protein, 78 aa, Oryza sativa (japonica cultivar-group)
MALGDDSPASYIHMVQHLIEKCMTFGMSMEECMETLSKRADVQPVVTSTVWKELEKENKEFFDKYKQLRSEKGGVSSS

SEQ ID NO: 13271 - protein, 563 aa, Idiomarina baltica OS145
MSDEQKRPLYIPYAGPSLLETPLLNKGSAFSKEERAAFNLTGLLPPRYESIEEQAERAYMQYKSFETPLNKHIYLRAIQDNNETLFYRLLTDHLEEMMPIIYTPTVGDACEKFSDIYRSSRGLFISYSERDQLDDILRNATKQKVKVIVVTDGERILGLGDQGIGGMGIPIGKLSLYTACGGISPAYTLPVMLDVGTNNEKLLNDPMYMGARHKRINQEQYDEFLEKFIKAVTRRWPGVMLQFEDFAQPNAMPLLRRYRDEVCCFNDDIQGTASVTVGTLLAACRQKGKKLSEQKVVFVGAGSAGCGIAEQVMIQMVAEGLSEEQAKKQIFMVDRYGLVVDSMSDLRDFQQALAQPIDSLKDWQYSGDYPSLLDVIHCAEPDVLIGVSGQAGLFTEQVITTMARYVEQPIIFPLSNPSKHVEAHPHDVIKWTQGKAIVATGSPFGEVEWEGTTYPIAQCNNSYIFPGIGLGVIAVKATRVSDEMFRVASKTLAKASPSANGKNKNLLPGFTELAQLSKDIAFAVAKVAQEEGVALEIDDEVLKQRIEKNFWSPEYRHYKRVSI

SEQ ID NO: 13272 - protein, 528 aa, Medicago truncatula
MENLGTLLSSLNLQPTKVAIITVITSVLIWWIWSALDWIWFTPKRIEKRLKQQGLKGNSYRLMVGDIRDMVKMIKEAKSKPMDPYSNDIAPRVLPFVVHTIAKYGKSSFMWLGPRPRVFIMEPDKIKEMTTKVYDFQKPDTSPLFKLLASGFANYDGDKWAKHRKIVSPAFNVEKMKMLIPIFCHSCDDMINKLDQVVSSSNGPCELDIWPFVQNVSSDVLARAGFGSSFEEGKRVFQLQKEMISLTMTLFKFAFIPGYRFLPTYTNRRMKAIDLEIRTSLMKIINRRLKAIKAGEPTNNDLLGILLESNYKESEKGNGGGGMSLRDVVDEVKLFYLAGQEANAELLVWTLLLLAKNPEWQAKAREESFQVFGNENPDFEKIGQLKIVSMILQESLRLYPPVIMLSRFLRKDTKLGDLTLPAGVELIVPVSMMHQEKEFWGDDAGDFKPERFSEGVSKATNGKVSYLPFGWGPRLCIGQNFGLLEAKIAVSMILRQFSLEFSPSYTHAPSFIITLQPEHGAHLILHKL

SEQ ID NO: 13273 - protein, 453 aa, Oryza sativa (japonica cultivar-group)
MGAIGEWRRGPVIGRGATATVSIATDRRTGGVFAVKSVDVARAGALRREQGMLSALASPFVVPCVGSGVSAAVDGSGGACYDLFLEYAPGGSLADEIKRCGGRCEEPLIRSRVGDVLRGLAYVHAAGIAHCDVKGRNVLVGADGRAMLADFGCARWMAAEDCNAGGVTIRGTPMFLAPEAARGEAQGTAADIWALGCTVIEMATGGAPWPRFADPVAALHHVAHSVDVPESPAWFSAEGKDFLARCLIRDPAKRWTAEQLLEHPFVASAASDSTSKAVQIEQRVSPKSILDQCLWESTSTDSDATVALAPADRLRALSAGASVAPDWTWSMDDWIAVCGGRADDHDTTPSPQPDTTTSFFRGDEASSDLVFPGGGELAAAADGPRGHDDDDDDDDHGVSSSPCSWRRSNSAISGCETERGAVAVAATVPLMAKSSEITGVERSIESRVASGSG

SEQ ID NO: 13274 - protein, 509 aa, Salinibacter ruber DSM 13855
MPFQRRLSPNTRPPLALFVAVDSVMPDPTADSSSEANEEVLTGNVLKIVLLSLSAALGGFLFGFDSGVINGTVEAIQSDFGAGEVVTGFNVASMLLGSAVGAFFAGNLADKVGRRPTLILTALAFMVSAWGSGAAGGSVPFVAARLIGGLAVGAASILAPAYISEIAPSSIRGSLATLQQLMIVVGLFVAFLNNYLIAQAAGSAANAFWMGFDAWQWMYWMELIPASVFFLSLLAIPESPRYLVAANREEEAASVLDSLGTATNVKEKLADIRSTLNDERRPRLTDVIQEHTGRIHPLLWAGIGLAALQQLTGINVVFYYGGTLWQAAGFTEASALLTNVVNGSVNVVFTFVAIALIDRVGRRPLLLVGSIGQALMLGVMAYVFATAAQGGAGGIEMQGNQGVVALVAANAYIAFFAFSWGPVMWVMLGEMFPNRFRGAALSICGLVQWLSNFLVTWTFPILLGSIGLGISYGIYAAFGVVAFVFVKLFIDETKGRSLEDMSREADAAA

SEQ ID NO: 13275 - protein, 371 aa, Streptomyces ambofaciens
MTQHTDVVVVGGGQAGLAAGYHLRRQGLDFVVLDADAAPGGSWQHMWDSLHLFSPADHSSLPGRLMPAQPGETYPDAGHVVDYLTDYEKRYDLPVQHGARVDAVRRDAGHLLVEADTGTWRAKAVISVTGTWSRPFLPAVPGRSVFPGRQLHTVNYRSPADFAGQRVLVVGGGKSGAQIAADLALDGQADVTWVTQRPTRFLADDIDGRALFDVATARRRALDAGRTDTGGVASLGDIVAVPAVRAARDAGLLHVKPMFARLTATGVRWSDGSQSDADAIVWCTGFRPALSHLAPLNLRGSRGGIPTDGTRAVGEPRLHLLGYGDWTGPASATLIRVGRPAGDAVRHIAGQLSTGRILGAGEGRSGSRTVR

SEQ ID NO: 13276 - protein, 303 aa, Arabidopsis thaliana
MSHFGRSGPPDISDTYSLLVLNITFRTTADDLYPLFAKYGKVVDVFIPRDRRTGDSRGFAFVRYKYKDEAHKAVERLDGRVVDGREITVQFAKYGPNAEKISKGRVVEPPPKSRRSRSRSPRRSRSPRRSRSPPRRRSPRRSRSPRRRSRDDYREKDYRKRSRSRSYDRRERHEEKDRDHRRRTRSRSASPDEKRRVRGRYDNESRSHSRSLSASPARRSPRSSSPQKTSPAREVSPDKRSNERSPSPRRSLSPRSPALQKASPSKEMSPERRSNERSPSPGSPAPLRKVDAASRSQSPYAAE

SEQ ID NO: 13277 - protein, 366 aa, uncultured environmental landfill bacterium
FTGDFHAITSANNLIRALIDNHIQQGNELRIDSRRVTFKRVLDMNDRNLRDVVVGLGGKGNGFVRQDGFMITVASEVMAILCLSSDLEDLKKRIGEIVIGYNLDSKPVFAKDLKCQGAVALLMRDSVLPNMVQTLENTPALIHGGPFANIAHGCNSIIATKAAMKLGDYAITEAGFGADLGAEKFLDIKCRFGGLNPSAVVVVATIRALKHHGGAKKGEYGEENLEQLKKGIVNLEKQIENVRKFGLEPIIAINKFATDSDAEIKFIEDFCNENNVRVALTDVFAKGGEGGEALAREIVDLVENNESNFKVLYDVNDSIEDKVNTIVREIYGGDGAVFTKAALKQVRELEENGMDKMPICMAKTQY

SEQ ID NO: 13278 - protein, 366 aa, uncultured environmental landfill bacterium
FTGDFHAITTSHNLISALLDNHIQQGNALQIDPRRVVWKRVMDMNDRALRNIVVGLGGKPNGMPREDGFDITVASEIMAIFCLAKDLEDLKERVANIIVAYKFNGDPVFARDLNAQGAVALLMRDAVNPNIVQTLENTPALIHGGPFANIAHGCNSMVATKLSLKLAEYTITEAGFGADLGAEKFFDIKSRFGDLKPDAAVIVATVRALKCNGGVKKEDLGTENLDALAEGFANLEKHIENMSKFGVPAVVALNNFPTDTDAEVEYVLDRCRKLGAEAVLSEVWGKGGEGGKALAEAVVRVCETKESNFKPLYVVESSIKDKINTIAREVYGAEGADFTKACEKQIANIEKLGFDQMPICMAKTQY

SEQ ID NO: 13279 - protein, 288 aa, Xylella fastidiosa 9a5c
MFDIPGLSTGDFHGFPSLLIQTPFSHAAISLFGGQLLSFVPSGGEEVIWLSPLVQPPPTAIRGGIPICWPYFGRQGQRDTMPAHGFVRTVPWQQVESCQENDGSLFLVLAPPPLKHLGLHLRMTLRIGRTLEQELATENISHAPISFTQALHNYFRVSNALQVTVQGLDGVEYLDKFEGYTQRHRQQGHWTLQDPRDPGRADRIYVDTSGHYVLVDPLFSRRIVLTTEGSHSLVVWNPGHAGASNMIDVADGWRDYLCLEPANAGPDEIELLPGARHVLRQSIAIAPL

SEQ ID NO: 13280 - protein, 366 aa, uncultured environmental landfill bacterium
  misc_feature (123)..(123): Xaa can be any naturally occurring amino acid
FTGDFHAITTAHNLISALLDNHIQQGNKLNIDPRRIVWKRVLDMNDRALRNIIVGLGGRTNGVPREDGFDITVASEIMAIFCLADDLEDLKERVGRIVIAYTYDNEPVYAKDIKAEGAVALIXKDAMAPNLVQTLENTPAILHGGPFANIAHGCNSIIATKTSLKLAEYTVTEAGFGADLGAEKFFNIKSRFGNLKPDATVIVATIRALKHHGGASKEELNEENLDYLNEGFKNLEKHIENISKFKVPSVVAINRFPTDTDKEIELLLKKCEDLNVKAVLCDVWAKGGEGAVELAEEVVSICENEKSEFEVLYDVNSSVEEKIETIAREIYGASGVNFTKKAKKQIANLEKLGLDKMPVCMAKTQY

SEQ ID NO: 13281 - protein, 559 aa, Bacteroides thetaiotaomicron VPI-5482
MCGIAGILNIKTQTKELRDKALKMAQKIRHRGPDWSGIYVGGSAILAHERLSIVDPQSGGQPLYSPDRKQALAVNGEIYNHRDIRARYAGQYDFQTGSDCEVILALYKDKGIHFLEEISGIFAFVLYDEEKDEFLIARDPIGVIPLYIGKDKDGKIYFGSELKALEGFCNEYEPFLPGHYFYSKEGKMKRWYTREWTDYESVKDNDAKVSDVKEALEDAVHRQLMSDVPYGVLLSGGLDSSVISAIAKKYAAKRIETDGASDAWWPQLHSFAIGLKGAPDLIKAREVAEYIGTVHHEINYTVQEGLDAIRDVIYFIETYDVTTVRASTPMYLLARVIKSMGIKMVLSGEGADEVFGGYLYFHKAPTPKDFHEETVRKLSKLHMYDCLRANKSLSAWGVEGRVPFLDKEFLDVAMALNPKAKMCPGKEIEKRIVREAFADMLPESVAWRQKEQFSDGVGYSWIDTLREITAAAVSDEQMEHAAERFPINTPLNKEEYYYRSIFEEHFPSESAARSVPSVPSVACSTAEALAWDVAFRNLNEPSGRAVRGVHEEAYAEEVK

SEQ ID NO: 13282 - protein, 513 aa, Populus trichocarpa
MDSLLQSLQTLPMSFFLIIISSIFFLGLISRLRRRSPYPPGPKGFPLIGSMHLMDQLTDRGLAKLAKQYGGLFHMRMGYLHMVAGSSPEVARQVLQVQDNMFSNRPANIAISYLTYDRADMAFAHYGPFWRQMRKLCVMKLFSRKRAESWESVRDEVDSMVKTVESNIGKPVNVGELIFTLTMNITYRAAFGAKNEGQDEFIKILQEFSKLFGAFNISDFIPWLGWIDPQGLTARLVKARKALDKFIDHIIDDHIQKRKQNNYSEEAETDMVDDMLTFYSEETKVNESDDLQNAIKLTRDNIKAIIMDVMFGGTETVASAIEWAMAELLKSPEDIKRVQQELADVVGLERRVEESDFDKLTFFKCTLKETLRLHPPIPLLLHETSEDAEVAGYYVPKKTRVMINAYAIGRDKNSWEDPDSFKPSRFLEPGVPDFKGNHFEFIPFGSGRRSCPGMQLGLYALDLAVAHLLHCFTWELPDGMKPSELDMTDMFGLTAPRATRLVAVPRKRVVCPL

SEQ ID NO: 13283 - protein, 366 aa, uncultured environmental landfill bacterium
  misc_feature (205)..(205): Xaa can be any naturally occurring amino acid
FTGDFHAIGAANNLLAAMVDNHIFQGNTLDIDVRRVVWRRAVDMNDRQLRNIVNGLGGKAQGMPREDGFDITVASEIMAVFCLSKDIIDLKERCARIVVAYNRKGEPVTAGDIKAQGAMAALLKDALKPNLVQTLEGTPAFVHGGPFANIAHGCNSVLATRFAMNYADYVVTEAGFGADLGAEKFIDIKCRLNDLQPDAVIIVAXVKALKYNGGVAKADLQEENLAALEKGIPNLLKHVENITQVFKLPAVVAINAFHTDTKAELDLVEAKCKELGVNVALSEVWAKGGEGGEELAKEVIRLCDQESNMEFAYDLEDSIKDKIKKISQKIYGADDVAFSAKAEKEIANFEKLGFGKMPICMAKTQY

SEQ ID NO: 13284 - protein, 613 aa, Rhodococcus sp. RHA1
MCGIAGWISFERDLRVEQSTVDAMAETMNCRGPDDRGTWVVERAALGHRRLAIIDLPGGHQPMSVDTPGGTVAMVYSGEVYNFGELHEELYRRGHRFATDSDTEVVLHGYLEWGEAVAERLNGMYAFAIWDSRTDTLVMIRDRMGIKPFYYYETRDGVLFGSEPKAILANPIAESTVTMDGIRELFAFVKTPGHAVWDGMREVEPGTVVTVSRTGLRTHRYWTLQTRPHTDDRDTSVAHVRELLDDIVRRQLVADVPRCTLLSGGLDSSAMTGIAAEQLAEVGETVRTFAVDFVGQTEHFVADELRGTPDTPYVHDVARRSRTAHQDIVLDSDALADPAVRAKVIRARDIPMGLGDMDASLYLLFKAIRQHSTVALSGESADEVFGGYKQFFDPKAQQANTFPWLVQFAEHFGDESNIFTPEVTAGLNMDDYVQDSYDAAVSGIDRLDGESDFEWRMRKICYLHLTRFVRVLLDRKDRASMAVGLEVRVPFCDHRLVEYVYNTPWSLKTFDGKEKSLLRAATRDVLPQSVIDRVKSPYPSTQDPKYAVALQQHGKDLLSDPSHPVFGLVSADWLSRAVSVDTPQISQVSRRGLERTLDLALWMDMYNPTIKLS

SEQ ID NO: 13285 - protein, 478 aa, Streptomyces coelicolor A3(2)
MDLGVRWKLHGDGKVPAPGAVVRPDERLSWPRTAGLGAQHVVAMFGASFVAPVLMGLDPNLAIMMSGVATVIFLLATRGRVPSYLGCSLSFVGVAAVIRAQGGTSATVTGAVLVVGVALFLVGLAVQRFGARIIHAAMPPVVTGAVVMLIGFNLAPVTASTYWPQDQWTALFVMLFTGLAVVCLRGFWSRIAIFLGLVFGYVLSWALDRIFGKIHSVDGSGKPTDHWRLDFSAVGQADWIGLPSFHGPSFEWSAILVALPVVIALIAENAGHVKAVGEMTGDNLDDKLGTAISADGIGSVLSTAVGGPPNTTYSENIGVMAATRVYSTAAYWAAAGFALLFGLCPKFGAVVAAIPGGVLGGITVILYGMIGLLGAQIWINAKVDMRNPLNLVPAAAGIIIGVGNVSMEFTDTFSLSGIALGTLVVITGYHALRAFAPAHLKTQQPLLDEGTSSYDAKTGSGGAGGDGGGDGGAQRARS

SEQ ID NO: 13286 - protein, 524 aa, Burkholderia sp. 383
MTSTTTDRRTAPPAPDARGDSYDLDVLIVGAGLSGIGAAYHLKQRCPYASVAIVEARDAIGGTWDLFRYPGVRSDSDMFTLGYSFRPWHSDKAISDGQTILDYIRDTARAYGIDKTIRYGQKVVAADWDSNRARWTVRIERTRDGATDTLVYTCRFLFMCSGYYDYDAGYLPDWAGMDTFEGKLVHPQHWPKDLSYANRRVVVIGSGATAVTLVPSMAADAQHVTMLQRSPTYIVSLPARDKIANALRRVLPSRLAHRLVRVKNVLLTMYLYNVSRRKPDRTKQFIIRAASKQVGPGFDVAKHLTPRYMPWDQRVCLVPNGDLFKSIRSGRASIVTDEIERFTPTGLKLKSGQQLDADVIVTATGLKVKMLGGARVTVDGRAVDLPDTVSYKGMMYSDVPNLASSFGYTNASWTLKAELIARYVCRLLNHMRANGYDTCVPRLGTGDPGNVPAVNLSSGYIQRAAGILPKQGHSKPWKFHQNYVLDLASLKFSGLADSAMQFERRAKAGPAATTPVAEPALETR

SEQ ID NO: 13287 - protein, 366 aa, uncultured environmental landfill bacterium
FTGDFHAITTSHNLISALLDNHIQQGNALQIDPRRVVWKRVMDMNDRALRNIVVGLGGKPNGVPREDGFDITVASEIMAIFCLAKDLEDLKERVANIIVAYKFNGDPVFARDLNAQGAVALLVRDAVNPNIVQTLENTPALIHGGPFANIAHGCNSMVATKLSLKLAEYTITEAGFGADLGAEKFFDIKSRFGDLKPDAAVIVATVRALKYNGGVKKEDLGTENLDALAEGFANLEKHIENMSKFGVPAVVALNNFPTDTDAEVEYVLDRCRKLGAEAVLSEVWGKGGEGGKALAEAVVRVCETKESNLKPLYVVESSIKDKINTIAREVYGAEGADFTKACEKQIANIEKLGFDQMPICMAKTQY

SEQ ID NO: 13288 - protein, 207 aa, Arabidopsis thaliana
ERLDDSRSEIHSKRISISVEKQSNHNNNAYDETSPKIVEIDTYKTKSRSKRMNVAVSECGDDFIYQAKDFEWSFPGEKCKFPTAQNTPRFSSSMANNNYYYTPPSPAKSVCRDACFRPSYPGLMTPSYMANTQSFKAKVRSHSAPRQRPDRKRLSLDEIMAARSSVSGVRMVQPQPQPQTQTQQQKRSPCSYDHQFRQNETDFRFYN

SEQ ID NO: 13289 - protein, 1075 aa, Bacteroides thetaiotaomicron VPI-5482
MKENIKKVLLLGSGALKIGEAGEFDYSGSQALKALKEEGIETILINPNIATVQTSEGVADQIYFLPVTPYFVEKVIQKEKPEGIMLAFGGQTALNCGVALYKEGILEKYNVKVLGTPVQAIMDTEDRELFVQKLNEINVKTIKSEAVENAEDARRAAKELGYPVIVRAAYALGGLGSGFCDNEEQLDVLVEKAFSFSPQVLVEKSLRGWKEVEYEVVRDRFDNCITVCNMENFDPLGIHTGESIVIAPSQTLTNSEYHKLRELAIRIIRHIGIVGECNVQYAFDPESEDYRVIEVNARLSRSSALASKATGYPLAFVAAKLGLGYGLFDLKNSVTKTTSAFFEPALDYVVCKIPRWDLGKFHGVDKELGSSMKSVGEVMAIGRTFEEAIQKGLRMIGQGMHGFVENKELVIPDIDKALREPTDKRIFVISKAFRAGYTIDQVHELTKIDKWFLQKLMNIMKTSEEMHEWGNNHKQIADLPVELLRKAKVQGFSDFQIARAIGYEGDMENGSLYVRKYRKAAGILPVVKQIDTLAAEYPAQTNYLYLTYSGVANDVHYLGDHKSIVVLGSGAYRIGSSVEFDWCGVQALNTIRKEGWRSVMINYNPETVSTDYDMCDRLYFDELTFERVMDILELENPHGVIVSTGGQIPNNLALRLDAQNIHILGTSAQSIDNAEDREKFSAMLDRIGVDQPRWRELTSLEDINEFVDEVGFPVLVRPSYVLSGAAMNVCSNQEELERFLKLAANVSKKHPVVVSQFIEHAKEVEMDAVAQNGEIIAYAISEHIEFAGVHSGDATIQFPPQKLYVETVRRIKRISREIAKALNISGPFNIQYLAKDNDIKVIECNLRASRSFPFVSKVLKINFIELATKVMLGLPVEKPEKNLFELDYVGIKASQFSFNRLQKADPVLGVDMASTGEVGCIGSDTSCAVLKAMLSVGYRIPKKNILLSTGTMKQKADMMDAARMLVNKGYKLFATGGTHKTFAENGIESTLVYWPSEEGHPQALEMLHNKEIDMVVNIPKNLTAGELDNGYKIRRAAIDLNVPLITNARLASAFINAFCTMTVDDIAIKSWEEYK

SEQ ID NO: 13290 - protein, 141 aa, Burkholderia xenovorans LB400
MAIERTLSIIKPDAVAKNVIGQIYTRFENAGLKIVASRMVHLSRADAEKFYAVHAARPFFKDLVDFMISGPVVVQALEGENAILKHRDLMGATDPKKAEKGTIRADFADSIDANAVHGSDAPETAAVEIAFFFPQVNVYSR

SEQ ID NO: 13291 - protein, 1370 aa, Frankia sp. EAN1pec
MTTKVALDRVRTVCAYCGVGCGIVLEVDRSGDSPRVVRSTGDPDHPANRGRLCTKGATTAELLNAPGRLTTALARAGHDEEPAPIDVDTALDLAAARLAALRDEHGPDAIGIYTSGQLSIEAQYLITKLAKGFLRTQYQECNSRLCMASAASGYKLSLGADAPPGSYDDFDHADVFLVIGANMADCHPILFLRMMDRVKAGAKLIVVDPRRTATADKADLFLQLRPGTDIALLNGLLHLLHASGAVDESFVAAHTEGWAAMPDLLAGYDPATVADITGVPEDDLRAAAALIAAAGSWMSCWTMGLNQSTHGTWNTNALINLHLATGAICRTGSGPFSLTGQPNAMGGREMGYMGPGLPGQRSLLDPADRAHIEQLWGLPADTIRADHGNGTIGMFEQMSAGAIKAAWIICTNPVATVANRRTVIEGLETAEFVLVHEAFTETETTGYADVVLPAAVWAETDGVMVNSERNLTLTRPAADPPGQARADWQLIAGIATRLGYADHFTYNSAQEVFDELRQAWNPVTGWDLRGITHGRLRDGPMQWPAPPGAGARNPIRYMTDDGPRFPTPSGRAKFWPRPHVDPQEIPDEKYPYLLNTGRLQHQWHTLTKTGRVGRLNKLNPAPFIEIHPDDAAALGISEGDQVEVSSRRGRAVLPAAVTDRVQPGNCFAPFHWNDMFGEYLAVNATTSDAVDPVSLQPGFKASAVALTRVHTPTPAQPPPTLVDDVLHADAVASAAPIASLLGLGGTAAPPALNDDESVYLAGFVAGLGLDLARGALTSVPTLPPSAPVTARTALWVNGALAGLWSRLPAEGREILPGRGVSPREDPPGTGGRRVLLGWASQTGNAERVAEQAEARLTESGTVVTTLPLNEIDHIAPHTDLVVVTSTFGDGESPDNGSEFLARLRARSMPLDDVRFSVIALGDSSYSDFCGHGRRIDELLAELGGLRLADRVDCEPDFDEAARAWLDRVLAARAGASPTRPEPVPVPVPPVSRLPGASSGPRVSETHRVILAGNRLLSGVGSAKEVREFLIDLEDSDLTYETGDVLVVRPSNRAELVDEWLSTTGLRGDTIVELLQFGRTELAVALRDHLEIAKPSRAFLAFVAERSGSRHLQRLLRGDRADLDGWLWGRQTVDVITETGTHASAQEWCELLKPLRERRYSISSSAEVSPRQIRTLVSVVRYNAPSGAARTGVASAFLADAPAGTPLKVAVARSSGFAPPSDPETPTIMIGPGTGLAPFLAFLDTRRARGHTGRNWLFFGEQRRATDFYYSDELAEFARSGLLTRLDTAFSRDQRAKIYVQDRMRERGAPLWQWLREGAAVYVCGDAARMARDVDTALRDVVAKHGDLNAAQAGDYVRQLITDGRYLRDVY

SEQ ID NO: 13292 - protein, 465 aa, Yersinia pseudotuberculosis IP 32953
MSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKATK

SEQ ID NO: 13293 - protein, 887 aa, Yersinia pseudotuberculosis IP 32953
MSERLNNDVDPIETRDWLQAIESVIREEGVERAQYLIDQVLGEARKGGVSVAAGSANRDYINTIPVEDEPAYPGNLDLERRIRSAIRWNAVMTVLRASKKDLDLGGHMASFQSSATFYEVCFNHFFRARNQKDGGDLVYFQGHISPGVYARAFLEGRLTEDQMNNFRQEVHGKGLSSYPHPKLMPEFWQFPTVSMGLGPISAIYQAKFLKYLSHRGLKDTSAQTVYAFLGDGEMDEPESKGAITIATREKLDNLVFVINCNLQRLDGPVTGNGKIINELEGIFSGAGWQVLKVIWGGRWDELLRKDTSGKLIQLMNETLDGDYQTFKSKDGAYVREHFFGRFPETAALVKDMTDDEIWSLNRGGHDPKKVFAALKKAQETQGKPTVILAHTIKGYGMGETAEGKNIAHQVKKMNMDGVRHFRDRFNVPVADAEIEKLPYITFEKDSEEYKYLHERRQALEGYVPTRMPKFTEKLEIPALSDFSSLLEEQNKEISTTIAFVRALNVMLKNKSIKDRIVPIIADEARTFGMEGLFRQIGIYSPNGQQYTPQDREQVAYYKEDEKGQILQEGINELGAASSWLAAATSYSTNDLPMIPFYIYYSMFGFQRIGDLCWAAGDQQARGFLIGGTSGRTTLNGEGLQHEDGHSHIQSLTIPNCISYDPAYAYEVAVIMHDGLERMYGEAQENVYYYLTTLNENYHMPAMPQGAEEGIRKGIYKLETVEGSKGKVQLMSSGAILRHVREAAQILAKDYGVGSDVYSVTSFTELARDGQDCERWNMLHPTETPRVPYVAQVMNDAPAVASTDYMKLFAEQIRNFIPASEFRVLGTDGFGRSDSRENLRHHFEVDSSYVVVAALGELAKRGDIDTSVVAEAITKFGIDADKVNPRLA

SEQ ID NO: 13294 - protein, 1018 aa, Frankia sp. EAN1pec
MVTAGGARRPDGDRPAGATIVTRADVMLPGALAVVPSAKATEQLQWAPTALVTEFSELAARGALPARMDLDRGQLILYTRRYVAFLYPTKFGDGYSLGHVSRRSFRDEDKLSRGALILHCRAPWGAFNDVRDIPRPQGTLSPRWASHWDQLSLEWTSLGRVVDGASELPPHHRDYLALLDHVVEASRDIELAKLSGIPEAPYREVEPTREERYSGRGVYSFSLARPPRGLPVGALVEVAECGDPPMRGKVVRSGGRTLVVRFERTVDFQRIPPQGRLRASVSDRVFQAQRDAIETLAKGEAANPALLSVLVDGRYARYQPDLSRQPVRQLDEHQADAFRRALAVPDVLLVLGPPGTGKTTTIVEIVTALVALGQRVLVTSHTNRAVDNVVENLPPQINSVRVGAEDSMTSAARRRGLDTLTEQVRAGIRDAAEPRGQLTEFRQSRAVFDQWLGHLRNSLAAVDAAEAALVSVEQAVDHAVQALSPQLAADRRSAADRRTRQLGSVIRLREELARRREVLARRAKTTPSDSPEEFWRLVTRFRRWLLARARRREQGAREALVTAQQDLTEAEAAVEALSAQAVALIAGDPEHRPLLAERERQIAARDGGHGGLRRTAEVVRGGLREVLPALPTLAALDDEPADSAGWVRFHDWAVESFATVGQRADLLGHWHDQLASAETELQRELVRYADVVAATCIGTATSKVLSDTVFDVALIDEAGQISTPNLLVPMVRARRAVLVGDQHQLPPFLDEEVRGWAAGLKKDGRYTPEAVTRVNGLLRASGFELLVPGAAATRANYVELNLQRRMPEQVARFVSDAFYAGRLGTRHGGGRDDPLFRSAFAMIDTSDRPAGERGETALKATETRHEQGYVNALEVELIVSLLARAAGWYRDWAVIVPYKAQARRISEALAGEFGDPTTVADNVGTVDSFQGGERDLIIYGFTRSNSRNSVGFLTELRRLNVAVSRAKQQLVMVGDLATLRSATDTEFRKKISMMEDHLRRDGDLRLSCEIEKLLRDPR

SEQ ID NO: 13295 - protein, 69 aa, Oryza sativa (japonica cultivar-group)
MGFWVTTLIFLLAGFVASLFSLLCCNRGPSTNLFHLTLVITATVCCWMMWAIVYLAQLKPLINPILSGE

SEQ ID NO: 13296 - protein, 320 aa, Burkholderia xenovorans LB400
MTNGNQSGNQSGNQSGNHSGNQGSNDGVQIRGSIPAIITPMLEDGSLDLPAFRKLIDWHVAEGTNALVVVGTSGESATLSVEEHVLMVKTAVEHTAGRIPVIAGSGGNSTTEAIELTQRAKEVGADATLQVVPYYNKPTQEGIYRHFAKIAETVDLPVILYNVPGRTVADMSNETILRLAQVPGIIGVKEATGNIDRAAHLIKFAPSHFGIYSGDDPTAIALMLLGGHGNISVTANVVPRAMSELCKAALAADVKTAREIHLKLLSLHKNLFVESNPIPAKWALQQLGRVQGGIRLPLTPLDPQYHEVVRGALREAGLLG

SEQ ID NO: 13297 - protein, 633 aa, Saccharomyces cerevisiae
MSSNNNTNTAPANANSSHHHHHHHHHHHHHGHGGSNSTLNNPKSSLADGAHIGNYQIVKTLGEGSFGKVKLAYHTTTGQKVALKIINKKVLAKSDMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLLPPDLKPHPEEENENNDSKKDGSSPDNDEIDDNLVNILSSTMGYEKDEIYESLESSEDTPAFNEIRDAYMLIKENKSLIKDMKANKSVSDELDTFLSQSPPTFQQQSKSHQKSQVDHETAKQHARRMASAITQQRTYHQSPFMDQYKEEDSTVSILPTSLPQIHRANMLAQGSPAASKISPLVTKKSKTRWHFGIRSRSYPLDVMGEIYIALKNLGAEWAKPSEEDLWTIKLRWKYDIGNKTNTNEKIPDLMKMVIQLFQIETNNYLVDFKFDGWESSYGDDTTVSNISEDEMSTFSAYPFLHLTTKLIMELAVNSQSN

SEQ ID NO: 13298 - protein, 546 aa, Medicago truncatula
MSTNIDNLWIFALASKCTQENIAYSLLIMALLWITMTFFYWSHPGGPAWGKYYYSSNYSTTKTNNKNNLNSSTKPSTTTSSSIFIPGPKGYPLFGSMNLMSSSLAHHRIASTAKTCKATRLMAFSLGDTRAMVTCNPDVAKEILHSSVFADRPIKESAYSLMFNRAIGFAPYGVYWRTLRKISTNHLFSPMQIKSSGPQRSEIATQMIDLFRNRHLHGGFCVRDVLKKASLNNMMCSVFGQRFKIDEVNERMMELSGLVEQGYDLLGGLNWGDHLPFLKDFDVQKIRFSCSELVPKVNRFVGSIISDHRADKNQTNKDFVHVLLSLQEPDKLSDSDMIAVLWEMIFRGTDTVAVLIEWILARLVIHPDVQKKVQTELDEVASGESCAITEEDVAAMVYLPAVIKEVLRLHPPGPLLSWARLAITDTTIDGYHVPAGTTAMVNMWAISRDPDVWRNPLEFNPERFVSEGAEFSVLGSDLRLAPFGSGRRSCPGKNLGLATVTFWVAKLLHEFEWLPLDEVNGVDLTEVLRLSCEMANPLTVQVRPRR

SEQ ID NO: 13299 - protein, 514 aa, Debaryomyces hansenii CBS767
MTISPVLYQFLVCCFASVGSFTYGYDLGIIAQVIASESFTEYMNYPNTTVTGLIVSLFTVGAFAGALLAGFLEKLSRRQTILLATIFFLFGGALQCGAQNFRFLFAGRFFAGVGVGLYTMIIPLYQAELVHPKHRGRVTSLQQFFLGIGALSAAWIGYGCYIGFEDDRQWRVPLGLQMVPALLLGSLILLFPELPRWLLEYNKDEKALKVLGKLYAHGNTQDPFVEEEFSKIKAAIEFDKIHGQTSWASLFLIPSNLRRIFLCCAIQGSVQMTGVSAIQYYAPTIFAQIGLSSGKTLLYQAINSIIALIAQALCIVTVDYTGRRWTLIGANIGCGCMFIVSCILLALFPPYKGAQPRSSQIGFIASTWIWNFIFSIYVGPLLWVIPSEVFNTATRSKGVSLSTMTCFAMNTMIGQVTPLAMDTIHYRFYIVFIICSFTNSFFFWCFLPETKGIPLESMNQLFENAPWFVPGINSKDYYGDIKVNDDSKFKSEKEIEYLEKENDVSISISSHVEA

SEQ ID NO: 13300 - protein, 350 aa, Aspergillus nidulans FGSC A4
MQAVVFKGPLKVALEQRPIPTIQDPTDAIVKVRYTALCGSELHVFRGHQPSGTDFIMGHEFTGEIASVGSSVSKFKPGDKVVSPFTVSCGDCFYCSHNTSSRCAKCQLYGSVVLDGAQADYVRVPLADSTLVSAPEKIDEKKLVMMADILPTGFFAAKNAFSGLDESIIKESTVILFGCGPVGIFALISALEYKPKHLIAIDSVPSRLELAKSLGAEPWNFATDSEGLKNRVKELTDGRGADVAIEVVGHSDALRMAFDMIRPWGKISSVGVHNGEIPWTGNEAYGKNLQLQMGRCPVRSIFEDALKLLEKKQDSIEFMVQDIRPLSQALQAYDDFNQMRSQKVIFEAGK

SEQ ID NO: 13301 - protein, 149 aa, Candida glabrata CBS 138
MFATRLLGKSALLGTTSTRMVFRSQMARYMSTETKKAIEGAIASAPVVLFMKGTPEFPQCGFSRATISMLGQQGVDPEKFAAYNVLEDPELREGIKEFSNWPTIPQLYVNKEFIGGCDVITSMARSGELADVLEEANALVPEEKEEGTD

SEQ ID NO: 13302 - protein, 338 aa, Mesorhizobium loti MAFF303099
MGVVLNIENGKREPASIKDLIDLTAADMGRVNELILSKAGSDVEMIPEVANHLISSGGKRLRPMLTLAAAQMFGYAGEGHVKLATSVEFMHTATLLHDDVVDESGMRRGKKTARMIWGNQASVLVGDFLLGQAFRMMVDVGSLEALDILSSAASIIAEGEVMQLAAAKNLETTEDEHFAVIKAKTAALFSAAAEVGPVIAQATRNDRAALRSYGMNLGLAFQLIDDALDYGGTSKDLGKNVGDDFREGKVTLPVILAYRRGTKAERTFWKRAIEDNVVDDAGLEKAIGLMTRHGAIADTIGRARHFGEIARDALAPLEETRQKSALIDVIDFCISRVN

SEQ ID NO: 13303 - protein, 1515 aa, Candida glabrata CBS 138
MPASISSSIISKERKDDADTTSNSYADSVHSYENINRDDNEQQPVSTQLSRHLTQILSEEGGKERLESMARVISTKTKAEMDKFEVNDMDFDLRMLLNYLRNRQLEQGIEPGDSGVAFKNLTAVGIDASAAYGPSVEEMLRDTGKLPLTLINKLRRKKDSVPLRNIIQNCTGVVESGEMLFVVGRPGAGCSTLLKCISGETSELVSVDGEFSYDGLDQEEMMKNYKGYVIYCPELDFHFPKITVKETIDFALKCKTPRVRIDRMTRKQYVDNIRDMWCTVFGLRHTYATKVGNDFVRGVSGGERKRVSLVEAQAMNASIYSWDNATRGLDASTALEFAQAIRTATNMMNNSAIVAIYQAGENIYELFDKTTVLYNGKQIYFGPAKKAVQYFENMGWIKPPRMTSAEFLTSVTVDFENRTLDIKPGYEDTIPKSGFEFEEYWLNSPEYQELLRHYDDYHARHPAEETRERFDTAKKQMLQSGQRESSRYVVNYWSQVWYCMIRGFQRVKGDSTYTKVYLSSFLIKGLIVGSMFHKIDNKSQSTTAGAYSRGGLLFYVLLFASVTSLAEIANSFSTRPIIVKHKSYSMYHISAESLQEIITELPTKFVAIIVLSLVTYWIPYLKFEAGAFFQYILYLFTVQQCTSFIFKFVATITKDGVTAHAIGGLWVLMLCVYAGFVLPLGEMHHWIKWLHFLNPLTYAFESLVSTEFHHREMLCSQLIPSGPGYENVSVANQICNAAGAIKGHMFVNGDTYIDRQYHFAYRHAWRSWGVNIVWTFGYIVFNVILSEFIKPVSGGGDLLLYKRGHMPEFGTENADARVASREEMMETLNGPDVDLPKVIAAKDVFTWNHLNYTIPYDGATRQLLSDVFGYVKPGKMTALMGESGAGKTTLLNVLAQRINMGVITGDMLVNSQSLPASFNRSCGYVAQADNHMAELSVRESLRFAAELRQPRSVPLEEKYEYVEKIIALLGMQNYAEALVGKTGRGLNVEQRKKLSIGVELVAKPSLLLFLDEPTSGLDSQSAWSIVQFMRALADSGQSILCTIHQPSATLFEQFDRLLLLKKGGKMVYFGDIGENSSTLLNYFERQSGVKCGISENPAEYILNCIGAGATASASADWHDLWQQSPECAAARAELDELHKNLLSRPVTEDPELVTKFAASYTTQMKCVLRRTMIQFWRSPVYIRAKFLECVSCALFVGLSYIAVNHSVGGATEAFSSIFMLLLIALAMINQLHVFAYDSRELYEVREAASNTFHWSVLLLCHYVVETGWSTLCQFMCFICYYWPAGYSGRASHAGFFFFFYVLIFPMYFVSYGLWILYMSPDVPSASMINSNLFAAMLLFCGILQPKEKMPGFWRGLMYNVSPFTYVVQALVGPLVHDKKVVCNKNEFAIMDPPAGQTCGEYLRTYIGNNSGYLVNPQATSNCNYCPYSVQDEVVARFNVKWSYRWRNFGFMWVYICFNIFAMLSCYYIMRVKVWSLKSVLDFKKWFNGPRKDRHEKDKSIFEKKPGDEEKVKQKF

SEQ ID NO: 13304 - protein, 363 aa, Thermoproteus tenax
MEAAILEKYNSELVIEEVDVEPPKSGEVALRVKAAGVCHSDLYVLEGATPVPPPLVPGHEAVAEVIEVGPDVQGLSRGDLVVTSFIWPCGRCRNCARGHENLCERFSEVRLKGVLLDGTTRLRRRKSGEPLRIFLGGLWAQEAVVPASAVAKLPPRLANRPELAMLGCAFLTAYGAVVNSGSVQPGDTVAVIGTGGVGLAIVQVARAVGARVIAVGRNPEKLKLAAEMGAEVVNARDGDAVAEVRKLTDGRGADVVVEAVGSEQTVEQAIDMASTGGRVVLVGLMGLGKKAPLHVARVVRGGISVIGSYGARPRVDLPKVIGMVERGLLRPELMARDFYKLEQINEAVEALRSGRSIRPIVLP

SEQ ID NO: 13305 - protein, 331 aa, Shewanella sp. ANA-3
MISSQIHLASRPVGMPTLANFKQVEVTLPALKAGEVLVKNTWMSVDPYMRGRMMDRDSYIPPFQIDAVMDGGAIGEVIESLNPQFPVGSKVSHISGWRSAFISDGQDLTLLPAVNIPEQYFLGVIGMPGLTAWVGLMQIAKLKPTDTVFVSAASGAVGMVVCQIAKLNGCKVIASVGSDEKAELVQSLGVDAVINYKKVTDLTQALRDAAPNGIDVYFENVGGAHLEAALNVLNEYGRIPVCGMIADYNAQAPVSGPSNLLAINTKKLTMQGFIVMDYFDQFEEFIAQMAQWLQAGKVKSQETVYHGLDQAAEAFIGLFEGKNKGKMLVKL

SEQ ID NO: 13306 - protein, 142 aa, Salinibacter ruber DSM 13855
MATERTLAILKPDCVRKEKVGEVLRRIQDAGFQLCAMKMITMSKAEAEGFYAVHEDKPFFDDLTDFMSSGPCVPVVLEKENAIADFRELIGATDPDEAAEGTIRSDFAGSIQENIVHGSDSPSNGQKEAGYFFPEHEIVANT

SEQ ID NO: 13307 - protein, 410 aa, Pyrococcus furiosus DSM 3638
MFRLRDFEYYNRTVFLRVDLNSPMSNGKIISDARFRAVLPTIKYLIESGAKVVVGTHQGKPYSEEYSTTEEHARILSELLNMHVEYVEDIFGKYARERIKAMKPGEVIVLENLRFSAEEVKNATIEECEKTFFVRKLSQVIDLVVNDAFAAAHRSQPSLVGFARIKPMIMGFLMEKEVDALTKAYESEEKPRVYVLGGAKVDDSLKVAENVLRKEKADLILTGGLVGQLFTLAKGFDLGRENIKFLEKKGILKYVDWAEKILDEFYPYVRTPVDFAIDFKGERVEIDLLSDEKRLFDEYPILDIGSRTVEKYREILLKARIIVANGPMGVFEREEFAVGTIGVFKAIGESPAFSVIGGGHSIASIYKYNITGISHISTGGGAMLTFFAGEKLPVLEALKISYEKFSNLLS

SEQ ID NO: 13308 - protein, 366 aa, uncultured environmental landfill bacterium
  misc_feature (212)..(212): Xaa can be any naturally occurring amino acid
FTGDFHAIGAANNLLAAMVDNHIFQGNVLDIDVRRVVWRRAVDMNDRQLRNIVDGLGGKAQGMPREDGFDITVASEVMAIFCLSKDIIDLKERCARIVVAYNRKGEPVTAGDIKAEGAMAALLKDALKPNLVQTLEGTPAFVHGGPFANIAHGCNSVLATRFAMNYADYVVTEAGFGADLGAEKFIDIKCRMNDLKPDAVIIVATVKALKYXGGVPKTELGPENLEALEKGLPNLLKHVENITQVFKLPAVVAINRFPTDTEAELKLVEDRCKELGVNVALSEVWGKGGEGGVALANEVIRLTAEESNVEYAYDLEDSIKDKIKKICQKVYGADDVVYSAKADKEIVNFEKLGFGNMPICMAKTQY

SEQ ID NO: 13309 - protein, 366 aa, uncultured environmental landfill bacterium
FTGDFHATTTSHNLISAMLDNHIQQGNILGIDPRRIVWHRVLDMNDRALRNVVVGLGGKPNGMPREDHFDITVASEIMAIFCLANDLEDLKERVSNIIIAYNFAGEPVYVKDIKAQGAVALLMKDAMAPNLVQTLENTPALIHGGPFANIAHGCNSMTATKLGLKLAEYTITEAGFGADLGAEKFFDIKARFGELKPNATVIVATVRALKHHGGAKKEELGTENLEQLAAGFENLEKHIENMNKFGVPSVVAINKFPTDTDAELNYVIDKCKELGAEAVLSEVWGKGGEGGIELAKKVVEVCETKEANFKPLYDEEETIKGKIEKIAEEIYGADGADFTNSANKDIAQAEKLGYDKMPICMAKTQY

SEQ ID NO: 13310 - protein, 329 aa, Zea mays
MSSRMAGAALLRHLGPRLFAAEPVTGLAARGVMPAAARILPARMSSTAAEAAKEAAAPQQRQKPEAAAAAPEGQDKKAVVSYWGIEPRKLVKEDGTEWRWFCFRPWDTYRADTSIDMKKHHEPKALPDKLAYWLVKSLVVPKQLFFQRRHASHALLLETVAAVPGMVGGMLLHLRSLRRFEHSGGWIRALLEEAENERMHLMTFLEVAQPKWWERALVLAAQGVYFNAYFVAYLASPKFAHRFVGYLEEEAVHSYTEYLKDLEAGIIDNTPAPAIAIDYWRLPADARLKDVVAVVRADEAHHRDVNHFASDIHYQGMKLRDTPAPLGYH

SEQ ID NO: 13311 - protein, 496 aa, Streptomyces coelicolor A3(2)
MLDQGAPPPHDASAVPPSPGLAARLMRRKPVERLVAEGGQGEGGSLRRSLGLWQLTMISIGATLGTGIFVVLGEAVPKAGPAVTLSFVIAGLTALFSALSYAELAGTIPVAGSSYSYAYATMGELVAWICGWCLVLEYGVSVAAVAVGWGEYLNELLDGTIGVTLPAALSAPPGDGGIFNLPALIVVLLAMTFLLGGARESACANTIMVVVKIAALVLFCAIGVQGFRSGNYEHFMPLGMAGVSAAGATLFFSYIGFDAASTAGEEAKNAQRDLPRAIMLSLVIVTVLYVLVAAVAVGAKPWRTFTDSEASLAQIMTDVTGQSFWGTLLAFCAVVAIASVVLTVLYGQTRVLFAMSRDGLVPKVFSKVHPKTGAPRANTLIVSLFCGVLAAAVPLGQLADATSIGTLFAFALVNVAVVVLRRTRPEMRRTFRVPLSPVLPALGFGLCVWMMGSLSTVTWVVFGVWMAVGLVFYFVYGHRRSRLATPVPSEARTHQK

SEQ ID NO: 13312 - protein, 441 aa, Triticum aestivum
  misc_feature (60)..(60): Xaa can be any naturally occurring amino acid
  misc_feature (406)..(406): Xaa can be any naturally occurring amino acid
  misc_feature (437)..(437): Xaa can be any naturally occurring amino acid
MGQKDSKPSYNSADYGNSANGYNSRYANTPSSYSPRYASSAGNNVQQPEAQARLQRKYSXRIGDDYRSVSQVTEALAQAGLESSNLIVGIDFTKSNEWTGKISYNRRCLHDIGNTPNPYEQAISIIGRTLSAFDEDNLIPCFGFGDASTHDQEVFSFYPENQPCNGFEEALERYREIVPTLRLAGPTSFAPIIETAIGIADSTGGQYHVLLIIADGQVTRSVDTQSGQLSPQERDTIDAIVKASHFPLSIVLVGVGDGPWDMMHKFDDNIPARSFDNFQFVNFTEIMSKSIAADRKEAEFALSALMEIPTQYKATLDLQLLGRRQGIPPRVPLPPPTRTPYSRSTSFDQQSGVYSRSSSFGQQTSGFQQSDSFKQRQHAATRRPDSHPSESSESTLSCAICMDKSXDLAFGCGHQTCYDCGGKLVRCPMCQKHITTXIRLY

SEQ ID NO: 13313 - protein, 228 aa, Candidatus Kuenenia stuttgartiensis
MDAYKKYLAEFVGTFALVFIAAGAVCADFYLKQSGGQGFGLLGISIAYGVVVIAVIYAMGYVSGSHINPAVTISFWITKRMEPNTAIMYIISQIGGAILGGFALRTIFPDALSSIHLGTSTLAAGVSIERGILMEFIISFLLIFTIYGTLVDKRASGGFAGLAVGLVVLFGSLVGGTISGGAMNPVRVFGPAIASGQFTNHYVWWIGPILGGIAAGIVYDKLFAERKK

SEQ ID NO: 13314 - protein, 296 aa, Yersinia pseudotuberculosis IP 32953
MSQKELWYETLHANFGQYFSVENVLYREKTEHQDLVIFENPELGRVMALDGVVQTTERDEFIYHEMMTHVPLLAHGQAKKVLIIGGGDGAMLREVSRHKNIEQITMVEIDAGVVEFCRQYLPNHSAGAYDDPRFKLVIDDGVNFVNQTTEKFDVIISDCTDPIGPGESLFTSVFYEGCARSLNEGGIFVAQNGVCFLQQDEAVNSHNKLSHYFSDVSFYQAAIPTYYGGIMTFAWATQNPALRQLDLATLQNRFAQAGLACRYYNPAIHVGSFALPQYLLDALTTIPKVIGVDSSE

SEQ ID NO: 13315 - protein, 376 aa, Anabaena variabilis ATCC 29413
MARDYYEILGVARDADKEEIKQAYRRLARKYHPDVNKEPGAEERFKEINRAYEVLSEPETRARYDRFGPEGVSGAGVGFQDMSDMGGFADIFESIFSGFAGGGMGGPTQQRRRGGPARGDDLRLDLKLDFREAVFGGEKEIRISHLETCETCSGSGAKPGTRPRTCSTCSGSGQVRRVTRTPFGSFTQVSTCPTCNGTGMVIEDKCDACDGKGTNQVTKKLKITIPAGVDNGTRLRIQQEGDAGQRGGPPGDLYVYLFVNEDEEFQRDGINVISEIKVSYLQAILGCRLEVNTVDGPVELIIPAGTQPNTVMKLENRGVPRLGNPVSRGDHLLTVLIDIPTKVIPEERELLEKLAKIKGDRTGKGGLEGFLGNLFK

SEQ ID NO: 13316 - protein, 286 aa, Frankia sp. EAN1pec
MTGPRTVLITGATDGHGRALAHRLAAEGTTLILHGRDPDKLARTADDIQTTHRVSRPRTMQADLAELAQVRRLASDVQAVADRLDVLVSNAGIGAGHPDGHTRRTSVDGYELRFAVNYLAGFLLTLDLLPLLRRSAPARIVNVASIGQHPLDLGDLMIERGYSGTRAYGQSKLAQIMSGFELAQRLPGAEVAVNSLHPATYMPTKIVLAEIGHHIDSIDDGVSATHRLVTDAAFAGVTGRFFDRTSDTRPNIQAYDEQARAELWRRSLELVDRSGVHGRGVRGVMI

SEQ ID NO: 13317 - protein, 508 aa, Medicago truncatula
MKFIDFLFALKPLFPILIAIALAGFIIKIHGSRFFDKKRRYHPVAGTVLHQLFNFHRLLEYMTDLTSKRKTYRLLSFNRSEVYTSDPANIEHMMATNFSNYGKGWYHHSVLEDLLGDGIFTVDGEKWRHQRKSASYQFSTKLLRDFSSSVFKSNAVKLAGIVSEAATSNNIIELQDLFMKSTLDSVFKGILGVELDTMCGTYREGTQFSNAFDEASAAIMFRYVNFLWKVQRFLNMGSEAVLKKNLRVIDEYVYTVIRSKIEQSQKPQNNSSELKGDILSRFLELNETDSKYLKDVILSFIIAGKDTTAITLSWFLYQLCKHPHVQEKIAQEIMEATKVEDGSTIDELAARLTEESMEKMQYLHAALTETLRLHPPVPVESKYCFSDDTLPDGYSVTKGDLVSFQPYVMGRMKFLWGEDAEQFRPERWLDENGNFQRESPFKFTAFQAGPRICLGKEFAYRQMKIFSAVLLGSHSFKLADQNKLVKYRTSLTLQIDDGLHVNAFHRNK

SEQ ID NO: 13318 - protein, 350 aa, Chroodactylon ornatum
VVIDNGSGRCKCGIAGEDSPKSVFPAVVGVPKQKGIMVGAGQKEDYVGDAAMARRGVLLIKYPLEHGIVTNWDDMEKIWHHAFYNELRVDPQEHPTLLTEAPLNPKANRERMTQILFESFNIPAFYVAIQAVLSLYASGRTSGIVIDSGDGVTHAVPIYEGYSLPHAVLRIDLAGRDLTGWMAKLLMQSGYSFTTSAELEIVRDIKQQLCYVAEDYEKELAAGKSNPSLEKEYELPDGQIITVTTERFQCPEALFKPEMLGNEMAGMHLTCFNSIMKCDIDIRKDLYNNIVMSGGSTMFAGIANRVQKEIEALAPSSMKIKVIAPPERQYSVWIGGSILASLSTFQQMWV

SEQ ID NO: 13319 - protein, 280 aa, Zea mays
SARVLSRVQHKNLVKFIGACLEPVMVVVTELLVGGSLRKYLVSLRPRSLEPRVAVGFALDIARAMECLHAHGIIHRDLKPENLLLTADQRTVKLVDLGLAREETLTEMMTAETGTYRWMAPELYSTVTLRHGEKKHYNHKVDVYSFAIVLWELLHNKLPFEGMSNLQAAYAAAFKNIRPSADNLPEELSEILTSCWKEDPNDRPNFTQIIQMLLHYLSTLSPQETLAGPRRTFSSENTILPPESPGTSSLMASRGDLGDTPKGKKEDKPRGFFFCFSECY

SEQ ID NO: 13320 - protein, 402 aa, Helicobacter hepaticus ATCC 51449
MFDEIEFDKIKRLPKYVFAAINEIKLEMRRNNEDVIDFSMGNPDGATPEHIIQKLCEAAQKGKNQGYSVSRGIYKLRLAICNWYKRTYGVELDPESEACVTMGSKEGYVHLVQAIANPGDNAIVAEPAYPIHYYAFILNGANVSTFGLKWNEQMELDVEDFFINIKRVLKEVMPRPKFVVVNFPHNPTTIVVYREFYERLVAFAKQERFYIISDIAYAELCFDGFKTPSILEIEGAKDVAVESYTLSKTYNMAGWRVGFVVGNKKIIQALQKIKSWIDYGIYTPLQIAATIALEGDQSCVKDIKNTYEKRMEILIKSFGEAGWEMKKPKASMFIWAKLPECVGDMGSLEFSKRLLKEAKIAVSPGVGFGDYGEGYVRIALIENEKRIRQAARNLKSFLKQFQ

SEQ ID NO: 13321 - protein, 427 aa, Burkholderia xenovorans LB400
MSAIVDIIGREILDSRGNPTVECDVLLESGTMGRAAVPSGASTGSREAIELRDGEAGRYGGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILSDRGMSTAVGDEGGFAPNFGSNDECLSTILQAIEKAGYRAGEDVLLALDCAASEFYHDGKYQLAGEGLQLSSTEFTDYLANLADKFPIVSIEDGMHESDWAGWKTLTDKLGKKVQLVGDDLFVTNTRILKEGIEKGIANSILIKINQIGTLTETFAAIEMAKRAGYTAVISHRSGETEDSTIADIAVGLNAGQIKTGSLSRSDRISKYNQLLRIEEDLGDIASYPGKSAFYNLR

SEQ ID NO: 13322 - protein, 513 aa, Medicago truncatula
MLFQSIMDFLSNPLLFAALSASLTLLLVQLLLRKLNNKSNSMKKKKYHPVAGTVFNQMMNFNRLHHYMTDLARKYKTYRLLNPFRSEVYTSEPSNVEYILKTNFENYGKGLYNYQNLKDLLGDGIFTVDGEKWREQRKISSHEFSTRMLKDFSTSIFRKNAAKVANIVSEAANSNTKLEIQDIFMKSTLDSIFNVVFGTEIDSMCGTSEEGKNFANSFDNASALTLYRYVDVFWKIKKFLNIGSEAALRNNTEILNEFVIKLINTRIQQMKNSKGDSVRKGGDILSRFLQVKEYDTKYLRDIILNFVIAGKDTTGGTLSWFMYMLCKYPAVQEKAAQEVREATNTKTVSSCTEFVSSVTDEAIEKMNYVHAVLTETLRLYPALPFDAKICFADDTLPDGYSVKKRDMVSYQPYAMGRMKFIWGDDAEEFRPERWLDENGIFQPECPFKFTAFQAGPRICLGKEFAYRQMKIFSAVLLGCFRFKLNDEKKNVTYKTMITLHIDGGLEIKALYRN

SEQ ID NO: 13323 - protein, 222 aa, Idiomarina baltica OS145
MSASDKLKQQAAQAAIKYVEKGAIVGVGTGSTVNFFIDELAKIKDDIEGAVSSSDASTERLKQHGIEVFELNNAPEVPVYIDGADEIDEHGQMIKGGGAALTREKIVAAVAKKFVCIADESKLVGRLGTFPLPVEVIPMARSYVAREIVKLGGDPVWRQGVTTDNGNWILDVHNFDILNAVELEEQLNNVVGVVTNGLFAARSADVALLATSEGVKELTWGN

SEQ ID NO: 13324 - protein, 515 aa, Medicago truncatula
MNAPLLLSSFSFNQLIPYLICFILFLLLIEQISYLNKKRSIPGPSLVLPFIGNAISLVRDPTKFWEVQSTLSKSAGFSANYIIGLFIVFIRDTELSHKVFSNVKPNAFHLVGHPFGKKLFGEHNLIYMMGQEHKNLRRRIAPNFTPKALSTYTELQQIIILKHLKSWLHKSHAQAHESFPIRVLTRDMNLETSQTVFVGPYLGLKARERFEHDYFLFNVGLMKLPFDFPGTAFRNARLAVDRLAGTLGGCTAASKEKMEKGEEPSCLIDFWMQDTLREIEESKLNGVTVPPFSTNAEIGGYLFDFLFAAQDASTSSLLWAVTLLDSHPEVLARVREEVAGIWSPESNTLITSEQLREMKYTQAVAREVIRYRPPATLVPHVAAEPFPLTESYTIPKGAIVFPSAFESSFQGFTEPDRFDPDRFSEERQEDQIFKRNFLAFGAGPHQCVGQRYALNHLVLFIAMFTSLIDFKRDRTDGCDEIVYVPTICPKDDCRVFLSKRCTRYPSLPGVEELVK

SEQ ID NO: 13325 - protein, 515 aa, Arabidopsis thaliana; identical to SEQ ID NO: 852

SEQ ID NO: 13326 - protein, 325 aa, Thermoproteus tenax
MAEGRCSQGKEPAEAMISLVALGEPLIQLNAVTPGPLRYVAYFEKHVAGSEANFCIAATMAGARCSLIARVGDDEFGRNIVEYLRGRGVDVSHVKVDPGAPTGIYFVQRHFPVPGRSRLIYYRKGSAGSRVGPDDVDSSLISSADAVHSTGITLALSDSANRAVHKAFGEAKRRTFDTNIRPALWPDLAAARRAILDVLNYGVDVLVTDPDDTQILLGVRDPEEAYRKYRELGVQTLVYKLGAEGAYVFWNGGSYFRDALKVAVEDPTGAGDAVAGYFVALYLSGVDPRRALDLAVAASALVVGVRGDNEALPSPREAEELLKAL

SEQ ID NO: 13327 - protein, 185 aa, Glycine max
  misc_feature (70)..(70): Xaa can be any naturally occurring amino acid
  misc_feature (118)..(118): Xaa can be any naturally occurring amino acid
MQTSLLRELVVGTPVISATYDRPQKSVNRYLPGPATQCQYSTTTSKQMRLRTNISETVKRKLSLGARILXVEEGERLLKVSQCYLSTTSGPGPLAGFLFISTDKVAFCSERSMKVFTXKGHMLRIRYKVAIPLNKIKCVNQSQNVQKPTQKYIEIVTEDNFDFWFMGVLKYQKTFKYLEQAVSQA

SEQ ID NO: 13328 - protein, 355 aa, Salinibacter ruber DSM 13855
MPDASSAATNGRASADASSADGESFPLDRPVPTTLDDIRVPVEDDLDAFRSYFREAMRSDHMLLDKVTQYVLWQKGKRIRPILVLLSAQACGGAATDQTHRAAALVELLHTATLVHDDVVDDAEERRGVFSINALWKNKIAVLLGDFLLSRGLLLSLDHDDYSVLHTLSDAVRRMSEGELLQIEKSRLLDIDEETYFRIISDKTASLISACTKSGAVSVTDDEALIERMDEFGETLGLAFQIRDDLFDFSAEDAGKPIGIDLQEKKMTLPLIVALREAGRREKKRILAIVDQDEKDRDDLRTIADFVDEYGGIEHARRKMESLAADARSLLSALPPSEARASLAGLTEFAIQRSR

SEQ ID NO: 13329 - protein, 433 aa, Shewanella oneidensis MR-1
MRFESFSFCPEILRAISDCGYQKMTPIQQQAIPAIRRGQDVLASAQTGTGKTAAFALPILQKMVENPSETLKSNTRVLILTPTRELAAQVAENVEAYSKYLNFSVLTIYGGVKVETQAQKLKRGADIIVATPGRLLEHLTACNLSLSSVDFLVLDEADRMLDMGFSADIQKILQAVNKKRQNLLFSATFSSAVKKLANEMMIKPQVISADKQNTTADTVSQVVYPVEQRRKRELLSELIGKKNWQQVLVFTATRDAADTLVKELNLDGIPSEVVHGEKAQGSRRRALREFVSGKVRVLVATEVAARGLDIPSLEYVVNFDLPFLAEDYVHRIGRTGRAGKSGVAISFVSREEERTLADIEKLIGQKIRRITVPGYEVGSRDLLLKQLQTRRSFAKKQQRQDNVSEQMIAEKSMQGRRVKMKVGQAPSKAKKLK

SEQ ID NO: 13330 - protein, 212 aa, Secale cereale
MDAADAGSPRFGHRTVCSEPPKRPAGRTKFKETRHPLYRGVRRRGRLGQWVCEVRVRGAQGYRLWLGTFTTAEMAARAHDSAVLALLDRAACLNFADSAWRMLPVLAAGSSRFSSAREIKDAVAVAVVEFQRQRPFVSTSETADGEKDVQGSPRPSELSTSSDLLDEHWFSGMDAGSYYASLAQGMLMEPPAARAWSEDGGEYSGVHTPLWN

SEQ ID NO: 13331 - protein, 268 aa, Secale cereale
MDVADIASRSGQQQQGHRTVSSEPPKRPAGRTKFHETRHPLYRGVRRRGRVGQWVCEVRVPGIKGSRLWLGTFNTAEMAARAHDAAVLALSGRAACLNFADSAWRMLPVLAAGSFGFDSAREVKAAVAVAVVAFQRKQIIPVAVAVVALQKQQVPVAVAVVALQQRQVPVTVAVVALQKLQVPVAVAVVALQKKQIILPAACLAPEFYMSSGDLLELDEEQWFGGMDAGSYYASLAQGMLVAPPDDRARPENGEQSGVQTPLWSCLFD

SEQ ID NO: 13332 - protein, 331 aa, Candida albicans
MPSLDDILKPVAEAVKNGKKVTFFNGAGISTGAGIPDFRSPDTGLYANLAKLNLPFAEAVFDIDFFKEDPKPFYTLAEELYPGNFAPTKFHHFIKLLQDQGSLKRVYTQNIDTLERLAGVEDKYIVEAHGSFASNHCVDCHKEMTTETLKTYMKDKKIPSCQHCEGYVKPDIVFFGEGLPVKFFDLWEDDCEDVEVAIVAGTSLTVFPFASLPGEVNKKCLRVLVNKEKVGTFKHEPRKSDIIALHDCDIVAEKLCTLLGLDDKLNEVYEKEKIKYSKAETKETKMHEIEDKLKEEAHLKEDKHTTKVDNKEKQNDANDKELEQLIDKLKI

SEQ ID NO: 13333 - protein, 447 aa, Sinorhizobium meliloti 1021
MPINITMPALSPTMEEGNLAKWLVKEGDKVKSGDVIAEIETDKATMEVEAVDEGTVAKIVVPAGTEGVKVNALIAVLAAEGEDVATAAKGGNGAAGAVPAPKPKETAETAPAAAPAPAAAPAPQAAAPASPAPADGEGKRIFSSPLARRLAKEAGIDLSAIAGSGPHGRVVKKDVETAVSGGAAKPAGAPAAAPAPATLAKGMSEDAVLKLFEPGSYELVPHDGMRKTIAKRLVESKQTIPHFYVSVDCELDALMALRAQLNAAAPEKDGKPVYKLSVNDMVIKALALALRDVPDANVSWTDQNMVKHKHADVGVAVSIPGGLITPIVRQAELKSLSAISNEMKDLGKRAKERKLKPEEYQGGTTAVSNMGMMGVKDFAAVVNPPHATILAVGAGEDRVVVRNKEMVIANVMTVTLSTDHRCVDGALGAELLAAFKRYIENPMGMLV

SEQ ID NO: 13334 - protein, 545 aa, Mesorhizobium sp. BNC1
MSAYARALDALRQHRRETEDFDLRQAFGADPDRFSRCSAALDDMLLDYSKCAVSDETLALLDKIAEAAGVIERREEMFSAKRINVTENRAVLHTALRNDSTRPVMLDGKDVMPDVEAVLAAMSTFSEGIRSGTIKAATGKSFTDVVNIGIGGSDLGPAMATLALAPYHDGPRLHYVSNVDGAHIHDTLKALDPDTTLFIIASKTFTTIETMTNAGTARSWIAEKLGQDAVGSHFAAVSTALDKVAAFGIDESRVFGFWDWVGGRYSLWSAIGLPIMIAIGPENFRRFLDGAELMDRHFREAPSRENLPMMLGLIGFWHRVICGYPARAVIPYDQRLARLPAYLQQLDMESNGKRVTFEGESVTVPTGPLVWGEPGTNGQHAFFQLLHQGTDIIPVEFMIAARGHEPELKHHHDLLIANCLAQSEALMKGRTLQEAKAQLLAKGMSEAEADKLAPHRVFPGNRPSVTIIYEKLDPFTLGRLIALYEHRVFVEAALFRINAFDQWGVELGKELATELLPVVEGKKDASGRDSSTAGLVAQIAALRDS

SEQ ID NO: 13335 - protein, 414 aa, Shewanella sp. ANA-3
MDHFLYQDNTLYAEGCRVNDLAQQYGTPLYIYSRATLERHWHAFNNAVADHPHLVCYAVKANSNLAVLNVLARLGSGFDIVSGGELARVIEAGGDPAKVVFSGVGKTVAEMEQALNLGIYCFNVESSAELEQLNDVAGRLGKVAPVSLRVNPDVDAGTHPYISTGLKENKFGIAMDEAEVVFARAHALPHLQVKGVDCHIGSQLTEIQPFLDAMDRMLALIDRLADQGIVIEHFDVGGGLGVTYDDETPPHPDVYAAALLARLGDRKLKLIFEPGRAIAANAGIFVTQVLYLKENSDKRFAIVDGAMNDLIRPALYSAWQNIIPVNPRDEQAQVFDIVGPVCETGDFLGKDRALAIAAGDLLVVRSSGAYGFAMASNYNTRPRAAEVMVDGDKAYLVREREKLAQLWQGEQLLP

SEQ ID NO: 13336 - protein, 395 aa, Medicago truncatula
FPKTNYKIFPLLASGLASYGGEKWSKHRRLINPAFHLEQLKIMTPAFFTSCNDMISKWEEMLSSDGSCEIDVWPSLQNLASDAISRTAFGSSYEEGKRIFQLQREQAELITTVVMKSTIPLWMFLPIFVHRKMNEIDKEITSSLKDMINKREKELKAGESTKNDLLSILLESNHKEIENNNNNKSVGMSLDHVVEECKLFHFAGQETTSVLLVWTMILLSRYPDWQTRAREEVLHVFGNKKPDFDGLNNLKIVTMILYEVLRLYPPVMGLARNVVKDMKLGNLTLPAGVEVFLPILLIHHDCKLWGDDAKMFNPERFSGGISKATNGRVSFFPFGWGPRICIGQNFSLMEAKMALSMILQHFSFELSSTYAHAPSTVITLQPQYGAHIIIRKVET

SEQ ID NO: 13337 - protein, 247 aa, Prosthecochloris aestuarii DSM 271
MIKLVLLRHGESQWNRENRFTGWRDIDLSEKGLAEAANAGVLMKEEGLTFDIAYTSVLKRAIRTLWNALDTMDLLWVPVEKTWRLNERHYGSLQGLNKTETAQLHGEEQVLVWRRSYDTPPPPLEKTDERYPGNDPRYASLSSEEIPVAECLKDTVARFLPYWHETIAPQIKAGKKVLIVAHGNSLRALVKYLDNISEEDIVGINIPTGIPLVYELDDDLKPIRHYYLGDQEAAAKAAAAVANQAKG

SEQ ID NO: 13338 - protein, 471 aa, Pyrococcus furiosus DSM 3638
MCLITGGINLTKEEIVKMIITGKHRGPDSFGVWSDGLVIKSEDFSEIKEIRGGNVVLAQCRLAMTGSKNYTQPFYNDIVLVHNGEIYNHESLRKWLIERGASFESDVDSEVILRLLEYFIFDKKMKVEEAVKKAMLMLRGDYAVAFALNGKIYLFRDPIGVRPLYYSPRGRFGSEKKVLWSVGEEAIPVNPGELVKLPEEEKMKLLSPWDIKGSGKGYYDGLKNLLQDAVRIRTAKKVGVLFSGGLDSSLIALLASKYSKVVLYTAGTEDSKDVEWARKVSDELRLELREYIFTREEVEREIKNVMFAIEEPNPMNLAIAIPLYFATKLARKDDVKVLLSGQGADELFGGYAKYLENPSLMRKDIEEIAERNLGRDDKVGMLNGVEVRYPYLDLPFVSLALRVPLEEKIREGVRKAILRRIALDFGLPEEVAFREKKAAQYGSNAQKILSKIAKKSLREFAQKLFSEVFST

SEQ ID NO: 13339 - protein, 270 aa, Secale cereale
MDVADIASPSGQQEQGHRTVSSEPPKRPAGRTKFHETRHPLYRGVRRRGRVGQWVCEVRVPGIKGSRLWLGTFNTAEMAARAHDAAVLALSCRAACLNFADSAWRMLPVLAAGSFGFGSPREIKAAVAVAVIAFQRKQIIPVAVAVVALQQQQVPVAVAVVALKQKQVPVAVAVVALQQLHVPVAVAVVALQQQQIILPVACLAPEFYMSSGDLLELDEEHWFGGMDAGSYYASLAQGMLVAPPDERARPENGEQERRPDAAMELFVRLI

SEQ ID NO: 13340 - protein, 186 aa, Nicotiana tabacum
IYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNRKIHHSVVGLRSCISEGAIIEDSLLMGADYYETDADRRFLAAKGSVPIGIGKNSHIKRAIIDKNARIGDNVKIINS

SEQ ID NO: 13341 - protein, 168 aa, Triticum aestivum
  misc_feature (149)..(149): Xaa can be any naturally occurring amino acid
  misc_feature (167)..(167): Xaa can be any naturally occurring amino acid
MGSASAASLPTSAGAGENLVLILDFGSQYTHLITRRVRQLGVLSLCVSGTAPLSSLAGLRPRAVVLSGGPHSVHADGAPSFPEGFLDFAAGAGAHVLGVCYGMQLLVQTLGGAVEPGVRQEYGDMEVEVTAPSSALYGEQGKRQSVWMXHGDEVVRLPEGFEVVARXV

SEQ ID NO: 13342 - protein, 444 aa, Xylella fastidiosa 9a5c
MNHSRSHTLFVQAQTRIPGGVNSPVRAFRSVGGEPFFVARADGPYLFDVDGHRYIDYVGSWGPMIVGHNHPAVREAVQVAISNGLSYGAPCAAEVTMAETIARLVPSCDMVRMVNSGTEATLSAIRLARGATGRNHIVKFEGCYHGHGDSFLVKGGSGMLTLGMPSSPGVPAELSKLTITLTYNDFDAATALFEEMGHHIAAVIVEPVIGNANCIPPRPGYLQHLRTLCTQYAVLLIFDEVMTGFRVALGGAQALYGVTPDLTTFGKIIGGGMPVGAYGGCRDLMQHIAPAGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPDIIEATLEAARAAFQTIANEAAILSESEAPLKMP

SEQ ID NO: 13343 - protein, 266 aa, Shigella flexneri 2a str. 2457T
MTEPLTETPELSAKYAWFFDLDGTLAEIKPHPDQVVVPDNILQGLQLLATASDGALALISGRSMVELDALAKPYRFPLAGVHGAERRDINGKTHIVHLPDAIARDISVQLHTVIAQYPGAELEAKGMAFALHYRQAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITAALQQKRENNRSDDYESFSRSI

SEQ ID NO: 13344 - protein, 1102 aa, Streptomyces coelicolor A3(2)
MPKRTDIQSVLVIGSGPIVIGQAAEFDYSGTQACRVLKAEGLRVVLVNSNPATIMTDPEIADATYVEPITPEFVEKIIAKERPDALLPTLGGQTALNTAISLHGNGVLEKYGVELIGANVEAINKGEDRDLFKEVVEEVRKKIGHGESARSYICHSMDDVLKGVDALGGYPVVVRPSFTMGGAGSGFAHDEDELRRIAGQGLTLSPTTEVLLEESILGWKEYELELMRDKNDNVVVVCSIENFDPMGVHTGDSITVAPAMTLTDREYQTLRDVGIAIIREVGVDTGGCNIQFAVNPEDGRVIVIEMNPRVSRSSALASKATGFPIAKIAAKLAVGYTLDEIPNDITQETPASFEPTLDYVVVKAPRFAFEKFPSADSTLTTTMKSVGEAMAIGRNFTEAFQKALRSLEKKGSQFTFVGEPGDKDELLREAVRPTDGRINAVMQAIRAGATPEEVFDATKIDPWFVDQLFLIKEIADEIAESRELTADLLTEAKRHGFSDQQIAEISGLGEDVVRQVRHALGVRPVYKTVDTCAAEFAARTPYFYSSYDEESEVAPREKPAVIILGSGPNRIGQGIEFDYSCVHASFALSDAGYETVMVNCNPETVSTDYDTSDRLYFEPLTLEDVLEIVHAEQQAGPVAGVIVQLGGQTPLGLSQALKDNGVPVVGTSPEAIHAAEDRGAFGRVLAEAGLPAPKHGTATTFGEAKAIADEIGYPVLVRPSYVLGGRGMEIVYDETRLEAYIAESTEISPSRPVLVDRFLDDAIEIDVDALYDGEELYLGGVMEHIEEAGIHSGDSACALPPITLGGFDIKRLRASTEGIAKGVGVRGLINIQFALAGDILYVLEANPRASRTVPFTSKATAVPLAKAAARISLGATIAELRAEGLLPALGDGGTLPLDAPISVKEAVMPWSRFRDIHGRGVDTVLGPEMRSTGEVMGIDSVFGTAYAKSQAGAYGPLPTKGRAFISVANRDKRSMIFPARELVAHGFELMATSGTAEVLKRNGINATVVRKQSEGTGPNGEKTIVQLIHDGEVDLIVNTPYGTSGRLDGYDIRTAAVARSVPCLTTVQALAAAVQGIDALNHGDVGVRSLQEHAAFLIAARD

SEQ ID NO: 13345 - protein, 347 aa, Coprinopsis cinerea okayama7#130
MPESDIPRGHLAVSKWFAPTKLVITFEREGLGKFTQEDIESYIQRNEQGEPVSLNLPTKFVFVQTYADWWYAWCFTYFSSPKGVHKYVYITLKKSLRWVPIVGWGMQFFNFIFLARSWASDRLQLASDLASLGKAAEREHRPFCFMLYPEGTLVSKDTRPISKKFADKIGVDDLKHVLLPRSTGLHYSLRSLSPRIQKLKLLDATTVYPGVPPMGYGQNYYTLRSIFFDGVPPPAIHLHLRMFDVRTDVPIGDLSSTKSTPGEKGATPEVEIPPAEKEIFDAWLRQLWQEKDSTIETFHSSGSFSRQPDTTVVEVPLQLRRKWEVLDAFCFFWPAALAYSLKRMREQ

SEQ ID NO: 13346 - protein, 426 aa, Yersinia pseudotuberculosis IP 32953
MSKSENLYAQAQQLIPGGVNSPVRAFTGVGGIPLFIERADGAYLFDVDGKAYIDYVGSWGPMILGHNHPAIRQAVIEAVERGLSFGAPTEMEVKMAQLVTDLVPTMDMVRMVNSGTEATMSAIRLARGYTGRDKIIKFEGCYHGHADCLLVKAGSGALTLGQPNSPGVPADFAKHTLTCTYNDLASVRQAFEQYPQEVACIIVEPVAGNMNCIPPLPEFLPGLRALCDEFGALLIIDEVMTGFRVALAGAQDYYHVIPDLTCLGKIIGGGMPVGAFGGRREVMNALAPTGPVYQAGTLSGNPIAMAAGFACLTEISQVGVYETLTELTDSLATGLRHAAKEENIPLVVNHVGGMFGLFFTNADTVTCYQDVMNCDVERFKRFFHLMLEEGVYLAPSAFEAGFMSLAHSNEDIQKTVNAARRCFAKL

SEQ ID NO: 13347 - protein, 406 aa, Mycobacterium tuberculosis CDC1551
MNAHVTSREGVNEFDDGIVIVGGGLAAARTAEQLRRAGYSGRLTIVSDEVHLPYDRPPLSKEVLRSEVDDVALKPREFYDEKDIALRLGSAAVSLDTGEQTVTLADVTVLGYDELVIATGLVPRRIPSLPDLDGIRVLRSFDESMALRKHASAARHAVVVGAGFIGCEVAASLRGLGVDVVLVEPQPAPLASVLGEQIGQLVTRLHRDEGVDVRTGVTVAEVRGKGHVDAVVLTDGTELPADLVVVGIGSTPATEWLEGSGVEVDNGVICDKAGRTSAPNVWALGDVASWRDPMGHQARVEHWSNVADQARVVVPAMLGTDVPTGVVVPYFWSDQYDVKIQCLGEPHATDVVHLVEDDGRKFLAYYERDGVLVGVVGGGMAGKVMKVRGKIAAGAPIAEVLDQTQA

SEQ ID NO: 13348 - protein, 718 aa, Oryza sativa (indica cultivar-group)
MCGADAVRWAGAAGVLRTAAGTGGVPMRKVEPASDRPNGHGRSSNYLERAIVLDEMMKSTVFSAVAVSIGYTLLGWDFTTVLGNPSAEANIHMKKEFGLNNGPSIDGIILAVSVFGSIAITVFSGLLLDWLGRRAALIYSSLLLISGGLLMVWSPNIYILLLARLIVGSGSGLVFTCVPIYISETSPPNMRGSLGTMPQFMFFVGIVFSYCLIFWMTLIPSPNWRIMIGAIFAPSLVYFALLVFYLPESPRWLVSDGKISEARISLQWLRGKDDVSDRSAGEIALIADGMNMITETAVGGHAVGAVRSQSFLGTSTNQMSRHSTFYWHLSDPLVDLLGSIHESMSELGAGRNSYFPVFNSFNIVEQERASEQRGNDSLQQSREAYSAEEGNNGDNLQASLLSQVASAETNDINTSFTSEGSSSYLRRHGTSTSGLAQDLISSLHDHDIEEDDEEIHIAALSSQPALGSGLHPFRQQIVRLSETADIKPKWRVLLQPGVRHALCYGMLIQALQQSAGISGLLRYTPQILEQVGVISLFSDIGLDSHSASILISVLNASLMLPCITVAMILMDVCGRRVLLLVSIPFLTLSVGAISLSNIVKMGSLPHEILFQLSLTICFCSYVIGLGPIPNILCSEMFPTRARATCASFCSLAFWFGRLLSIYCFPVMLSTIGLSGACAIYAFVCCLVLVFVYLRVPETKGLPLELIAEIFKFSRQECL

SEQ ID NO: 13349 - protein, 426 aa, Medicago truncatula
MEVFMFPTGTTIIISVLSVLLAVIPWYLLNKLWLKPKRFEKLLKAQGFQGEPYNLSVFKDKSRQNYMLKLQQEDKSKFIGLSKEAAPSIFTHVHQTVHKYGKKSFLWEGTTPRVIIADPDQIKEVFNKIEDFPKPILKSIAKYLSVGIIHYEGKKWAKHRKIANPAFHLEKLKGMLPAFSYSCNEMISKWKELLSSDGTCEVDVWPFLQNFTCDVISRTAFGSSYAEGEKLFQLLKKQGFLLMTGRQTNNPLWGLLATTTKTKMKEIDREIHDSLEGIIEKREKALKNGEPTNDDLLGILLQSNHAEKQGHGNSKSNGMTTQDVIDECKLFYIAGQETTSSLLVWTMVLLGRYPEWQARARQEVLQVFGNQNPNIEGLNQLKIVTMILYEVLRLFPPLIYFNRALRKDLKLGNVSLPEGTQISLPI

SEQ ID NO: 13350 - protein, 429 aa, Streptomyces coelicolor A3(2)
MSDNSVVLRYGDGEYTYPVIDSTVGDKGFDIGKLRAQTGLVTLDSGYGNTAAYKSAITYLDGEAGILRYRGYPIEQLAERSSFVEVAYLLINGELPTVDELSAFKGEITQHTLLHEDVKNFYKGFPRDAHPMAMLSSVVSALSTFYQDSHNPFDERQRNLSTIRLLAKLPTIAAYAYKKSIGHPFVYPANNLGYVENFLRMTFSVPAQEYELDPTVVAALDKLLILHADHEQNCSTSTVRLVGSSQANMFASISAGINALWGPLHGGANQSVLEMLEGIRDAGGDVDSFIRKVKNKEDGVRLMGFGHRVYKNFDPRAKIIKAAAHDVLSALGKSDELLDIALKLEEHALSDDYFVSRSLYPNVDFYTGLIYRAMGFPTEMFTVLFALGRLPGWIAQWHEMIKEPGSRIGRPRQIYTGVVERDFVPVEER

SEQ ID NO: 13351 - protein, 463 aa, Mycobacterium avium 104
MSRHRVVIIGSGFGGLTAAKALKRVPKGTQVDITLISKTTTHLFQPLLYQVATGILSEGDIAPTTRLILRKQKNVRVLWGDVSAIDLTARTVTSHLMGMDTVTPYDSLIVAAGAQQSYFGHDEYAAFAPGMKSVDDALELRGRILGAFEAAEVATDPAERRRRLTFVVVGAGPTGVELAGEIVQLAERTLAGAFRTITPSECRVILLDAAPAVLPPMGPKLGLKAQRRLQKMDVEVQLNAMVTAVDYMGITVKEKDGAERRIECACKVWAAGVQASALGAMIAEQSDGTETDRAGRVIVEPDLTVKGHPYVFVVGDLMSVPGVPGMAQGAIQGAKYAAGIIKQAVKGQDNPAERKPFRYVNKGSMALISRYSAVAQVGRVEFAGFIAWLAWLLLHLYYLIGHRNRLAAMFAWGISFLGRTRGQMAITSQMIYARPVVEWLERRAQDGTLAAAEHVDSAEKQAG

SEQ ID NO: 13352 - protein, 128 aa, Shewanella oneidensis MR-1
MMKSIIHAERAPTAIGPYSHGTRYGNLIFTSGQLPVCKDKGGVVDGGISEQSVQCLENLKYVLEAGGGSLDTVLKTTCYLSEISDFAAFNEVYKTYFKTDCPARSCFAVKDLPLGVKVEIEAIAHVND

SEQ ID NO: 13353 - protein, 222 aa, Oryza sativa (japonica cultivar-group)
MGSPGAGSSGGGGGGHECSFKILLIGDSGVGKSSLLVSFVVAAAAAHLDDDIAPTIGVDFKIKFLTIGGKKLKLTIWDTAGQERFRTITSSYYRGAQGIILVYDVTKRESFTNLAEVWSKEIESHSSNKDCIKMLVGNKIDKEDERTVTREEGLAFAEESGCLFLESSAKTRDNVEKCFEELALKIMDVPSLLEEGSSSVVKRNILKQKQESQAKHGGGCCQ

SEQ ID NO: 13354 - protein, 174 aa, Candida albicans
  misc_feature (146)..(146): Xaa can be any naturally occurring amino acid
  misc_feature (150)..(151): Xaa can be any naturally occurring amino acid
  misc_feature (154)..(154): Xaa can be any naturally occurring amino acid
TYGTKSYSDSRQWRIPLGLCFAWALCLVAGMVRMPESPRYLVGKDRIEDAKMSLAKTNKVSPEDPALYRELQLIQAGVERERLAGKASWGTLFNGKPRIFERVIVGVMLQALQQLTGDNYFFYYSTTIFKSVGMNDSFETSIIIGXINFXXTFXGIYAIERMGRRLCLVTGSVA

SEQ ID NO: 13355 - protein, 407 aa, Glycine max
MEHSLKRKSPESGDNLLFSSFSLDDLNEDLLERVLSWLPTSSFFRLTSVCKRWKSAAASVSFKLACSRVPLRDPWFLMVAPNLNQSIVFDTAENSWKRLNHPHLPLKDSNISCMPVAASGGLVCYRKLLGNFVVCNPVTGSCTELPPLHFALENQSLNAVVMSTTFNDQMSYKIVLVFGELPNLLFKVYNSSSSCWEDEAALRRNVDDNSLDCDSTDDDNVVYFLSKAGTVVASSMHRSPSKQYSSVITNKDGQEIVYFLSSSGTVVACNLTSRCFLEYPRLLPVFSEYSIDIVECGGEMVVVLLSEFLESTSLRVWKYDEANRCWQQIAAMPAAMSQEWYGKKADINCVGASGRIFICLNSPELCTYVLCDLVTNKWTELPKCCLNGEVMEFMSAFSFEPRIEASV

SEQ ID NO: 13356 - protein, 274 aa, Taxodium distichum
VEQQGIGAKDYIDPPPAPLVDFEEFKLWSFYRALIAEFIATLLFLYITIATVIGHKRTAANCGSVGILGIAWAFGGMIFVLVYCTAGISGGHINPAVTFGLFLARKVSLPRAVLYMVAQCLGAICGVGLVKAFQKSFYDMHGGGANSVAQGYSKGTGLGAEIIGTFVLVYTVFSATDPKRSARDSHVPVLAPLPIGFAVFMVHLATIPITGTGINPARSFGAAVIYGHDKIWDDQWIFWVGPFLGAFAAAFYHQYILRAAAIKALGSFRSNPNV

SEQ ID NO: 13357 - protein, 255 aa, Haemophilus somnus 129PT
MARRPLVMGNWKLNGSKAFTKELITGLKDELNAVSGCDVAIAPPVMYLAEAETALVSSDIALGTQNVDLNKQGAFTGDISTEMLKDFGVKYVIIGHSERRQYHHESDEFIAKKFGVLKDAGLVPVLCIGESEAENEAGKTEEVCARQIDAVMNTLGVEAFNGAVIAYEPIWAIGTGKSATPAQAQAVHAFIRGHIAKQSQAVAERVIIQYGGSVNDANAAELFTQPDIDGALVGGASLKASAFAVIVKAAAKAKN

SEQ ID NO: 13358 - protein, 557 aa, Sinorhizobium meliloti 1021; identical to SEQ ID NO: 1385

SEQ ID NO: 13359 - protein, 559 aa, Helicobacter hepaticus ATCC 51449
MDSNDLERERGITILSKNTAINYKGTKINIIDTPGHADFGGEVERVLKMVDGVLLLVDAQEGVMPQTKFVVKKALGFGIRPIVVVNKIDKPAAQPHRVIDEVFDLFVAMGASDEQLDFPVVYAAARDGYAIKELEDEKKNLEPLFEAILEYVPLPSGAKENPLQMQVFTLDYDNYVGKIGIARVFNGCIKKGENVMLAKSDGEKETGRISKLIGFLGLARTEIESAEAGDIVAIAGFNAVDVGDSIVCPTNPMPLDPMHLEEPTMSVYFAVNDSPLAGLEGKHVTANKIKDRLLKEMQTNIAMRCEEMGEGKFKVSGRGELQITILAENLRREGFEFSISRPEVIIKEENGVKCEPFEHLVIDTPQDFSGAIIEKLGKRKAEMKAMNPMSDGYTRLEFEIPARGLIGYRSEFLTDTKGEGIMNHSFLEFRPFSGSVESRKNGALISMENGDATGFSLFNIQERGILFIAPQTKVYVGMVIGEHSRDNDLDVNPIKAKHLTNMRSSGADEAIKLVPPRDLTLERALEWIEDDEILEVTPQTIRIRKKILEPNMRKRAKAK

SEQ ID NO: 13360 - protein, 107 aa, Lilium longiflorum
RAAPAQASMVAPFVGLKSSSAFPVTQKPATGLPTLPSNGGRVQCMKVWPIVGKKKFETLSYLPTLPVEALLKQIEYLIRSGWVPCLEFSLVGFVSRDYHQSPGYYDG

SEQ ID NO: 13361 - protein, 363 aa, Salmonella enterica subsp. enterica serovar Typhi str. CT18
MSKNYHIAVLPGDGIGPEVMAQALKVMDAVRSRFDMRITTSRYDVGGIAIDNHGHPLPKATVEGCEQADAILFGSVGGPKWENLPPESQPERGALLPLRKHFKLFSNLRPAKLYQGLEAFCPLRADIAANGFDILCVRELTGGIYFGQPKGREGSGQYEKAFDTEVYHRFEIERIARIAFESARKRRRKVTSIDKANVLQSSILWREIVNDVAKAYPDVELAHMYIDNATMQLIKDPSQFDVLLCSNLFGDILSDECAMITGSMGMLPSASLNEQEFGLYEPAGGSAPDIAGKNIANPIAQILSLALLLRYSLDADEAATAIEQAINRALEEGVRTSDLARGAAAVSTDEMGDIIARYVAEGV

SEQ ID NO: 13362 - protein, 337 aa, Zea mays
  misc_feature (92)..(92): Xaa can be any naturally occurring amino acid
MAERRPIYREPRKPRRRPRSQGRVNLSVPMWEKNFCIDACAIPWAKLCETKRLMSLYKSVVDWDDSAALEAFNDAKARFCAVYHGQHYDIPXPDPDMFIDIINPDEYVDPELVADLERSRRRVPRKDNGVSDVWDSFIFSDKTVPVTGWGDTETSFTDGQQVPVNWGNQLKHSVEANHKQMSANWDYSVKRPAQTTGQQNSGKQQDQTSSHGEQTNSCISLSIMRDGSQNAWKHDYGWDPAAIQTDLWDSHQGSYEVPDGHGVPYEHWTHWRTRNSDSGRRNTRNSGGPISSKPMKSKHQTDEHNVAINGWRNCRVRNDVYYYSYGQADYTKQSHAM

SEQ ID NO: 13363 - protein, 582 aa, Yarrowia lipolytica CLIB122
MLRLRPAVRAVSVARSVALTRSLHVSVAKFNKIEGTAPAGLPKEVKQTAGHQGHHQEIPKPDENHPRRKKFHFWRSLWRLTYLSAIASLGYIGYRIYVIRNPSDQLPADPSKKTLVVLGSGWGSVSFLKKLDTSNYNVIVVSPRNYFLFTPLLPSCPTGTIEHRSIMEPIRGIIRHKQAECQYLEADATKIDHEKRIVTIRSAVSENSKEEVIKEIPFDYLVVGVGAMSSTFGIPGVQENACFLKEIPDAQQIRRTLMDCIEKAQFEKDPEVRKRLLHTVVVGGGPTGVEFAAELQDFFEDDLRKWIPDIRDDFKVTLVEALPNVLPSFSKKLIDYTEKTFSDEKISILTKTMVKSVDENVIRAEQTKGDGTKETLEMPYGTLVWATGNTVRPVVRELMSKIPAQKGSRRGLLVNEYLVVEGTEGIWALGDCSATKYAPTAQVASQEGSYLANLLNGIAKTEDLNNEITNLEKQSEHTFDEQERKNIFAQLESKSRKLRRSRAMLPFEYSHQGSLAYIGSDRAVADLSFNFWGIMNWSSGGTMTYYFWRSAYVSMCFSMRNKILVCIDWMKVRVFGRDISRE

SEQ ID NO: 13364 - protein, 535 aa, Candida glabrata CBS 138
MASVVDQVHMSMNATAHAAGAASAGAVMAAPSLLDKLQGMSYLQMFVTLICGVLVWDQVSYQMKKGNIAGPRFKVYPIIGPFLESLDPKFEEYKAKWDSGPLSCVSIFHKFVIIASTRDLARKVLQAPKYVKPCVVDVAVKILRPSNWVFLDGKAHTDYRKSLNGLFTKTALAQYLPPLEELMDKYIEKFVELSKENNYEPQIFFHEMREILCALSLRSFCGDYISEDQIRKIADDYYLVTAALELVNFPIILPFTKTWYGKRTADMAMKIFESCAQRAKDHIAAGGKPICVMDNWCKLMHDAKNRTDDDSRLLHREFTNREISEAVFTFLFASQDASSSLACWLFQIVADRPDVLAKIREEQLRVREGDINKRLDIDLVDKMEYTHMVVKETLRYRPPVLMVPYVVKNKFPVVPDYQAPKGSMLIATLYPALHDPEVYENPDDFIPERWVEGSPANEAKKNWLVFGCGPHVCLGQTYVMITMTALIGKFALFTDFKHKVTPLSEKIKVFATIFPKDDLLLSFKKRDPVTGEIKE

SEQ ID NO: 13365 - protein, 224 aa, Glycine max
MLEAMESSVNGGFSHLQSCGDSSEEELSVLPRHTKVVVTGNNRTKSVLVGLQGVVKKAVGLGGWHWLVLTNGIEVKLQRNALSVIEAPTGNEEDDDLEFENMPWNGSDMASDDTHKSHKSRHRMYRTMGSSHKTMSRSFSGDSQSKGSVSMPLHGSTKVDLSKLEMAALWRYWRHFNLVDAFPNPSKEQLVDVVQRHFMSQQMDELQVIVGFVQAAKRLKTVWK

SEQ ID NO: 13366 - protein, 603 aa, Burkholderia xenovorans LB400
MSLVEVKVPDIGDFKDVDVIEVNIKPGDVIENEQALMTLESDKASIEVPSDTAGTVREVRVKAGDKVSQGTVIALVETSGEAAPAKDAPKAPAKEAEKAPAQAEAKPQAAEAPAAAPAKAAAPAPQAGSYSGSADIECDMLVLGSGPGGYSAAFRSADLGMKTVLVERYSTLGGVCLNVGCIPSKALLHTALVIDEAEALGAHGITFAKPQIDLDKLRDFKSGVVRKLTGGLAGMAKMRKVEVVTGNGAFVDPYHMEVQTEGGKKVVKFKQAIIAAGSEAVKLPFIPEDPRVVDSTGALELRQIPQRMLVIGGGIIGLEMATVYATLGAKIDVVEMLDGLMAGADRDLVKVWEKYNSKRFANVMLKTKTTAAEAKDDGIHVSFEGEKAPAEAQRYDLVLVAVGRTPNGKKIGADKAGVAVTDRGFIDVDKQMRTNVPHIFAIGDIVGQPMLAHKAVHEGHVAAEAAHGEKAYFDALQIPSVAYTDPEVAWAGKTEDQLKAAGIKYGKAVFPWAASGRAIANGRDEGFTKLLFDEETHRVIGGGIVGLNAGDLISEVCLAVEMGADATDIGKTIHPHPTLGESIGMAAELYEGVCTDLPPQKKK

SEQ ID NO: 13367 - protein, 555 aa, Burkholderia xenovorans LB400
MSQAIEVKVPDIGDYKDIPVIEVLVKAGDTVEKEQSLVTLESDKATMDVPSSAAGVVKEVKVKVGDNVSEGSLIVVLEGAEGGAAAPAPAPAAAPAAAPAPAPAAAPAAAPAPAPAASGGGLQEVKVPDIGDYKDIPVIEVAVKVGDRVEKEQSLVTLESDKATMDVPSSAAGVVKEVKVKVGDTVSEGSVIVVVEAEGGAAAPAPAPKQQAVEQPSDAPATPSPAPAAPSALAQAPVIPAGEGGARHASHASPSVRKFARELGVDVTQVQGTGPKGRITQADVTAFIKGVMTGQRAAPAGAAAPAAAGGGELNLLPWPKIDFTKFGPVDPKPLSRIKKISGANLHRNWVMIPHVTNNDEADITELEALRVQLNKENEKAGVKITMLAFVIKAVVSALKQFPTFNASLDGDNLVFKQYFHIGFAADTPNGLVVPVIRDADKKGLIDIAREMAELSKAARDGKLKPDQMQGGCFSISSLGGIGGTNFTPIINAPEVAILGLSRGATKPVWDGKQFVPRLILPLSLSYDHRVIDGAAAARFNAYLGAILADFRRVIL

SEQ ID NO: 13368 - protein, 371 aa, Oryza sativa (japonica cultivar-group)
MASSNSTSSARRRAARAPPPPNLGDLSGVSAPLPSNGLQAPSISTHPTNAATPNPSPPGASIVVVVRPAMQPASPVSGDAGPVAEAGRLPVDFSARCPHNICNFTYARFHKRLDLYIPRDPKKPSPVVAFVTGGAWIIGNFPQGTISDMVSDASDGISFVCETVGAYGGDPNQIYLMGQSAGAHIAACALLEQAAKESRGEQISWSVTQIKAYFGLSGGYNIENLVDHFHERGLYRSIFLSIMEGKKSLPHFSPETVAKKLCPETIALLPQIVLLHGTDDYSIPFSASETFAGVLKQAGAKAKLLLYEGKTHTDVFLQDPLRGGRDKLVEDVISVIHADDADAREKDALAPIPGRLVSEWQIKLAHRISPF

SEQ ID NO: 13369 - protein, 635 aa, Streptomyces avermitilis MA-4680
MATRHDIRNVAIVAHVDHGKTTLVDAMLKQAGAFAAHAAESLDDRMMDSNDLEREKGITILAKNTAVKYHPKDGGDVITINIIDTPGHADFGGEVERGLSMVDAVVLLVDASEGPLPQTRFVLRKALQARLPVILCINKTDRPDSRIDEVVNEAYDLFLDLDADEDQIEFPIVYACARDGVASLTKPQDGTVPADSDSLEPFFSTILQHVPAPTYDEAAPLQAHVTNLDADNFLGRIALLRVEQGELRKGQTVAWIKRDGTVSNVRITELMMTEALTRKPAEMAGPGDICAVAGIPDIMIGETLADPENPIALPLITVDEPAISMVIGTNTSPLVGRGGTGKGASAKAAVKDRKVTARQVKDRLDRELVGNVSLRVLDTERPDAWEVQGRGELALAILVEQMRREGFELTIGKPQVVTKEVDGKVHEPVERLTVDVPEEHMGAVTQLMGVRKGRMDNMSNHGSGWVRMEFVVPSRGLIGFRTEFLTGTRGTGIAHSIHEGHEPWFGTLTTRNNGSLVADRAGAVTAFAMTNLQERGVLFTDPGTEVYEGMIVGENSRADDMDVNITKEKKLTNMRSSSADSFEAIVPPRKLSLEQSLEFCRDDECVEVTPEAVRIRKVVLDQKERGRTASRAKHG

SEQ ID NO: 13370 - protein, 394 aa, Nicotiana sylvestris
MTTKNRQIKNFTLNFGPQHPAAHGVLRLVLEMNGEVVERAEPHIGLLHRGTEKLIEYKTYLQALPYFDRLDYVSMMAQEHAYSLAVERLLNCEVPLRAQYIRVLFCEITRILNHLLALTTHAMDVGALTPFLWAFEEREKLLEFYERVSGARMHASFIRPGGVAQDLPLGLCIDIDSFTQQFASRIDELEEMLTGNRIWKQRLVDIGTVTAQQAKDWGFSGVMLRGSGVCWDLRKAAPYDVYDQLDFDIPVGTRGDCYDRYCIRIEEMRQSVRIIVQCLNQMPSGMIKADDRKLCPPSRSRMKTSMESLIHHFELYTEGFSVPASSTYTAVEAPKGEFGVFLVSNGSNRPYRCKIRAPCFAHLQGLDFMSKHHMLADVVTTIGTQDIVFGEVDR

SEQ ID NO: 13371 - protein, 343 aa, Zea mays
TTFEGSWVLRPKSLASSFVVHFVGGIFVGAAPQITYRFFLECLANRGALVIATPYASGFDHFFIADEVQFKFDRCLRNLDEPVNDLPTFGVGHSLGSVIHMLIGSRYAVQRSGNVLMSFNNKKEASSAIPLFSPVIVPMAQSFGPIFSQLASYPTIRFGAEAAIKQLENLSPPVVKQLLPLLQQLPPLYMDLIKGREDFIPKPEETRRLIKSYYGISRNLLIKFKDDQIDETSTLAQVLSSEAAISSLLDMSIRSLPGDHGLPLQQVLPDVPPAMADAVNRGGELLTNLTTGTPWEAVAKEVGTTLGTDSGILRAQISKDVETLVDVIASWTSSNSGPRLLRP

SEQ ID NO: 13372 - protein, 390 aa, Thermus caldophilus
MRTLLDLDPKGKRVLVRVDYNVPVQDGKVQDETRILESLPTLRHLLAGGASLVLLSHLGRPKGPDPRYSLAPVGEALRAHLPEARFAPFPPGSEEARREAEALRPGEVLLLENVRFEPGEEKNDPELSARYARLGEAFVLDAFGSAHRAHASVVGVARLLPAYAGFLMEKEVRALSRLLKDPERPYAVVLGGAKVSDKIGVIESLLPRIDRLLIGGAMAFTFLKALGGEVGRSLVEEDRLDLAKDLLGRAEALGVRVYLPEDVVAAERIEAGVETRVFPARAIPVPYMGLDIGPKTREAFARALEGARTVFWNGPMGVFEVPPFDEGTLAVGQAIAALEGAFTVVGGGDSVAAVNRLGLKERFGHVSTGGGASLEFLEKGTLPGLEVLEG

SEQ ID NO: 13373 - protein, 511 aa, Triticum aestivum
  misc_feature (235)..(235): Xaa can be any naturally occurring amino acid
  misc_feature (247)..(247): Xaa can be any naturally occurring amino acid
  misc_feature (265)..(265): Xaa can be any naturally occurring amino acid
  misc_feature (396)..(397): Xaa can be any naturally occurring amino acid
  misc_feature (406)..(406): Xaa can be any naturally occurring amino acid
MMIARGCLLRSKAESIVKHVASGGSWHGLHSFSEASARGFSSEPSLQAHSTEEIGFKGHGMLAPFTAGWQSTDVHPLVIDRSEGAYVYDINGKKYIDALAGLWCTALGGSEPRLVKAATEQLNKLPFYHSFWNRTTKPSLDLANDVLSMFTAREMGKVFFANSGSEANDSQVKLVWYYNNAMGRPDKKKFIARSKSYHGSTLISASLSGLPALHQKFDLPAPFVLHTDCPHYWRXNLPDETERRIVXTNLPNNVGNSILKEGPEXTIAAFIAEPVMGAGGVILPPKTYFEKIQAVLKKYDVLLIADEVITAFGRLGPMFGCDMFIIQPDLVSVAKALSSAYMPIAAILVSPEIADVVHSQSSKLGSFAHGFTYSGHPVACAVAIEALKIYKERNIXXHVNTIAPRXFQEGIKAFSGSPIVGEIRGLGLILGTEFVDNKSPNDPFPAEWGVGSIFGAECEKRGMLIRVAGDNIMLSPPLIMTPDEVEEIVSKYGGALKATEERIEELKSAKK

SEQ ID NO: 13374 - protein, 381 aa, Triticum aestivum
  misc_feature (287)..(287): Xaa can be any naturally occurring amino acid
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECKNCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSVVAVFGLGTVGLAVAEGAKSAGASRIIGIDIDAKKFDVAKNFGVTEFVNPKDHDKPIQQVLVDLTDGGVDYSFECIGNVSIMRAALECXTRGWGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 13375 - protein, 370 aa, Oryza sativa (japonica cultivar-group)
MAAKSLREIRRAAAAGIGSRRCFSGDAAAAAAAAAGVAEGKVGGGAGKEVNLFTAINQALHIALDTDPRSYVFGEDVGFGGVFRCTTGLADRFGRNRVFNTPLCEQGIAGFAVGLAAMGNRAIAEIQFADYIFPAFDQIVNEAAKFRYRSGNEFNCGGLTIRSPYGAVGHGGHYHSQSPEAFFCHVPGLKVIIPRSPREAKGLLLASIRDPNPVVFFEPKWLYRLAVEEVPEEDYMLPLSEAEVIRKGSDITLIGWGAQLAVLEEACEDAAKDGISCELIDLRTLIPWDKETVEASVSKTGKLLVSHEAPITGGFGAEIAASITERCFQRLEAPVARVCGLDTPFPLVYETFYMPTKNKVLDAIKATVNY

SEQ ID NO: 13376 - protein, 366 aa, Bacillus subtilis subsp. subtilis str. 168
MVHYGLKGITCVETSISHIDGEKGRLIYRGHHAKDIALNHSFEEAAYLILFGKLPSTEELQVFKDKLAAERNLPEHIERLIQSLPNNMDDMSVVRTVVSALGENTYTFHPKTEEAIRLIAITPSIIAYRKRWTRGEQAIAPSSQYGHVENYYYMLTGEQPSEAKKKALETYMILATEHGMNASTFSARVTLSTESDLVSAVTAALGTMKGPLHGGAPSAVTKMLEDIGEKEHAEAYLKEKLEKGERLMGFGHRVYKTKDPRAEALRQKAEEVAGNDRDLDLALHVEAEAIRLLEIYKPGRKLYTNVEFYAAAVMRAIDFDDELFTPTFSASRMVGWCAHVLEQAENNMIFRPSAQYTGAIPEEVLS

SEQ ID NO: 13377 - protein, 396 aa, Mesorhizobium sp. BNC1
MTKRFNDDWKPQTRLVHGGTLRSSFGETSEALYLTQGFVYETAEAAEARFKGEDPGFIYSRYANPTVDMFESRMCALEEAEDARATASGMAAVAAALLCSVKAGDHVVAARALFGSCRWIVETLMPRYGIETTLVDGTRMEAWEEAVRKNTKLFFLESPTNPTLEICDIASIAKLADSIGARLVVDNVFATPLLQKPLELGAHVVVYSATKHIDGQGRCLGGVVLSDKEWIDENLHDYFRHTGPSLSPFNAWTLLKGLETLPMRVRQQMESAAHVADYLADHPKVERVIYPGRPDHPQADLVKRQMKGGSTLVCLDIKGGKQGAFAFSNALEIIRISNNLGDAKSLITHPATTTHKNLSEEARLEAGIQQGTLRLSLGLEDTEDLLKDIEQALATV

SEQ ID NO: 13378 - protein, 898 aa, Burkholderia xenovorans LB400
MSAVPDEVMKYVAAEKDDDPQETGEWLEALDGVISAVGPDRAHYLIEKQIEFARVHGEHLPFSANTPYINTIPVSRQAKIPGDQDLEHRIRSYTRWNAIAMVLRAGKETNVGGHIASFASAATLYDVGYNHFWHAPSAEHGGDLVFVQGHSSPGVYSRAFLLGRLTENQLDNFRQEVGGEGISSYPHPWLMPDFWQFPTVSMGLGPIMAIYQARFMKYLQARGITKTEGRKVWAFLGDGETDEPESLGAIGMAGRERLDNLVFVINCNLQRLDGPVRGNGKIIQELESEFRGAGWNVIKVIWGSRWDALFQRDKSGALMRRMMEVVDGEYQTYKSESGAYVREHFFNTPELKALVAEWSDEEIWNLNRGGHDPHKIYAAFQEASNSQGQPTVILAKTIKGYGMGEAGQAMNITHQQKKLHVDQLKKFRDQFRLPISDEDLVNVPYLKFEEGSKELEYMRARRQDLGGYLPARRQKAESLPVPELSVFEPLLKGTGEGREISTTMAFVRILNILLKDKALGKRIVPIVPDESRTFGMEGLFRQIGIWNQDGQKYVPEDSDQLMFYRESETGQILQEGINEAGGMSDWIAAATSYSTHGEIMIPFYIFYSMFGFQRIGDLAWAAGDMRSRGFLLGGTAGRTTLNGEGLQHEDGHSLLWAASVPNCISYDPTFGYELAVIMQDGLRRMVAEQEDVYYYVTVMNENYEHPAIPQGDSVAADIIKGMYAFRKAEADRKTPRVQLMGAGTIFNEVIAAADLLKNDWGVAADLWSVPSFTELAREGHEVQRWNLLHPTEEKKLSHVEKLLKDAQGPVIASTDYVRALTEQIRAFVPQKFVVLGTDGYGRSDTREKLRHFFEVDRYWVTVAALNALADEGTIERKVVAEALKKYNLDPAKPNPMTV

SEQ ID NO: 13379 - protein, 284 aa, Streptococcus pneumoniae
MKLDGYTRLAAVVANPIKHSISPFIHNRAFEATDTNGAYVAWEIEASDLVETVANIRRYQMFGINLSMPYKEQVIPYLDKLSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQGNPAVNGLGMLLYQAAEAFQLWTDKEMPTEEIWQSLTEKYQ

SEQ ID NO: 13380 - protein, 284 aa, Streptococcus pneumoniae
MKLDGYTRLAAVVANPIKHSISPFIHNRAFEATATNGAYVAWEIEASDLAETVANIRRYQMFGINLSMPYKEQVIPYLDELSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQGNPAVNGLGMLLYQAAEAFQLWTGKEMPTEEIWQSLTEKYQ

SEQ ID NO: 13381 - protein, 241 aa, Xanthomonas oryzae pv. oryzae KACC10331
MGIRSMPAAVPLQRIPNFQSPIPSPTMSEAKRLAAEKAIDYVEDGMIVGVGTGSTVAYFIDALGHIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDVVLTDNGNVVLDVHNLQITDPVALERSLNQIPGVVCVGLFARRPADVVIVGGEPPRVL

SEQ ID NO: 13382 - protein, 541 aa, Triticum aestivum
  misc_feature (29)..(29): Xaa can be any naturally occurring amino acid
  misc_feature (224)..(224): Xaa can be any naturally occurring amino acid
FPSRVRGQFTPTPTLIARICIGSVKEEKXEDMTLLCVPLVGRTVEEMKIDAAAAAAAGADLVEIRLDYIEGFRPREDLPRLLHSCPLPVLVTYRPNWEGGRYDGDDATRFETLYLAMELGVDYVDIELKVADKFVGFLSGNKPDKCKLIVSSHNYESTPSCEDLANLVARIQEVGADIVKVATTATDIVDVSRMFQVMVHCQVPMIGLVMSERGLMSRVLSPKXLGGYLTFGILDATKTSASGQPTLEELLDIYNIRCIGPDTKVLGLIANPVKQSKSPILHNKCLQSVGYNAVYLPLLADDLARFLDTYSSPDFSGFSCSLPFKVDAVHCCHEHDAVAKSIGAINTIVRKSDGKLVGYNTDYIGAISAIEDGIGGLGSKDAAMSPLSGRLIVVVGAGGAAKAIAYGAKKKGARVVVANRTYEKAVTLANAVGGQALRLADLENFRPEEGTILANATSLGMYPNVDGTPVPKKALRFYDVVFDAVYAPKVTRLLREAKEHGVKVVSGVEMFVRQAMGQFEHFTGGIEAPESLMREIAAQYT

SEQ ID NO: 13383 - protein, 203 aa, Solanum demissum
MDILGNLYIDPLPLVIPTTTSSTTFDNNSNEKVMLLLASKIPKRRGDRKKFHETRHPVYRGVRWKNFEKWVSEVRVPAKKSRIWLGTFPNAEMAAKAHDVAVMALKGRSACLNFADSTWRLPVPASAAVKDIQKAAAEAAEAFRVSESLERENSEEVVINNDDHYVVDSGWRLVIPASAVARDIQKAVAEAFCPSESSKGEYF

SEQ ID NO: 13384 - protein, 246 aa, Zea mays
  misc_feature (232)..(232): Xaa can be any naturally occurring amino acid
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETXRAAHPSRELELPDG

SEQ ID NO: 13385 - protein, 384 aa, Solanum demissum
MAIDCMITRNNNMTSKEGQEYDIIKTNKSLSFDASLMKNESNIPSQFIWPDHEKPNCASVTRELQVPLIDLSGVLSNDPIEIKKATRLVNEACTKHGFFLVTNHGVDTNLIKKAHVYIDKFFELPLCEKQKAQRRVGEHCGYASSFIGRFSSKLPWKETLSFQYSDEKGSSHIVEQYFQRTLGEKFSHIGKIYQEYCNAMSTLSLGIMELLGLSLGVSKNHFKEFFQENESIMRLNYYPTCQKPELTLGTGPHCDPTSLTILHQDSVGGLQVFVDNEWHSITPNFNAFVVNIGDTFMALSNGRYKSCLHRALVNNKVPRKSLTFFLCPKKDKVVTPPIELVDSNNPRIYPDFTWPTLLEFTQKQYRADMNTLQTFSNWLKKTHP

SEQ ID NO: 13386 - protein, 289 aa, Bacillus subtilis subsp. subtilis str. 168
MNPMDRQTEGQEPQHQDRQPGIESKMNPLPLSEDEDYRGSGKLKGKVAIITGGDSGIGRAAAIAFAKEGADISILYLDEHSDAEETRKRIEKENVRCLLIPGDVGDENHCEQAVQQTVDHFGKLDILVNNAAEQHPQDSILNISTEQLEKTFRTNIFSMFHMTKKALPHLQEGCAIINTTSITAYEGDTALIDYSSTKGAIVSFTRSMAKSLADKGIRVNAVAPGPIWTPLIPATFPEEKVKQHGLDTPMGRPGQPVEHAGAYVLLASDESSYMTGQTIHVNGGRFIST

SEQ ID NO: 13387 - protein, 334 aa, Coccidioides immitis RS
MTSTSLKETASAAASEAPREAKAAVESSPGRASSVFQSPFVRAALPFVNGGLAGMTATTCIQPIDMVKVRLQLAGEGARTGPRPSALGITRDIIASGRVLDLYTGLSAGLLRQAVYTTARLGFFDTFIAMLNSRAAASGTKVTFGERAAAGLTAGGIAAMVGNPADLALIRMQSDGLKPKEARANYRSVIDALARISKSEGITALWAGAFPTVVRAMALNFGQLTFFSESKSQLQAHTNLSPQNRTFAASAIAGFFASFLSLPFDFIKTRLQKQQKDPKTGQLPYKGVFDCARKVVRDEGWLRFYRGFGTYYVRIAPHAMVTLIVVDYLNLLTS

SEQ ID NO: 13388 - protein, 465 aa, Bacillus subtilis subsp. subtilis str. 168
MKGSVFRKKSIQDLIAATSGEKSLKRELGAFDLTLLGIGAIIGTGIFVLTGTGAVTAGPGLTISFVVAALACLFAALSYAEFASSVPVSGSVYTFTYATLGELMAFIIGWDLILEYMLAVSAVSVGWSGYFQSFLSGLGIHLPVALTAAPGAVKGTFTLFNLPAFVIVMAITYLLYLGIKESKRVNNIMVILKILVVLLFIAVAAVYVKPHNWQPFMPMGFGGVFSAAALVFFAFIGFDAVSSAAEETKNPAKDLPKGIIFSLLVCTILYVTVSAIMTGVIPFAQFAGVDHPVSLVLQSAGQNWVAGIIDIGAVLGMTTVMLVMLYGQTRVMFAMSRDGLVPGSLSKVHPKHKTPYVATWFFGTMSALLGSLVPLDELAKLVNIGTLSAFVLISVAVIVLRKKQPDLPRAFKCPGVPVIPGLAILFCLFLILNLGWVTIVRFLVWLLIGLVIYFLYSRKHSKLNQ

SEQ ID NO: 13389 - protein, 462 aa, Coprinopsis cinerea okayama7#130
MSDKTDIIVFGATGFTGRLITEYLATHPQKALFSLGVAARSESKLRGVLQELGLGESGIRTVTLDVTDPDSVERAVKAARVVVNTVGPYWRWGTPVVRSCVRNNVHYVDLTGEGCWIHELITQFDWLATKNHTVIIPSCGYDSIPSDISAHLAVKTLHEHVAANHPDILASVGHVGLSTSISAHRLKTGISGGTLASFITAIEEVPPELRKISGNPFFISPIKGTPLPFPKLVYSLPIPGGNPIVGSFFVMRPSNAAIVHRTAGLIELQARTARSKLHQDPKLEIQRYGTSFAYDEFLAGPSKFSAFFSSISLIFGLLLVRLFKPLRRLILQKMPSGSGPSIDQKETGYLHLTNISTSADIPSLPPVKVKTDVKIKGDPGYYKTAVMISESALSLLLPPPSAPSHVKENYNPFDALPSMAREGGILTPMTALGDVLIQRLRDTGSFEFSSSVVQDPEDRKRI

SEQ ID NO: 13390 - protein, 356 aa, Glycine max
  misc_feature (144)..(144): Xaa can be any naturally occurring amino acid
MHSKAALLSFLANKCSKIQTHTLSPMALNNGVPATGTGLIVSFGEMLIDFVPTVSGVSLAEAPGFLKAPGGAPANVAIAVSRLGGKAAFVGKLGDDEFGHMLAGILKENGVRADGITFDQGARTALAFVTLRADGEREFMFYRXNPSADMLLKPEELNLELIRSAKVFHYGSISLIVEPCRSAHLKAMEVAKEAGCLLSYDPNLRLPLWPSPEEARKQILSIWEKADLIKVSDVELEFLTGSDKIDDESALSLWHPNLKLLLVTLGEHGSRYYTENFKGSVDAFHVNTVDTTGAGDSFVGALLSKIVDDQSILEDEPRLREVLKYANACGAITTTQKGAIPALPKEEDALKLIKGA

SEQ ID NO: 13391 - protein, 400 aa, Vibrio parahaemolyticus
MSNSLSLPTRVSQQVHTLAQQQNQPLCAYLYDLNALEEHIKQLRHVLPKNVKLFYAAKANPSGPILNTLAPYVDGFEAASGGELTHLHQQQLDKPLIFGGPGKMPSELQQAIELDVDAIHVESLTELQRIGALTERLNRPASIFLRMNIDIGDITLSKLAMGGKPTPFGLDESELSNALMLLRDFPQVSLKGFHFHLMSHQLDVERHLALMQRYFQVVKAWQQEFELGELMINLGGGMGINYQNPEQHFPWMEFCDKLEFLIAKEQVQDWTLRFECGRFITAACGYYVMEVLDIKQNLGENFVIARGGTHHFRTPAAQSHDHPFVILKSEQHHDISHPIQHAQATFVGQLCTPKDVLARNQHVAHVDIGDYVVFTLAGAYAWNISHQNFLMHEPPIFHYF

SEQ ID NO: 13392 - protein, 284 aa, Streptococcus pneumoniae
MKLDGYTRLAAVVANPIKHSISPFIHNRAFEATATNAAYVAWEIEASDLAETVANIRRYQMFGINLSMPYKEQVIPYLDELSDEARLIGAVNTVVNENGNLIGYNTDGKGFFKCLPSFTISGKKMTLLGAGGAAKSILAQAILDGVSQISVFVRSVSMEKTRPYLDKLQDQTGFKVDLCALEYVSELQARIAESDLLVNATSVGMDGQSSPVPENIVLPETLLVADIIYQPFETPFLKWARSQGNPAVNGLGMLLYQAAEAFQLWTGKEMPTEEIWQSLTEKYQ

SEQ ID NO: 13393 - protein, 515 aa, Bacillus clausii KSM-K16
MQVTNHETIVVLDFGGQYNQLITRRIRDLGVYSELHSHKLTADELKEMNPIGIIFSGGPNSAYVEGSPKCDPAIYDLGIPILGICYGVQLMTHHFGGKVDKASHREYGKALLNVENQSPLFKGLPIEQTVWMSHGDKIVAPPEGFTVDASNPSCPVAAMSDESRNLYGVQFHPEVRHSEFGNDLLKNFAFDICGAKGDWSMENFIEEEIKKIREQVGDRHVLCALSGGVDSSVVAVLIHKAIGDQLTCMFIDHGLLRKGEAESVMETFTQGFNMNVVKIDASERFLTKLKGVTDPEQKRKIIGNEFIYVFDEESAKLKDKKMDFLAQGTLYTDIIESGTDTAQTIKSHHNVGGLPEDMAFELIEPLNALFKDEVRALGTELGIPDEIVWRQPFPGPGLGIRVLGEITDEKLKIVRESDAILREEIKKAGLDREIWQYFTALPNMRSVGVMGDTRTYDYTVGIRAVTSIDGMTSDWARIPWDVLEIISTRIVNEVEHVNRIVYDITSKPPSTIEWE

SEQ ID NO: 13394 - protein, 284 aa, Streptococcus pneumoniae
MKLDGYTRLTAVVANPIKHSISPFIHNRAFEATATNGAYVAWEIEASDLAETVANIRRYQMFGINLSMPYKEQVIPYLDKLSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQGNPAVNGLGMLLYQAAEAFQLWTGKEMPTEEIWQSLTEKYQ

SEQ ID NO: 13395 - protein, 197 aa, Glycine max
  misc_feature (165)..(165): Xaa can be any naturally occurring amino acid
TWEEDFTTSDDDEDELEVEERRPEKPKKIKAAAMDKEVDKNKKKPARTCVQIKEIPEDNTAGCDAIRKAFAMGNGKGKAKELSPQDAMLLIQMNYRAHLAHRSQVLSCPCDLAVAKAKLKEPRSLFYNLSYRRRLSHDHEECQRFSEKIIVLLLTVDALEGPDFXVRTAKKSMLEELESMLEIVDPQPPGKQRSFQP

SEQ ID NO: 13396 - protein, 888 aa, Shewanella sp. ANA-3
MSEDMLQDLDPLETQEWVDALQAVLEQEGPERAHFLLEKLIDKARRNGTHLPYTATTAYLNTIPAGQEPHMPGNQEMERRIRAIIRWNALAMVLRGSKKDLELGGHISSFASSATIYDVCFNHFFRAPNEKDGGDLVYFQGHIAPGIYARSFLEGRLTEDQLANFRQEVDGKGLSSYPHPKLMPDYWQFPTVSMGLGPIQAIYQARFLKYLTDRGLKDCSEQTVYCFLGDGECDEPEALGAIGLAAREELDNLVFIINCNLQRLDGPVRGNGKIIQELEGEFRGAGWEVVKVIWGRYWDPLLARDTSGKLLQLMEETVDGEYQNCKAKGGAYTREHFFGKYPETAEMVANMSDDDIWRLNRGGHDPVKVYAALDHARKTKGRPTVILAKTVKGYGLGDAGEGKNIAHNVKKMGIESIRYFRDRFNIPIPDDQLEDLPFYHPGPDSEEVKYMMSRRAALHGSVPQRRQKFSEELEIPSLKIFDSILQGSNGREISSTMAFVRVLTALLKDKKIGKNIVPIIPDEARTFGMEGLFRQVGIYAHEGQKYVPQDSDQVAYYREDKTGQVLQEGINELGAMSSWVAAATSYSVNDTPMIPFYIYYSMFGFQRIGDMAWAAGDMRARGFLVGGTSGRTTLNGEGLQHQDGHSHVLANTIPNCITYDPTYGYEIAVIVQDGIRRMYGEKQEDIFYYLTTMNENYIQPEMPEGAEEGIVKGIYKLETVSGSGKGKVQLMSCGTILEQTRKAAQALAKDFGITADVFSVTSFNELTRDGQAVERWNMLHPTETPKQAYISQVISSDAPAIAATDYMKIYGEQLRAFMPTDYKVLGTDGFGRSDSRDNLRHHFEVDAKFIVIAALKSLVDRKELPVDVLANAIKEYGIDADKINPQYA

SEQ ID NO: 13397 - protein, 382 aa, Oryza sativa
MGASASSSVTSKLTNDGENQKVKYASSTMQGYCPTMQDALAVELDLDALRNTSFFGVYDGDGGAEVAMYCAKRFHAMLCEDENYLNNLPNAITSVCSRLDDDLQRSNEWKESLYPRGNGECFQFLKTGVCANLWHSEELGFLLPQQAYRAPLYEGSTACVVIIRGNQITVGNVGDSRCVVSHNGQAIDLSIDHKPTVGSERERIVRAGGRVLAKRIPVMGSDGRLMRGWGYFELKKNQNIPPSQQMVTCDPEFTIVDITANTEFLVIATDGIWGHMSSQDVVDFIRKELRSGEENLRAICEKLLDHCLTSRDNVTVILVRFKPGAAVIPILSDIDEEPVLSDVEEEPHEPQQNPGDGGGGGGGQQDIGGESEELPLAHFPQE

SEQ ID NO: 13398 - protein, 1171 aa, Oryza sativa (japonica cultivar-group)
MASGSRATPTRSPSSARPAAPRHQHHHSQSSGGSTSRAGGGGGGGGGGGGGAAAAESVSKAVAQYTLDARLHAVFEQSGASGRSFDYTQSLRASPTPSSEQQIAAYLSRIQRGGHIQPFGCTLAVADDSSFRLLAYSENTADLLDLSPHHSVPSLDSSAVPPPVSLGADARLLFAPSSAVLLERAFAAREISLLNPLWIHSRVSSKPFYAILHRIDVGVVIDLEPARTEDPALSIAGAVQSQKLAVRAISRLQALPGGDVKLLCDTVVEYVRELTGYDRVMVYRFHEDEHGEVVAESRRNNLEPYIGLHYPATDIPQASRFLFRQNRVRMIADCHAAPVRVIQDPALTQPLCLVGSTLRSPHGCHAQYMANMGSIASLVMAVIISSGGDDDHNISRGSIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEVQIKDIIEWLTMCHGDSTGLSTDSLADAGYPGAAALGDAVSGMAVAYITPSDYLFWFRSHTAKEIKWGGAKHHPEDKDDGQRMHPRSSFKAFLEVVKSRSLPWENAEMDAIHSLQLILRDSFRDSAEGTSNSKAIVNGQVQLGELELRGIDELSSVAREMVRLIETATVPIFAVDTDGCINGWNAKVAELTGLSVEEAMGKSLVNDLIFKESEETVNKLLSRALRGDEDKNVEIKLKTFGPEQSKGPIFVIVNACSSRDYTKNIVGVCFVGQDVTGQKVVMDKFINIQGDYKAIVHNPNPLIPPIFASDENTCCSEWNTAMEKLTGWSRGEVVGKLLVGEVFGNCCRLKGPDALTKFMIVLHNAIGGQDCEKFPFSFFDKNGKYVQALLTANTRSRMDGEAIGAFCFLQIASPELQQAFEIQRHHEKKCYARMKELAYIYQEIKNPLNGIRFTNSLLEMTDLKDDQRQFLETSTACEKQMSKIVKDASLQSIEDGSLVLEKGEFSLGSVMNAVVSQVMIQLRERDLQLIRDIPDEIKEASAYGDQYRIQQVLCDFLLSMVRFAPAENGWVEIQVRPNIKQNSDGTDTMLFLFRFACPGEGLPPEIVQDMFSNSRWTTQEGIGLSICRKILKLMGGEVQYIRESERSFFHIVLELPQPQQAASRGTS

SEQ ID NO: 13399 - protein, 663 aa, Chlamydophila abortus S26/3
MGKISFYPGSPLPLGATQLSSDCYRFALFSSQATQVVLVLADQNLHTQEIVLSRKENRTGAIWHIEVEGISDLWSYTFRVDGPASPLGRFDFKKYLADPYAKNLRSPQTFGSIKTPGDYAFSYLKNEEFSWEGDRCLNLPKEESIIYEMHVRSFTWDNSSKSRYPGTFLGIIEKIDYLKKLGINAIELLPIFEFDETYHPFRKVDFPHLCNYWGYASVNFFSPCRRYAYGSDPCAPSREFKTLVKALHQAGIEVILDVVFNHTGLENTTCPLQWIDLPSYYIVDSQGEFANYSGCGNTVNTNHTPTTQLILDSLRYWVQEMHVDGFRFDLASIFSRDPSGKPLPFSPALQAISYDPILADTKIIAEPWDAAGLYQLGYFPTLHSRWSEWNGQYRDTVKAFLNGNDQLIGTFASRISGSQDLYPYGSPCNSINYICSHDGFTLYDTVAYNNKHNEENQEGNCDGSDANYSYNFGEEGETQNPHIIELRQRQMRNFLLTLFLSQGIPMLQSGDEYGHTAKGNNNRWALDTDANHFLWDRLSNNASLVDFVCHAIHFRKKHKEIFNRGFLTQDNITWLDATANPIQWHPGKFLAYELKQARYSLFTAFYTGKEQIKVQLPNLRENFMPYQKIADSSSGFVSQHLPEKITLDPYMMVVAMSYANHQD

SEQ ID NO: 13400 - protein, 284 aa, Streptococcus pneumoniae
MKLDGYTRLTAVVANPIKHSISPFIHNRAFEATATNGAYVAWEIEASDLAETVANIRRYQMFGINLSMPYKEQVIPYLDELSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQFSPVPENIVLPETLLVADIIYQPFETPFLKWARSQGNPAVNGLGMLLYQAAEAFQLWTGKEMPTEEIWQSLTEKYQ

SEQ ID NO: 13401 - protein, 475 aa, Shewanella sp. ANA-3
MSNEIKTQVVVLGAGPAGYSAAFRAADLGLETVIVERFSTLGGVCLNVGCIPSKALLHVAKVIEEAKAVAAHGVVFGEPTIDLDKLRSFKQKVISQLTGGLGGMSKMRKVNVVNGFGKFTGPNSLEVTAEDGTVTVVKFDQAIIAAGSRPIKLPFIPHEDPRIWDSTDALELKEVPGKLLVMGGGIIGLEMGTVYSSLGSEIDVVEMFDQVIPAADKDVVRVFTKQIKKKFNLILETKVTAVEAREDGIYVSMEGKSAPTEPVRYDAVLVAIGRTPNGKLIDAEKAGVKIDERGFINVDKQLRTNVPHIYAIGDIVGQPMLAHKGVHEGHVAAEVIAGMKHYFDPKVIPSIAYTDPEVAWVGLTEKEAKEQGIAYETATFPWAASGRAIASDCSEGMTKLIFDKDTHRVIGGAIVGVNGGELLGEIGLAIEMGCDAEDLALTIHAHPTLHESVGLAAEIYEGSITDLPNPKAKKK

SEQ ID NO: 13402 - protein, 1299 aa, Aspergillus oryzae
MTAEDICPLDDPKHGVNVESLQDQAAAFDLSFREVQPVDIRVKDLSLEVDISPPIWETAPSQIWRRLRGKTTTDARKTVLDGIDAYMPSGSLTAIIGSSGSGKTSLLNLMAGRMGMTKASVAGTTTFNGDANIESVRSAYVMQEDVLIPTLTVRETLRYSADLRLPPPTTQEERHQTVEQVIMELGLKECADTRIGTNIHKGCSGGEKRRTSIGVQMLANPSVLFCDEPTTGLDATSAFQIVRTLKRLAQKGRTVIISIHAPRSEIWSLFDNVVLLARGSVLYSGLSSRSLSYFENHGHVIPPFVNPAEFLIDLAAIDNRTEELEAASLARVDFLKTSWRTEEKTEKEVLGSRKDDEKSITRAQAIPIARAVSFSRQFRVLTSRTFKTTIRDPMGLAGSLLEAVGMGVISGWIFLQLDESQAGIRSRQGSLYTSSSLNGYLILLYETYRLTIDIRQFDRERTEGVVGVPAFLLSRRAARLPLEDLPVPIIFAVIFYFMVGYRLSVGQFFIFLALTILTHYIAITFAAVSIGIARSFPGASLVGNLSFTVQSFACGYFVQSNQIPVYVRWLKWVAYTFYIFGALCANEFIGPNGPPEGQFYDCPFSDDPNDPACTQYTGRYIMESLGFPPNWIWRPIVVLVAFVVGHYLLAGILLQYNHFAMDIAQARKSDKDTSTGVEKMAVRPAEEARKVVISLDKYALDIRKRGLFGRGSRTLSILKPITAEFRPGNLNVIMGPSGSGKTSLLNSVARRLHGSLSTQYRVHGDMLYNGAVPSESVIRSVTSFVTQDDDALMPSLTVRESLRFAAGLRLPLWMSREEKNRRAEEVLLKMGLKECADNLIGSELIKGISGGEKRRVTIAIQILTDPKVLLLDEPTSGLDAFTAMSIIEVLKGLAEEGRTLVMTIHQARSDLFQHFSSVLLLARGGYPVYAGDGATMLSHFGALGYHCPQTTNPADFVLDLITVDLQQVDREAVTRERVQKLILSWDDKTFDLGRQTSHIATPAELGSLKRQMLPFRITYPLVLRRSAINFWRQPPLVMARSMQVVGIGIIMALFFAPLKNDYAAVQSRMGFIQEFGALYFVGALTKNRAGMLQNIAIYPNERDVFYREEADHCYSAETFILQYTTLEVPFEILSSLIFGVLAAYADNLGRSATMFLITAYNCFCIVSCGESLGIMFCTLFSHVGFAVNVTSILLSIANILGGVMSLNVNEVLQGLNHLSPVKYAVANLAPYAMRDQEFVCTAAQRLADGSCPIQNGQQVLRLYNLDKNGAINVMALGVCTIIYRVVAYGLVKAMRWERK

SEQ ID NO: 13403 - protein, 275 aa, Triticum aestivum
MLYKGTLSSGVEIAVVSSLISSKNDWSKECESQYRKKISSLSKVGHKNFINLLGYCEEENPFTRAMVFEYAPNGTLFEHLHVREAENLDWMARLRISMGIAYCLEQMHKLNPPVVPRSFSSTTIHLTDDFAAKVSDLDFWNGTKGSDSVTDGCTMLDTESIVHQYGIILLEILTGRVPFPEQDLPLEQLASIYFESKMPLAELMDSSLGSFPEETARALCDVARSCVDPDPSKRPRMAQVAAQMKEITAVGPEGATPKVSPLWWAELEIMSAEAT

SEQ ID NO: 13404 - protein, 299 aa, Propionibacterium freudenreichii subsp. shermanii
MNSPVDPTSTPAWAELENLHRSLDVDFRKWFAEEPNRAQQFTLRAGDLTVDLSRNYLNQQVRDTLVSLAAQVDLAGRRDAMFRGDRINTTEDRSVLHVALRLPKGAELDVDGVNVVDQVHEVLDREISFTEAVRSGERGGVTGKPITTVVNIGIGGSDLGPVMVYEALKPYKHDRIECRFISNIDPADMYEKTHDLDAETTLFIVASKTFTTLETMTNARMAKNWLINSLQSSGAIDGTADSRARAIKRHFVAVSTNAEKVSEFGIDHANMFGFWDWVGGRYSVDSAVGLSALIAIGPD

SEQ ID NO: 13405 - protein, 471 aa, Burkholderia xenovorans LB400
MSKSVADVVQLVKDEDVKFVDFRFTDTRGKEQHVSVPVSAFDEDKFESGHAFDGSSIAGWKGIEASDMLLVPDANTAFIDPFYEESTLVLTCDVVEPADGKGYERDPRSLAKRAEAYLKSTGLGDTAFFGPEPEFFIFDSVKWGTDQSGTFVKIGSEEAPWSSALDFEGGNTGHRPGTKGGYFPVAPVDTFQDIRSEMCLLLEQIGIPVEVHHHEVAGQGQNEIGTKFSTLVQRADWLQQMKYIIHNVAHTYGKTATFMPKPVVGDNGSGMHVHQSIWKDGTNLFAGNGYAGLSEFALFYIGGIIKHARALNAITNPSTNSYKRLVPHFEAPVKLAYSARNRSASIRIPHVSNPKGRRIETRFPDPMANPYLCFSALMMAGLDGVQNKIHPGEAADKNLYDLPPEEDAKIPTVCAGLDQALDSLDADREFLTRGGVFTDSMLDAYIELKTGELQRYRQSVHPIEFEMYYSL

SEQ ID NO: 13406 - protein, 327 aa, Propionibacterium freudenreichii subsp. shermanii
NGFGRIGRNFFRAMVDQKADLDIVAVNDLTDTKTLAHLLKYDSILGRFPGEITYDDNSITVDGHKIQVCEERDPANLPWKDLGVEVVVESTGLFTDGEKAKAHIAAGAKKVIISAPAKNVDATFVIGVNEQEYDTSKHNIISNASCTTNCLAPLAKVFEDEFGIERGVMTTIHAYTGDQRLLDAPHKDLRRARAAAINLIPTKTGAAQAVALVIPALKGKFDGLAVRVPVPTGSLTDLSFIPGREVTVEEINAAVKKAAEGPLKGILAYTEDPIVSTDIVTDPHSSIFDASETKVIGNLVKVLSWYDNEWGYSNRLVDITELVADKL

SEQ ID NO: 13407 - protein, 237 aa, Arabidopsis thaliana
SKLAALSHRHNLAWDAGTGNGQAAIGIAEHYERVVATDVSETMLNLGKPHPKVTYHHTPSSMTEDEMVDLIGGENSVDLITVATAVHWFDLPRFYAIANRLLRKPGGIIAVWSYNTDMVVNPEFDSVMTRFIAETLPYCKFPESQYFLDGYKTLPFPFESVGLGSEGKPMELEMKKTVSFEGFLRMLRSWSAVGAAKEKGVDLLSDNVVKELETAWGGYELVRTIVYKTFMLAGTVP

SEQ ID NO: 13408 - protein, 412 aa, Shewanella sp. ANA-3
MKRLAIPLQGAQMLFVAFGALVLMPLLTGLDTSVALFTAGIGTLLFQLITKRQVPIFLASSFAFIAPILYGVQTWGIPSTMGGIIAAGLVYVLLGALVKVRGTDFIHKLLPPVVVGPVIIIIGLGLAPVAVNMALGKSGDGSLTLVPTNTALIISLASLCTTIAVAIFAKGLLKVMPILAGIVVGYGLSLAFGIVDFAVVTAASWIAIPKFVAPEFNWHAIAFMIPVAIAPAVEHIGDILAISNVTGKDFMKKPGLHRTLTGDGVATIAAAAFGGPPNTTYSEVTGAVTLTRNFDPKIMTWTAITAITLAFVGKLGALMQTIPVPVMGGIMCLLFGSIAAVGLNTLIRNHVDLSEPRNLSIVGVTLVFGIGGMAFGIGSFSLTGISLCGIVAITMNLLLPASKHHERDAASH

SEQ ID NO: 13409 - protein, 270 aa, Oryza sativa
MEDAGDSARAGGGRRRGATESLTNHGVETSLMDDVLNLAREFFNQPIERKRKFSNLIDGKNFQVEGYGTDRVVTQDQILDWSDRLFLRVEPKEERNLAFWPDHPESFRDVLNEYASRTKRIRDDIVQAMSKLLGLDEDYFFDRLNKAPALARFNYYPPCPRPDLVFGVRPHSDGSLFTILLVDEDVGGLQIQRDGKWYNVQVTPNTLLINLGDTMEVLCNGIFRSPVHRVVTNAERERISLAMFYSVNDEKDIGPAAGLLDENRPARYRK

SEQ ID NO: 13410 - protein, 495 aa, Escherichia coli
SYYHHHHHHLESTSLYKKAGLMQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVVNILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVGKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 13411 - protein, 197 aa, Pisum sativum
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIILVGTKLDLRDDKQFFVDHPGAVPITTAQGEELRKLINAPAYIECSSKSQQNVKAVFDAAIRVVLQPPKQKKKKSKAQKACSIL

SEQ ID NO: 13412 - protein, 493 aa, Salinibacter ruber DSM 13855
MSLPQFLFVCTTTPTTTRHPMEETEEYLPSASNSITVRVVISNRPGMLAKVTSVIGEHGGNIGAIDIVRAEKDELTRDITINTRSDDHAESIVQALRDLDGVEVVNISDRTFLLHLGGKVEVESKSPLRTRDQLSMAYTPGVARVCEAIHETPEDTHRLTIKSNTVAVVSDGTAVLGLGDIGSGAALPVMEGKAQLLKEFANVNGFPICLDTTDVDEIVNTVRRIAPVFGGINLEDIAAPRCFAVEERLKDELDIPVFHDDQHGTAVVTAAALLNALKIVEKDLDEIKVVTVGIGAAGTAVTEMFMEMGVENIVGVDSHGPVTPERDDLNDAKRQYAEMTDPSVTGDTLSAVMEGADVFIGLSVPDILDVEDLNRMARDPIVFAMANPRPEIMPEVAYPHVAVMATGRSDYPNQINNVLCFPGLFKGALDCRAKGITSEMKIAAAEAIANAIDDQSLTPDYIIPSVFDENVVAQVSSAVSQTAQKQGLARKRT

SEQ ID NO: 13413 - protein, 185 aa, Triticum aestivum
  misc_feature (153)..(153): Xaa can be any naturally occurring amino acid
  misc_feature (179)..(179): Xaa can be any naturally occurring amino acid
SGLAATSGKLCQLCEQYSSEALLYLTQNETQTEILSILHHECASLAPLKQQCITLVDYYVPLFFLEVSMVTPEKFCESMHLCKKGMKISLPTREGTCGLCHHVVVEILIMLKDPNMQLEVIDLLTKTCSKAQNYEQQCKRLVLKYIPLILVKXQKFLETTDVCSVIHACKAGTQASMEXCLVCML

SEQ ID NO: 13414 - protein, 233 aa, Candida albicans
SSCEDEHHNHNHGHNQNHNHVAPIPTTAGQSLNNKIDTSKVTALNMANSADDLAKVFKDSTKKYQIKPIIKSDSDEQMIINIPFLNGSVKLYSIILRTNGDLYCPKTIKLFKNDTSIDFDNVDSKKPIQVLTHPQVGVANNDSDDLPEFLESNNDDDFVEHYVSRHKFTGVNQLTIFIEDIYDEGEEECHLHSIELRGEFTELNKDPVITLYESAANPADHKNLTIVENQNLA

SEQ ID NO: 13415 - protein, 372 aa, Yersinia pestis KIM
MELPMNQSYLWATLLTLAVLCINKSIFNRRFRDCVMKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVTAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 13416 - protein, 284 aa, Streptococcus pneumoniae
MKLDGYTRLAAVVANPIKHSISPFIHNRAFEATATNGAYVAWEIEASDLAETVANIRRYQMFGINLSMPYKEQVIPYLDKLSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQGNPAVNGLGMLLYQAAEAFQLWTGKEMPTEEIWQSLTEKYQ

SEQ ID NO: 13417 - protein, 282 aa, Helianthus annuus
MSLVGGFTEVKDFANSIVIDDLARFAVDEYNKKQNTLLEFRKVLNAKEQIVSGTLYYITLDAANGGIIKTYEAKVWVKKWENLKELQEFKPVDAATSVIGGITEVKDFANSLEIEDLARFAVDEHNKKQNTLLEFGKVLNAKEQIVAGKLCYITLEATDGGVKKTYEAKVWVKPWENFKELQEFKPVDAATPVIGGITEVKDFANSLVIDDLARFAVDEYSKKQNTLLEFERVLDAKQQIVAGTMYYFILEATVGGVKNTYVAKVLLKPDNSKELKEFKHLY

SEQ ID NO: 13418 - protein, 284 aa, Streptococcus pneumoniae
MKLDGYTRLAAVVANPIKHSISPFIHNRAFEATATNGAYVAWEIEASDLVETVANIRRYQMFGINLSMPYKEQVIPYLDELSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQGNPAVNGLGMLLYQAAEAFQLWTGKEMPTEEIWQSLTEKYQ

SEQ ID NO: 13419 - protein, 497 aa, Nicotiana tabacum
MSTIMAKMMSGSTPINPGSTGRTSSPSLTPPPASLPVRTIPGGYGWPLLGPISDRLNYNWFQVPNTFFTKRIEKHKSTVFRTNVPPCFPFFLGVNPNVVAVLDVKSFSHLFDMEIVEKANVLVGDFMPSVQYTGDMRVCAYLDTSEPKHTQIKNFSLDILKRSSKTWVPTLVNELNTMFETFESDISKSNSASLLPTMQKFLFNFFSLTLLGANPSASPEIANSGYVMLDPWLAIHLAPTVSIGVLQPLEEIFVHSFSYPFFLVKGGYEKLIQFVKNEAKEVLNRGKSEFGLTEQEAIHNLLFILGFNAFGGFSIFLPTLLGNLGDEKNAELQEKLRNEVREKVGLKPENLSFESVKEMELVQSFVYETLRLSPPVPTQYARARKDFKLSSHDSVYEIKKGELLCGYQPLVMRDPKVFDNPEKFVLERFTKEKGKELLNYLFWSNGPQTGRPTESNKQCAAKDIVTLTASLIVAYVFQRYDSVSFSSGSITSVKKAS

SEQ ID NO: 13420 - protein, 666 aa, Bacillus clausii KSM-K16
MKPLTKENISQLSVTTVRTLSIDSVEYAQHGHLGMPLGAAPMAYALYRNVLKHNPKNPKWYDRDRFVLSSGHGSILQYTLLHLTGYDVSLSDLKNFRKLGSKTPGHPEVGYTPGVEATTGPLGQGLPMVVGMAIAERHLAAKYNKDDLNIVDHYTYTICGDGDLMEGVGQEAMSLAGHLGLGKLIVLYDSNDICSDGSVTDSNTENVQEKYKTMGWQTILVEDGNDLEKIQQAIELGKKETNKPTLIEVKTVIGYGSPNLSGTEHIHSNPVGEKEAQLIKQQYGWHFEDPFHIPDKVKEDFSQVLSNGLDNENKWNELFKQYQQKYPALATEFIRSMENEIEINELSTEFTEEKVATRSASGTVLNEVASKVPSIIGGSADLASSNKTTLRDNEFMTKEDYRGSNIHFGVREFGMAAIINGIALHGGIKGYCGTFLVFSDYMRSAIRMSAIMKVPVTYVFTHDSIMLGPDGPTHQPIEHLISLRAMPNLNVIRPADANETKAAWLIAANSKKTPTAIILGRHDVPVLDNASLEGVRKGAYLISEGTEEATGIIIATGSEVELAIKAQNILESKNIFVNVVSMPSWELFNQQNEDYKNSVLPSNLDNKLAVEMGSDIGWREYIGPKGDTITINTFGDSGNGQELAEKLGFTPENIAHRFIELKERNL

SEQ ID NO: 13421 - protein, 267 aa, Shewanella sp. ANA-3
MDGLTGKVVIITGASEGIGRALAIAMARVGCQLVLSARNETRLASLALEIANYGPTPFVFAADVSSASQCEALIQATIAHYGRLDILVNNAGMTMWSRFDELNQLSVLEDIMRVNYLGPAYLTHAALPYLKSSQGQVVVVASVAGLTGVPTRSGYAASKHAVIGFFDSLRIELADDNVAVTVICPDFVVSQIHKRALNGEGKPLGKSPMQEAKIITAEQCANMMLPVIATRGRQLITSLRGRLGRWLKLIAPGLIDKIARKAIASGH

SEQ ID NO: 13422 - protein, 284 aa, Streptococcus pneumoniae
MKFDGYTRLAAVVANPIKHSISPFIHNRAFEATATNGAYVAWEIEASDLAETVANIRRYQMFGINLSMPYKEQVIPYLDELSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQGNPAVNGLGMLLYQAAEAFQLWTGKEMPTEEIWQSLTEKYQ

SEQ ID NO: 13423 - protein, 353 aa, Ralstonia metallidurans CH34
MKAAVYYGPQDIRCTDIPDPVIRSDHEMLVKVTATSICGSDLHLYRGALDGIMEKGKSQTGHELIGEVVEVGKSVGRFKQGDRVSMGYSVSCGHCYMCEVGQTAHCETTKNAVYGFGIPFGSINGTHAEALIVPHADGHAMNVPKGIPDEAAVTLSCNLPSAIIANRLADIQVGENVALVGCGPTGMMTLDIALHRGPGRVVVLDKVAHRLDVVRKKGGVAIDANQEDWKEKALAETGGRGFDKVIEVVGYPETLQMCLDLVRPGGTVAAIGVFCDSTFNLNLADVFLRNISLHMNGFANAQPYMWEALRLMERGVINPQEYFSHAFELADVDKAFSVFHQKSDSAMKVLIRP

SEQ ID NO: 13424 - protein, 250 aa, Photorhabdus luminescens subsp. laumondii TTO1
MAVTKLVLVRHGESEWNRENRFTGWTDVALSEKGRAEAQQAGQLLKEEGFVFDFAYTSVLKRAIHTLWNILDQVDQQWLPVEKSWKLNERHYGALQGLDKAETAAKYGDDQVKLWRRGFAITPPDLTKDDERFPGHDPRYANLKPEELPVTESLATTIERVIPYWEEVIKPRVAQGEKVIIAAHGNSLRALVKYLDNMSEETILELNIPTAVPLVYEFDENMKPIKHYYLGNADEIAAKAAAVANQGKAK

SEQ ID NO: 13425 - protein, 247 aa, Bacillus subtilis subsp. subtilis str. 168
METFKSILHEAQRIVVLTGAGMSTESGIPDFRSAGGIWTEDASRMEAMSLDYFLSYPRLFWPKFKELFQMKMSGSFEPNEGHLLLAELEKQGKQVDIFTQNIDGLHKKAGSRHVYELHGSIQTAACPACGARYDLPHLLEREVPECTAAGNNGDICGTVLKTDVVLFGDAVMHFDTLYEKLDQADLLLVIGTSLEVAPARFVPEDASLIPGMKKVIINLEPTYCDSLFDMVIHQKIGEFARSLGMKK

SEQ ID NO: 13426 - protein, 380 aa, Listeria ivanovii
QNRWRPELHDIQVSGIRAFNTRVTGIPDMIRLTLGEPDFPTPEHVKQAAIQAIQDNFTNYTPNAGMPELLEAASTYFQEKYNLEYNTNEIIVTVGATEAISVALQTILEPGDEVILPDPIYPGYEPLITLNKAHPIRIDTTETNFKLTPTQLRKHITPKTKALIIPYPSNPTGVSLTKEELVDLANVLREAGIFVIADEIYSELIYHEEHASIAPMLREQTIVINGLSKSHAMIGWRIGFLLAPEIITKQMLKIHQYSVTCASSISQKAALEAITNGKDDAFQMRTEYKTRANFTQDRLEKMGFTVVPPDGAFYFFVKLPDEITENSFDWAVKLAEEAKVAVVPGNAFSEKGDRFFRLSYATSFNKLAEALDRMAAFLSK

SEQ ID NO: 13427 - protein, 232 aa, Nicotiana tabacum
MGYWQAKVVPKIKQIFDKNGPKKAAAAEACKTFDEAKALYSKEFEDKKTELQPKVVEIYEAAAVEIKTLVKEPKVSGLKKHSTEVQKLLDELVKIEFPGSKAVSEASSNFGPSYVFGPVLFVFRESSTFIVTENKKVEEAAVPVAASSSEEEAAASVAAASEAEAIAAAPVEVKKKEIVVEAEAKKEEEPAPAPAAEVAPAPAAEVAPAADVAPAKVEERAPAAAAPEPPKA

SEQ ID NO: 13428 - protein, 589 aa, Phytophthora infestans
MSSSSRKFFVGGNWKCNGSLGQAQELVGMLNTAKIPVNVEVVVAPSQVHAATVKASLRSYVRVSGQDVWKQGNGAFTGETSAEMLKDLGAEYTLVGHSERREKGETNEVVAKKAAYALEKGLGVIACIGETKDHREANQTVAYITEQLDAYAAEINDWTNVVIAYEPIWAIGTGLTASPEQAQEAHASIRAWLKEKVSPEAAEQTRVIYGGSVGAKNAPELSQKEDIDGFLVGGASLKPDFLQIINAQNPTANVGGAVNVAINGFGRIGRLVLRASAKNPLINIVAINDPFVSTTYMEYMLEYDTVHGKFDGSLSHDETHIFVNGKPIRVFNEMNPENIKWGEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALTDDFVKLVSWYDNEWGYSSRVLDLIEHMVKNE

SEQ ID NO: 13429 - protein, 357 aa, Pseudomonas fluorescens PfO-1
MATMKAAIFVEKNRIVLDDKPIPEVGPLDALIRITTTTICGTDVHILRGEYPVAKGLTVGHEPVGIIERLGSQVRGFVEGQRVIAGAITPSGQSYACLCGCGSQDGPDTRHGFRAIGGWKFGNTIDGCQAEYVLVPDALANLCPIPDGLSDEQVLMCPDIMSTGFSGAERGEVSIGDSVAVFALGPIGLCAVAGARLKGASTIIGVDAVAERMTVARRLGATHVVNFREGDVVEQIMALTDGRGVDVAIEALGTQGTFESALRVLRPGGRLSSLGVYSSDLRIPLDAFAAGLGDYSIVTTLCPGGKERMRRLMAVVQSGMVDLSPLVTHRFKLDDIEAAYDLFAHQRDGVMKVAITP

SEQ ID NO: 13430 - protein, 326 aa, Arabidopsis thaliana
MGKQINNTFTWVIKNLSTLQGLEVRSKIFVVGGCKWRLIAYPEVNDADGYLSLSVYLGVPDCCESLPSGWKRHAKFSLTIVNQLSEGLSQVQETQAWFDENAPGWGFPPMLNLKDVSDKYGGFLVNDEVMVAVAVDVIEVVGSLDAPEMSESMDIKGFKVLPSQVKSVNRLFESHPDIASKFSIKNQSLKTAYMNVLLCLAETLHQSPMEISEDDLSDAKTTLAYMKSVGFKLDWLEKKLDELFEKKKEEADKIRMQNIEEELKDLRQKCSSLEALLKKEKTGVLAAKAPFLFFNNVNDDDLKWILRAVFYFDKFASSSSRVFDKL

SEQ ID NO: 13431 - protein, 456 aa, Salmonella enterica subsp. enterica serovar Typhi str. CT18
MDSQQHGEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 13432 - protein, 126 aa, Arabidopsis thaliana
MREDTMFKKALELSTLCDIEVCVILYSRDGELIKTWPEDQSKVRDMAERFSKLHERERRKKRTNLSLFLRKKILDNSKLSEKVLEMKDSLESGLRVLQDKLLLLQPEKNQTELGQIPVINNGQNHW

SEQ ID NO: 13433 - protein, 251 aa, Aspergillus oryzae
MGVAFDKCETRPANIDAILSGLDRYNPETTTIFQDYVVQQCEDRTFDCYANLALLKLYQFNPHLLQAETVTNILAKALTVFPSPAFSLCLSLLPAHTQPFPSNTEAQAASQTSDFVESVQKLARLSTLLESAQYAQFWSTLNSDDLYADLTADVAGFEELVRIRIAVEVGKAFREINAEVLEQWLDLRSREALEKFVAEVCSWEVDKSGPNGTVVKVPTNKENEVRSEVKSERVGVEMFGRVIRRGFEQAA

SEQ ID NO: 13434 - protein, 887 aa, Salmonella enterica subsp. enterica serovar Typhi str. CT18
MSERFQNDVDPIETRDWLQAIESVIREEGVERAQYLIDQLLSEARKGGVKVAAGAGASNYINTIAVEDEPEYPGNLELERRIRSAIRWNAIMTVLRASKKDLELGGHMASFQSSATIYDVCFNHFFRARNEQDGGDLVYFQGHISPGIYARAFLEGRLTQEQMDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIVNELEGIFAGAGWNVIKVMWGGRWDELLRKDTSGKLIQLMNETVDGDYQTFKSKDGAYVREHFFGKYPETAALVADWTDEQIWALNRGGHDPKKVYAALKKAQETKGKATVILAHTIKGYGMGDTAEGKNIAHQVKKMNMDGVRYVRDRFNVPVADADLEKLPYITFPEGSEEHKYLHERRQALHGYLPSRQPNFTEKLELPQLSDFGALLEEQSKEISTTIAFVRALNVMLKNKSIKDRLVPIIADEARTFGMEGLFRQIGIYSPNGQQYTPQDREQVAYYKEDEKGQILQEGINELGAGASWLAAATSYSTNDLPMIPFYIYYSMFGFQRIGDLCWQAGDQQARGFLIGGTSGRTTLNGEGLQHEDGHSHIQSLTIPNCISYDPAYAYEVAVIMHDGLERMYGEKQENVYYYITTLNENYHMPAMPAGAEEGIRKGIYKLETLEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAITKFNIDADKVNPRLA

SEQ ID NO: 13435 - protein, 503 aa, Ralstonia metallidurans CH34
MLITDPQATASTGNQSGARAKEIHNFINGEYVPGQRWFEKRSPLNNAVIAKVAEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAMRRPVGVVGVICPWNLPLLLMTWKVGPALACGNTVVVKPSEETPQTAALLGEVMNAAGVPRGVYNVVHGFGPNSTGEFLTTHRGINAITFTGETRTGAAIMKAAADGARPVSLEMGGKNAAIVFADCDFDAAIEGTLRSCFANCGQVCLGTERVYVERPIFDRFVSALKKGAEGMQLGRPEDPATGMGPLISQEHRDKVLSYYKKAVEAGATVVAGGGVPDMPDALKGGAWVQPTIWTGLGDDSVIAREEIFGPCVLVMPFDSEEEVIRRANDNDYGLATAIWTTNLSRAHRVAGAIEVGIAWVNSWFLRDLRTPFGGAKQSGIGREGGVHSLEFYTELKNVCIKL

SEQ ID NO: 13436 - protein, 516 aa, Bacillus clausii KSM-K16
MFTPYKHEPFTDFTIEANKQELLTAIKQVEANLGGHYPLVINGERVETDDTISSYNPANKQELIGTTGKATKAHAEQAIEAASTAFESWRTVAPAERANILVRAAAIVRRRKHEFTALLIKEAGKPWKEADADTAEGIDFMEYYARQMVELAEGKSVHSREGELNRYIYTPTGVTVVISPWNFAFAIMAGTTVAPLVTGNTVLLKPASTTPVVAAKFVEVLEEAGVPKGVINFVPGSGSEVGDYLVEHPKTALITFTGSRDVGVRLYEKAAIVQAGQNHLKRVIVEMGGKDTVVVDNEADIDTAVEAIVISAFGFSGQKCSAGSRAVIHEDLYDEVVAKVVEKTEALTVGNPADATNYYMGPVIDQAAFDKITGYIEIGKSEGKLVAGGKSDDAEGYFIHPTVFADVDPKARIMQDEIFGPVLAISKASTFAEALDIANNTEYGLTGAVITNNRAKIEQAKQDFHVGNLYFNRNCTGAIVGYHPFGGFKMSGTDSKAGGPDYLTLHMQAKTISEMF

SEQ ID NO: 13437 - protein, 415 aa, Glycine max
MDPCPFVRILVGNLAVKSPASSKPSSFSGKVHPSSSPFFCKILLQGLDSNSTSPRVSSVPLISDSDPHPHSFAASFDFSKAQILKASKKPLMKISVYKGPTTPSCVFTSAKLLGKVSIPLDLTLAESRPCTFHNGWLSLSKNTNPSQLLHLTVRAEPDPRFVFRFDGEPECSPQVFQIKGDVKQPVFTCKFSFRDKDKAHFPSLNANHAAERKGWSITVHDLSGSPVAAASMATPFVPSPGSQRVSRSNPGAWLIIRPDGDGTWKPWGRLEAWREPNNSNAVGYRFEVLPGTADPVTLAASTISSQHGGKFAIDATSGVTPVNTPRGSWDLGSGSGSGSNSDFGLEPNFFYNKGFVMSAMVSGEGKCSKPEVEVGVQHVTCTEDAAAFVALAAALDLSIDACKLFSQKLRKELRQ

SEQ ID NO: 13438 - protein, 356 aa, Oryza sativa (japonica cultivar-group)
MAKYGEGDARWIVQERADGTNVHNWHWAERDCLEWSRSRLTSLLAGLPVLSGEGGLALRTTALDKLDGEAYVNIRKGKVIPGYELSLTLAWEAEATTESGVVKVSGAAEVPYLADENADEDPELRVTVRGDDGPVARRAKDAFLTKGKPLVLEKIREYVAAMAKGGPAKDELDSKKTPTKAAAVEAGGAATAPAPAAEKKEEAPAVKEKKAKAKDKEGFKTIEMTEKFYCRAKDMYEILMDENRWKGFTQSNARISREVGGQFSLFDGSISGVNEELQEGKLIVQKWRFGSWPDGVHSTVRLVFDEPESGVTVISLKQTDVPEEDRYGNSTVVENTERGWRELIFQRIRGVFGFGI

SEQ ID NO: 13439 - protein, 416 aa, Arabidopsis thaliana
MIYTAIDNFYLSDEQLKASPSRKDGIDETTEISLRIYGCDLIQEGEILLKLPQAVMATGQVLFQRFYCKKSLAKFDVKIVAASCVWLASKLEENPKKARQVIIVFHRMECRRENLPLEHLDMYAKKFSELKVELSRTERHILKEMGFVCHVEHPHKFISNYLATLETPPELRQEAWNLANDSLRTTLCVRFRSEVVACGVVYAAARRFQVPLPENPPWWKAFDADKSSIDEVCRVLAHLYSLPKAQYISVCKDGKPFTFSSRSGNSQGQSATKDLLPGAGEAVDTKCTAGSANNDLKDGMVTTPHEKATDSKKSGTESNSQPIVGDSSYERSKVGDRERESDREKERGRERDRGRSHRGRDSDRDSDRERDKLKDRSHHRSRDRLKDSGGHSDKSRHHSSRDRDYRDSSKDRRRHH

SEQ ID NO: 13440 - protein, 225 aa, Methanosarcina barkeri str. Fusaro
MVSREYVKGDLPEKAAILQRDGETYAIAPHIPGGIVYPETLRKIADIAEKYGAAALKITSAQRIAIVGLKEEDLDAAWGELNLKPGAAIGLCVRSVKICPGTTFCKRGKQDSVGLGLKLDEKYHGMQLPSKFKMGVSGCQNSCSEPMIKDIGLMGTAKGFTLSVGGSAGPRPRLGSVVAKDLTEEQALDLVERIIDFYKKYPKPRRLGEVIDEIGLEKFKEEVGL

SEQ ID NO: 13441 - protein, 455 aa, Oryza sativa (indica cultivar-group)
MASQPPALDILVREPDGFSVWSGPPYPTGSAPPVRLPKTACSATYFSSDGSRLLATVASASATVYDCRTLSVVRSFELPGLLAAALSPAGTFLQTFQKSSSPQEKNVTVWHVDTATALYQHYQKNMSKATWPMVQFSADESVACRMMTNEIQFFDPKDFTKGFVYKLRMPGIAAMQLASAPGSHVAGFVPEAKGVPASVQIFSCDKDAQGQAVARRSFFRCSTVQFHWNKGSTGLLVVAQADVDKTNQSYYGETKLNYLTTDRAFEGIVPLKKKLVGKTKAECSVTSEWSPDGRHFMTATTAPRLQIDNGIKIFDHNGSLQFKKMFEKLYQADWKPEAPEKFSDIADLTISLGSIKIEETKKQGSLHFLIFHVISAQGSKSAQPSSKAPANIAAKPTAYRPPHSKNSADVQDKLFGGLASTGGEMSKNALRNKKRREKQKEKKAAEGSGASADDN

SEQ ID NO: 13442 - protein, 368 aa, Triticum aestivum
MMNPKSRVQEWVADHIELIPGMPDDVAVDCLARVPHGSYRSMRRVCRGWRSAAAAPEFALARAEAGANEDLVFLMQFGNPVAGDDGAPENAPAYGVAVYNVTTGEWHRESSAPPVPMFAQCAAVGTRVAVMGGWDPKTFEPVADVNVLDAATGVWRRGAPMRSARSFFACAEAGGKIYVAGGHDKLKNALKTAEAYDAEADGWDPLPDMSEERDECDGMATVAGDRFLAVSGYRTGRQGGFERDAEWFDPATREWRRLERVRAPPTAAHVVVRGRVWCIEGTAVMEWRGERRGWLEVGPYPPGLKAGTARAVAVGGGERVVVTGAIESEGGGGGHALWVFDVKSKNWTVVRPPPQFAGFVFSLASVRV

SEQ ID NO: 13443 - protein, 509 aa, Oryza sativa (japonica cultivar-group)
MTLLCVPLVSRTVEAMQADAAAAAAAGADLVEIRLDFIEGFRPREHLPSLLRGCPLPALVTYRPNWEGGQYDGDDATRFEALRLAMELGVDYVDIELKVADKFISFISGSKPEKCKLIVSSHNYESTPSCEELADLVARIQAVGSDIVKIATTASDIADVSRMFQVMVHCQVPMIGLVMGEKGLMSRVLSPKFGGYLTFGTLDATKISAPGQPTVKELLDIYNIRRIGPDTKVLGLIANPVKQSKSPILHNKCLQSIGYNAVYLPLLADDLARFLSTYSSPDFSGFSCSLPFKVDAVQCCHEHDPVAKSIGAINTIIRRPDGKLVGYNTDYIGAISAIEDGIGGPGSKDAAISPLAGRLVVVVGAGGAGKAIAYGAKEKGARVVVANRTYEKAVSLAAAVGGHALRLAELETFRPEEGMILANATSLGMYPNVDGTPIPKKALSFYDVVFDAVYAPKVTRLLREAEECGIKVVSGVEMFVRQAMGQFEHFTGGIEAPESLMREIAAKYT

SEQ ID NO: 13444 - protein, 657 aa, Oryza sativa (japonica cultivar-group)
MPNCLISLARPAAPTLPHSHLTNPRHPATPTATAATPKPNTPPDPTRPAPHLTLHHQYSGTLPLPISLARAFTSSLPKEEEEEMTLLCVPLVARTVEAMRADAAAAAAAGADLVEIRLDFIGSKFRPREDLPRLLRGCPLPAIVTYRPNWEGGQYEGDDATRFEALRLAMELGVNYVDIELKVADKFISFIYGSKPEKCKLIVSAHNYESTPSCEELADLVARIQAVGADIVKIATTANDIVDVSQMFQVMVHCQVPMIGLVMGEKGLMSRVLSPKFGGYLTFGSLDATKVSAPGQPTVEELIDIYDIRRIGPDTKVLGVIANPVKQSKSPVLHNTCLQSVGYNAVYLPLLADNIARFLSTYSSPDFSGFSCSLPFKVDAVQCCHEHDPVAKSIGAISTIIRRPDGKLLGYNNDYIGAICAIEDGIGGPGSKNAAVTPLAGRLLVVVGAGGAGKAIAYGAKEKGARIVVANRTYEKAVSLAAAVGGHALRLAELETFRPEEGMILANATSLGMYPNVDGTPIPKQALSFYDVVFDAVYAPKVTRLLREAEECGVKVVSGVEMFLRQALGQFERFTNGIEAPESLMREFHVCDGLSARMRLKCHRVVMEACPTLDRSEPFVSMDNNPTSRSGGVLPTAVASRGRIRYRRLPAVDPAMT

SEQ ID NO: 13445 - protein, 349 aa, Triticum aestivum
MGVHAAPFPFPLPRRQDEDDDADDTIVLGGGGGRWGAAAMPAEDEAVEQSPTAPPISSCGRYILHRVCRFDTLAGVAIKYGVEVADVKRVNGLTADLQMFAHKTLRIPLPGRHPPAQHSPPSSSPAAAAAAREWTTRRPPKNAALDPFQKPPRSTVSPSMSLLQGYYGLAPPPKRDLTDEGTEMATSVKGQHRKARSISTGFPGVNGDAGWDTDDAEKQIRRRQKADLELTTMREDNGGALLPRTGEGLALRPKSGSRPDMNNSQQDLIAAGFVPSYGDGLLAVRKSSSTPEFQDSDNNIASVWLSKWNLKPDAFAVPLPILLLDSLPKPLFDSLPKPIAAWRNKAARD

SEQ ID NO: 13446 - protein, 475 aa, Salmonella enterica subsp. enterica serovar Typhi str. CT18
MMSTEIKTQVVVLGAGPAGYSAAFRCADLGLETVIVERYNTLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIQLPFIPHEDPRVWDSTDALELKEVPKRMLVMGGGIIGLEMGTVYHALGSEIDVVEMFDQVIPAADKDIVKVFTKRISKKFNLMLETKVTAVEAKEDGIYVSMEGKKAPAEAQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEIFEGSITDLPNPKAKKK

SEQ ID NO: 13447 - protein, 462 aa, Trichodesmium erythraeum IMS101
MVKLTPNPSFSLTISLETPNRTGMLAKVTQAIASEGGNIGNVDLIKQSRQIIIREITVDAYSTEHIEKIVQAVKTLPEIKLVNVYDRTFDIHKGGKITVQGKIPLKSQADLSMAYTPGVGRISKAIAEDPQQIYNFTIKKNTVAIVTDGSAVLGLGNLGPGGALPVMEGKAMLFKEFAGIDAFPICLATQDTDAIVETVKNIAPVFGGVNLEDIAAPRCFEIEVKLREILDIPVFHDDQHGTAIVSLAALINALKLVKKSIEDIRIVINGAGAAGIAITRLLQKAGANQICLCDSKGIVSKSRTGLNSEKQAFAVESSGTLADALMGADVFLGVSVPGVLTPEMVRSMAKDPIVFAMANPIPEIQPELVAEEVAVMATGRSDYPNQINNVLAFPGIFRGALDCRATTLTSTMYLEAARAIASLVKTSDLDQEHIIPSVFDTRVATAVAGAVASAARTEGVTV

SEQ ID NO: 13448 - protein, 118 aa, Zea mays
  misc_feature (23)..(23): Xaa can be any naturally occurring amino acid
  misc_feature (38)..(38): Xaa can be any naturally occurring amino acid
MSASASSPAAAAGDEKQEAAPSXCKGVNDLDKVVLREXRGSSAEVYLYGGHVTSWKDEHGDELLFVSNKAIFKPPKAIRGGIPICFPQNRTWSVDDDPPPFPVPTSNSAYIDLILKPT

SEQ ID NO: 13449 - protein, 480 aa, Silicibacter sp. TM1040
MLEKREFYINGQWVEPSAANDCAVIDPSTEEPCTVISLGSQADTDAAVAAAKAALPGWMATPPAERIALVEKLVEIYNSRAEDLAQAMSSEMGAPIDMSRSSQVGAGSWHLNGFIEAAKNFQFERPLGDHAPNDRIIYEAVGVAALITPWNWPMNQITLKFGAAAIAGCTMVLKPSEQSPLNAMIFAELVHEAGFPPGVFNLVNGDGAGVGTQLSSHPDVDMVSFTGSTRAGTAISKAAADTLKKVHLELGGKGANLVFEDADEKAVKRGVLHMMQNTGQSCNAPSRMLVQKSIYDRVVEEAAAVANKVEVGPASQEGRHIGPVVNELQWTKIQDLIQKGIDEGARLVAGGTGRPDGLNKGYYVKPTVFADVNNQMTIAREEIFGPVMAIIPFETEEEAVEIANDTPYGLTNYVQTQDGARANRLARVLRSGMVEMNGKSRSAGSPFGGMKQSGNGREGGVWGLEDFMEVKAVGGWTPDA

SEQ ID NO: 13450 - protein, 304 aa, Trichodesmium erythraeum IMS101
MFKNLSNINQQQLNTWVKQVLTQTKSGNLPNYIPLLAEANPNSFAILLQSIDHHIISFGDIKTKVPLMSAIKPFLLFYLLSQFGNELIFKKVGQKPSEKPFNSLEQLEFDGGWPRNPMINSGAIALSSLIPGNTAREKCNNFCSWLNSYGNCQLFLDENMLASVRSLPNQNNQNIAQKLVESGSIKDAKITLDTYNQICCLSGKIIDIANLGILLVNSPHSEWQKHCFTVKTLMTNCGLYETSNRYAMDIGIPIKSSISGIVLGLVPAKGVIVCYSPPLDQQGNSVAGLLLLELISRNLEKQYN

SEQ ID NO: 13451 - protein, 149 aa, Arabidopsis thaliana
MEFSGDAGMMMENKRNVCSLGESSIKRHKSDLSFNSKERKDKVGERISALQQIVSPYGKTDTASVLLDAMHYIEFLHEQVKVLSAPYLQTIPDATQEELEQYSLRNRGLCLVPMENTVGVAQSNGADIWAPVKTPLSPAFSVTSQSPFR

SEQ ID NO: 13452 - protein, 355 aa, Zea mays
MSAYCGKYADELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 13453 - protein, 321 aa, Oryza sativa (japonica cultivar-group)
MAGSRAAGRGGRPLLGGGGGKRGGGGGGGGGGGGKSSSYTTTVILAALLLASVALLLLVALGALSLPSGGGVGVGHAGIGLPRPRPRFRRSAAFESGLEMRGGEKGEPWTEVLSWEPRAFLYHNFLSKEECEYLISLAKPHMKKSTVVDASTGGSKDSRVRTSSGMFLGRGQDKIIRTIEKRISDYTFIPVENGEGLQVLHYEVGQKYEPHFDYFHDEFNTKNGGQRIATLLMYLSDVEEGGETIFPSSKANSSSSPFYNELSECAKKGLAVKPKMGDALLFWSMRPDGSLDATSLHGGCPVIKGNKWSSTKWMRVHEYKI

SEQ ID NO: 13454 - protein, 597 aa, Dehalococcoides sp. CBDB1
MAVNDREFHLKELDPVLMKDWEIAEKAEDFLKPVKVLAMELGLTEDEIIPHGKYIAKVDFAGVLARLKDRPNGKYIDVTAITPTPLGEGKSTTTMGLVQGLGKLGKKVTGAIRQPSSGPTFNIKGSAAGGGLSQCLPLSPFSLGLTGDIDAVTNSHNLAMVALQARLQHEANNTDEFLSSRHLTRLDIDPSRVEMKWAMDFCAQSLREIIMGIGGKTDGYRMPSGFGISVSSEVMAILSVFTSLSDLRERMGKIIVAYRKNDEPVTTADLEVDGAMTALLLRAVNPNLLQTIEGQPVFVHAGPFANIAIGQSSIVADRLALKLADYHVTESGFGADIGFEKFWNIKCRLSGLKPDCAVIVVTARALKMHGGGPKVTPGAPLDPAYTTPNTKLVEKGCQNMLAHIQTVKTAGINPVVCINHFAADTHEEIDIIRRTAEQAEARVAVSHHWAKGGDGATELAEAVTDACNEPNNFHFLYPENMPLKKRIETIARKVYGANGVSYTPIAMEKLARIESMGDTQFMPTCMVKTHLSLSHDPALKGRPSGFTLPIRDILTYMGAGLVVPVAGDIKLMPGTSSDPNFKRIDVDTQTGKVKGLF

SEQ ID NO: 13455 - protein, 411 aa, Zea mays
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNVDGLDIAQLVKHSAENKGIKGFKGGDAIAPDSLLTEECDVLIPAALGGVINKDNANDIKAKYIIEAANHPTDPEADEILSKKGVLILPDILANSGGVTVSYFEWVQNIQGFMWDEEKVNAELRTYITRAFGNVKQMCRSHSCDLRMGAFTLGVNRVARATVLRGWEA

SEQ ID NO: 13456 - protein, 156 aa, Musa acuminata
PLLLSPLASTSSITQNTRSLFSPMAVAAIAEAPFHVLAVDDSVLDRKLIERLLKTSSFQVTTVDSGTKALQFLGLHAEDASISSVHADQLDVEVNVNLIITDYCMPGMTGYDLLKKIKESSSFRDIPVVIMSSENIPSRINRCLEEGANEFFLKPV

SEQ ID NO: 13457 - protein, 308 aa, Brassica napus
  misc_feature (244)..(244): Xaa can be any naturally occurring amino acid
NSSKETKMRAKQLADEIGAWHLDVCIDGVVSAVLSLFQTVTGMRPRYKVDGGSNAEDPGLQNIQARMRMVLAFMLASLLPWVHSKPGFYLVLGSSNVDEGLRGYLTKYDCSSADINPIGSISKQDLRLFLRWAATNLGYQSLADIEAAPPTAELEPIRSDYTQLDEVDMGMTYEELSVYGRMRKIFRCGPVSMFKNLCYKWGTKLSPAEVAEKVKYFFKYYSINRHKMTVLTPSYHAESYSPEXDNRFDLRQFLYNSKWPYQFKKIDEIVDGLNGDSVAFPEEEEEEATSSQEFGVVAANSGDPSAGL

SEQ ID NO: 13458 - protein, 447 aa, Shigella flexneri 2a str. 301
MLNSILVILCLIAVSAFFSMSEISLAASRKIKLKLLADEGNINAQRVLNMQENPGMFFTVVQIGLNAVAILGGIVGDAAFSPAFHSLFSRYMSAELSEQLSFILSFSLVTGMFILFADLTPKRIGMIAPEAVALRIINPMRFCLYVCTPLVWFFNGLANMIFRIFKLPMVRKDDITSDDIYAVVEAGALAGVLRKQEHELIENVFELESRTVPSSMTPRENVIWFDLHEDEQSLKNKVAEHPHSKFLVCNEDIDHIIGYVDSKDLLNRVLANQSLALNSGVQIRNTLIVPDTLTLSEALESFKTAGEDFAVIMNEYALVVGIITLNDVMTTLMGDLVGQGLEEQIVARDENSWLIDGGTPIDDVMRVLDIDEFPQSGNYETIGGFMMFMLRKIPKRTDSVKFAGYKFEVVDIDNYRIDQLLVTRIDSKATALSPKLPDAKDKEESVA

SEQ ID NO: 13459 - protein, 354 aa, Arabidopsis thaliana
MKIEEDLGFINILKRATKLLCGNINLVLFLFLCSLPLFCFLIFFELSLQTTVSLASQYLVRQLTNWDYYYVPQDASVLENLIPLLIQTFLLYLFPYGLIDLFTTTTIVSASWTVHTSEEEPLRFGQLVRRTVEICQNRLEGCLITSLYVLLLSTPVFFGFLFVATNYFHIISLTGSGENSYYYSINIEEDAEGYYRSSSVNSPVKMLFDAVLAMFHGAIFLGLLAMFSKWSAGWNMGLVVSVLEEEENGQSIYGTDALTLSSNYGKGHEKRGLQVMLVFLVFAIAMRMPCFCFKCTESSNGNRVLYTSFYVGLICVGNMIKWVACVVFYEDCRTSVLEKKGDVEIGSKGMTFVA

SEQ ID NO: 13460 - protein, 468 aa, Oryza sativa
  misc_feature (116)..(116): Xaa can be any naturally occurring amino acid
MEPKPSTPTAAATPRFKLGKQSSMAPDRGGAGESSEEGSSEAVGVMGFQLMYMAHEGDVEGIQELLDAGADPNFRDSDGRTAMHIAACEGQAEVVELLLQRGADAVAEDQWGSTPXADALHYQNHDVIKILEKHGSKLKIAPMHVKNVREVPEYEISPNELDFTNGNGISKGTFRKATWRGILVAVKKLDDDLIMDENKVQAFRDELDVLQLIRHPNVVQFLGAVTQSSPMMIVMEFMPKGDLRKHLSRKGALEPSYAVKLALDIARGMNYLHEHKPQAIIHRDLEPSNILRDDTGHLKVADFDLCKMLKWRRKVREEKAVTSPGNACRYVAPEVLRNEEYDTKVDVFSFALILQEMIEGCLPFYDKKNNEIEKAHNSKERPPFRAPPKHYAYGLRELIEQCWSENPASRPDFRTIIEQLSYIQNEISQRNRWKVKPLKCFLSFEGMWKKDRNEGSTTRSSRSSRSYF

SEQ ID NO: 13461 - protein, 459 aa, Pseudomonas putida GB-1
MSSHEHSPGAAAPANELVLGLEDKPRLLIGLLAALQHLLAIIVPIVTPGLLICQALGVSARDTNLIVSMSLVISGIATFVQCKRFGPFGAGLLIVQGTSFNFVGPLIAGGALMVKQGTPVEGVMAAIFGVVIAGSFVEMGVSRILPFVKRLITPLVTGIVVLMIGLTLIKVGLISMGGGFGAMANGTFANGENLLLSGVVLAIIVILNRIPVVWMRSCAIVIALAVGYALAGYMGRLDFTGMHEAALFQVPTPLHFGLSFSWALFIPMLVIYLVTSLEAIGDVTATSKVSRQPVEGPVWMQRIKGGVLVNGANSLLAGLFNTFPSSIFAQNNGVIQLTGIASRHIGMWIAVMLVLLGLFPSVAGVIQAVPEPVLGGAAMVMFGAVAASGINILASTRLDRRALLIIAVSLALGLGVAQVPEFLAHMPAAIRNVLESGVATGGICALVLNWFLPESKEQA

SEQ ID NO: 13462 - protein, 286 aa, Salmonella enterica subsp. enterica serovar Typhi str. CT18
MAENTMWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVETITMVEIDAGVVSFCRQYLPNHNAGSYDDPRFTLVIDDGVNFVNQTHQTFDVIISDCTDPIGPGESLFTSAFYEGCKRCLNPGGIFVAQNGVCFLQQDEALDSHRKLSHYFSDVGFYQAAIPTYYGGIMTFAWATDNDALRHLSSEIIQARFHAAGLKCRYYNSAIHAAAFALPQYLHDALSAQ

SEQ ID NO: 13463 - protein, 220 aa, Salmonella enterica subsp. enterica serovar Typhi str. CT18
MKDIDTLISNNALWSKMLVEEDPGFFEKLAQAQKPRFLWIGCSDSRVPAERLTGLEPGELFVHRNVANLVIHTDLNCLSVVQYAVDALEVEHIIICGHSGCGGIKAAVENPELGLINNWLLHIRDIWLKHSSLLGKMPEEQRLDALYELNVMEQVYNLGHSTIMQSAWKRGQNVTIHGWAYSINDGLLRDLDVTATNRETLENGYHKGISALSLKYIPHQ

SEQ ID NO: 13464 - protein, 146 aa, Triticum aestivum
MPVPLAPYPTPPVPFTPPAPNAGAQSQLVCSGCRNLLMYPAGATSVCCAVCSTVTAVPAPGTEMAQLVCGGCHTLLMYIRGATSVQCSCCHTVNLAMEANQVAHVNCGSCRMLLMYQYGARSVKCAVCSFVTSVGASSGAEQKPSN

SEQ ID NO: 13465 - protein, 351 aa, Trichodesmium erythraeum IMS101
MKNDRGNVLVVDDNQFNRDLLARRVKRQGHMISSASDGFQALEMVRNHSFDLVLLDIMMPQMNGYQVLETLKADPALRHIPVIMISAVDDIDSIVRCIELGAEDYLSKPFNPILLKARINACLEKKRLRDQEQAYIKQLAEEQEKSEKLLLNILPAPIAQRLKQGEKTIADSFSEVTVLFADLVGFTKVSANLSPAELVELLNMIFSCFDQLADKYGLEKIKTIGDAYMVVGGLPTLRKDHAEAIAEMALDMLYQVKQISESQEKSLQIRIGLNTGAVEAGVIGTKKFAYDLWGDTVNTAHRMESHGIPGVIQVTEDTYGCLANKYIFQERGIINVKGKGMMKTYLLISRK

SEQ ID NO: 13466 - protein, 379 aa, Coprinopsis cinerea okayama7#130
MNYIQGRSRTTNEIVALKEIHLDAEEGTPSTAIREISLMKELKHVNIVRLHDVIHTETKLVLIFEYCEQDLKKYMDQHGERGALEPEVVRSFMYQLLKGTAFCHENQVLHRDLKPQNLLINRKGELKLGDFGLARAFGVPVNTFSNEVVTLWYRAPDVLLGSRTYSTSIDVWSCGCIFAEMISGVPLFRGRDNQDQLLHIMRIIGTPSPAQFAKICKETPEIQPKQFPNYPRLPFHQVLPKASPQALDLLDKLLKFDPAERISAADALAHPYFTTATNTPFGLNSSPSSMPPPSFNFPHSHVHQAQQQHQQRQQQQQQQQQQQQQQQQQQQVHHQQIQPHYSRPIYGQIPQHPQNPAQVKNVQVPYGNVQYPPYGAPPR

SEQ ID NO: 13467 - protein, 491 aa, Bacillus clausii KSM-K16
MIRGKMFINGEWTDAKNGRVREIINPFNQEVIATVPEGSAEDSHAAIAAARAAFDEGVWSAASASERGERVRLIGQKIANQNEEFARLESLDTGKTLEESRTDMEDIANVFFYFAGLADKNGGEVIRSPLPNSTSIVVREPVGVCGLITPWNYPLLQAAWKLAPALVAGNTLILKPSELTPLTTMKLFELFEEVGLPTGVANLVLGTGKEVGAPLAESTDVDLISFTGGIETGKTIMQAASSNVKKMALELGGKNPNIVFADADFETAIDQALNAVFFHAGQVCSAGSRLLVEEAIHDDFVEELVKRTKRIKLGNGFDEKTESGPLISAAHRAKVESYIQIGLDEGATLACGGKRPDAAELQNGFFLEPTIFTNCRSSMRIVQEEVFGPVLTVETFRTTEEAIAKANDTIYGLAGAIFSNDIGKAERIASKLRLGTVWINDFHPYFVQAPWGGYKQSGFGRELGKIGLEEYTETKHIFRNKQPQPIGWFRG

SEQ ID NO: 13468 - protein, 467 aa, Caulobacter crescentus CB15
MNAPIRNHDVAELKRLDLAHHLPAQADHKVIAELGGSRIVTRADGCYITDGDGHRILDGMAGLWCVNVGYGRKELADAAYEQMLELPYYNTFFKTATPPTVKLAAKIAEKMGGHLTHVFFNSSGSEANDTVFRLVRHYWKLKGQPNRTVFISRWNAYHGSTVAGVSLGGMKHMHVQGDLPIPGVEHVMQPYPFGEGFGEDPAAFRDRAVKEIEDKILEVGPENVAAFIGEPVQGAGGVIIPPDGYWPAVEAVCRKYGILLVCDEVICGFGRLGQWFGHQHYGIKPDLIAMAKGLSSGYLPISAVGVADHIVAELREKGGDFIHGFTYSGHPTCAAVALKNIEIIEREDLITRTREDTGPYLAKALARLNDHPLVGETRSLGLIGAVEIVREKGTNHRFLDKEGEAGPIVRDICIRNGLMVRAIRDSIVCCPPLIVSHAEIDELVGIIEKSLTEAEPILRALKPEAVS

SEQ ID NO: 13469 - protein, 1844 aa, Arabidopsis thaliana
MKQRSLLSILCFILLASGVASVSAQTCIENRKYFTPNGTYDSNRRLILSSLPNNTASQDGFYYGSIGEEQDRVYALGMCIPRSTPSDCFNCIKGAAGWLIQDCVNQTDAYYWALDPTLCLVRYSNISFSGSAAFWEIEPQYLVLNTATIASNLTEFKTIWEDLTSRTITAASAARSTPSSSDNHYRVDFANLTKFQNIYALMQCTPDISSDECNNCLQRGVLEYQSCCGNNTGGYVMRPICFFRWQLFTFSKAFHNITLATTPPLSPPPLQRPVVASQPPSADNRDKKRDNSSGKISMKTILAIVVVGIVILIIISGILARRFARKEKPYQEVELNQTGITSVRSLQYKFKTIETATNNFSERLGHGGSGHVFKGRLPDGKEIAVKRLSEKTEQSKKEFKNEVVLVAKLQHRNLVRLLGFSVKGEEKIIVYEYLPNRSLDYILFDPTKQGELDWKKRYKIIGGTARGILYLHQDSQPTIIHRDLKAGNILLDAHMNPKVADFGTARIFGMDQSVAITANAAGTPGYMAPEYMELGEFSMKSDVYSYGVLVLEIICGKRNTSFSSPVQNFVTYVWRLWKSGTPLNLVDATIAENYKSEEVIRCIHIALLCVQEEPTDRPDFSIIMSMLTSNSLILPVPKPPPSFIPGTEEESCIGCLLSASNTLLETCLTEENALIWIANRTICMIRYSDTSFVGSFELEPHREFLSIHGYKTNETEFNTVWSRLTQRMVQEASSSTDATWSGAKYYTADVAALPDSQTLYAMMQCTPDLSPAECNLCLTESVVNYQSCCLGRQGGSIVRLSCAFRAELYPFGGAFTVMTARPLSQPPPSLIKKDSGKFSTETIAAIVVPIIVVAIIFLVLLVLSRLFARRRKSYQEIDLDQSGITTLHFQQLDFKTIEVATENFAKTNKLGQGGFGEVYKGTLVNGTEVAVKRLSKTSEQGAQEFKNEVVLVAKLQHRNLVKLLGYCLEPEEKILVYEFVPNKSLDYFLFDPTKQGQLDWTKRYNIIGGITRGILYLHQDSRLTIIHRDLKASNILLDADMIPKIADFGMARISGIDQSVANTKRIAGTFGYMPPEYVIHGQFSMKSDVYSFGVLILEIICGKKNRSFYQADTKAENLVTYVWRLWTNGSPLELVDLTISENCQTEEVIRCIHIALLCVQEDPKDRPNLSTIMMMLTNSSLILSVPQPPGFFVPQNKELSAQTCTTDKGTFRPNGTYDVNRRLILSSLPSNVTDQDGLYYNGSIGQQPNRVYAIGMCIPGSTSEDCSDCIKKESEFFLKNCPNQTEAYSWPGEPTLCYVRYSNTSFSGSADLNPRNWLTNTGDLDSNLTEFTKIWEGLMGRMISAASTAKSTPSSSDNHYSADSAVLTPLLNIYALMQCTPDLSSGDCENCLRQSAIDYQSCCSQKRGGVVMRPSCFLRWDLYTYSNAFDNLTVASPPPEPPVTVPQPAGDQDNPTNNDSKGISAGVVVAITVPTVIAILILLVLGFVLFRRRKSYQRTKTESESDISTTDSLVYDFKTIEAATNKFSTSNKLGEGGFGAVYKGKLSNGTDVAVKRLSKKSGQGTREFRNEAVLVTKLQHRNLVRLLGFCLEREEQILIYEFVHNKSLDYFLFDPEKQSQLDWTRRYKIIGGIARGILYLHQDSRLKIIHRDLKASNILLDADMNPKIADFGLATIFGVEQTQGNTNRIAGTYAYMSPEYAMHGQYSMKSDIYSFGVLVLEIISGKKNSGVYQMDETSTAGNLVTYASRLWRNKSPLELVDPTFGRNYQSNEVTRCIHIALLCVQENPEDRPMLSTIILMLTSNTITLPVPRLPGFFPRSRQLKLVSEGSESDQYTSKSSSFSS

SEQ ID NO: 13470 - protein, 466 aa, Caulobacter crescentus CB15
MGPAHEARDDGGGGGGMIAELAKSLSDLLTAERARFTVEHPRSVAMAKAAGAHWRGGAPMHWMNDWASPSPIFAAQGVGAQITDVDGKLYDDFCLGDTPSMFGHGDPSVAAAVSDQIKRGAGFMLPTASAAIVGKLLSERFGLPLWQAATTASDANRAAIRWARAVTGRPVILVFDGCYHGMVDDAFVVLKDGAPVMKPGLLGQVHDLTATTRVVAFNDLAALEAALAPGDVAAVLAEPVMTNCGMILPEPGFLEALRRLTREAGTLLVIDETHTISTGPGGYTRAHGLEPDVFVLGKAVAGGVPAAVWGVTAELSARMDAAQQRIGPGQSGIGTTLSGNALAMAAMRAMLSEVMTEAAYGKMLAGAERLVAGLNAVIAARRLPWSVVHVGARVELVFADPPPKNAAQMRKVLDHEAVEALHLWLINRGVLIAPFHNMMLVSPVTEDAAIDRLVAAVDGFAAAMGE

SEQ ID NO: 13471 - protein, 328 aa, Dehalococcoides sp. CBDB1
MTTCSLEAIGLGAVHVDHIYTVEQILHDGECVVTESASFPGGSGANTIHGLSRLGLKCGFIGAVGNDSDGNLLIKDFENAGIDNQYLMVTDEAQTGSVVSLSESSGRRSTYVNPGANNYLNLSDINLEYLSQAKLVHMSTFFSQNEFALCHEIAERLAPDVLFSFSPGALFAAQGLKRLAPILSRTNALFTNQLDIEKMTQKNYQRATDMCIRSGCEHVVVTLGESRRFQRKGKITLQTYIRDKDHECHMESTVSLRKDIRTVVDTIGAADAFTTGFLFGLMGDKPIEECGLLGDISARFCISKLGARSGLPNLEGLKERFGMHYFTN

SEQ ID NO: 13472 - protein, 162 aa, Glycine max
  misc_feature (106)..(106): Xaa can be any naturally occurring amino acid
TLILAIASNSTSFCYGLNFVYVVARILEFLSPEISRTSLVGIVKDIRESMLEEVDFYKEAANIEAFRRYLETMGLTGNATAPKVYRYCSTMKVLTMQRLYGVPLTXLDSISALVSNPETSLITALNVWFGSLLACKLFHADVHAGNLWLLHDGHIGFLNFGC

SEQ ID NO: 13473 - protein, 335 aa, Xanthomonas axonopodis pv. citri str. 306
MTAPSKPVLVADIGGTNARFALADVDASVPLLDDTSREFAVVDFGSLGEAARYYLDQIGVQATQGVFAVAGRVDGDEARITNHPWVISRSRTATMLGFSTLHLINDFAAQAMAISLLRPQDVVQVGGASWRPAPIDQARNYGVIGPGTGLGVGGLIIRNGRCFPLETEGGHVSFPPGTPEEIRILEILSEQFGRVSNERLICGPGLVNIHRALSEIAGVDPGPLQPKDITARAAAGDPRSSRTIDLFCAIFGAIAGDMVLMQGAWDGVFLTGGLVPKVLDSLQHSGFRQRFEHKGRFSAIMSKVPSLAVMHPHAGLLGAAAYAVDAQRQHPGEQR

SEQ ID NO: 13474 - protein, 219 aa, Pseudomonas fluorescens PfO-1
MKNLIEGFLKFQNEAFPQRTELFKHLATTQTPGTLFITCSDSRVVPELLTQQEPGELFVIRNAGNIVPSYSPHPGGVSATVEYAVAVLGVTDIVICGHSDCGAMTAIAQCKCMDHLPAVSGWLQHAESAKVVNESRPHANDAAKLSSMVRENVIAQLANIQTHPSVRLAQEKGLLNLHGWVYDIETGSIDALSADRRTFVSLAEQPSTCAVYGQTVDAA

SEQ ID NO: 13475 - protein, 615 aa, Litchi chinensis
MGHSSQTWFNKSKSFAPSWALSCRIPGPMFQPLYSSRIFLNPVRRAGLFRALLLLNTVIAQGADPVESTSESILIKNFNSLYDYNNSTTFDPTSKSLILTQSSSSTLSYEPDSDSEPDFATVVASQRFFFTSPGSSNSIIESSPSIATLESSDTSVSMISHGVNQSLNNFSDRSLLKSWKSPSVKDSVAVPTYSPDPYLDFRQSMQEMVEARDLVDVRSNLDYLHELLLCYLALNPKTTLVELGGTLGLEECALWMPSRSGSSLQLSHTLRHQITVGSTVSINLPVVNQVFSSNRAIIIPHTSPLARIRPLAGRYVPPEVAAVRVPLLHLSNFQINDWPELSAKSYAIMVLMLPSDSARKWHVHELELVEVVADQVAVALSHAAILEESMRARDLVKEQNVALDLARREAEMAIRARNDFLAVMNHEMRTPMNAIIALSSLLLETGLTPEQRLMVETVLKSSNLLATLINDVLDLSKLEDGSLELEIKAFNLHAVFKEVMSFIKPIAAIKRLSVSVMLAPDLPLCAIGDEKRLMQTILNISGNAVRFIVHYTCGGCLQSPYFCGRERICFRSIHLCCFQHQCSGGCQVPQQTIPSVQNSNRFWRLSHQGQVVPFV

SEQ ID NO: 13476 - protein, 302 aa, Pseudomonas fluorescens PfO-1
MQALLNEILDAVRPLIGQGKVADYIPALGTVPANQLGIAVYGNDGEMYCAGDAETPFSVQSISKVFSLVQAIEHSGEAIWERLGHEPSGQPFNSLVQLEFERGRPRNPFINAGALVICDINQSRFAAPALSMRDFVRRLSGNPQVMVDGKVADSEYQHRARNAAMAYLMQSFGNFHNDVEAVLRSYFSHCALRMNCIDLARAFCFLANDGFCKHSGEQILTRRQTQQVNSIMATSGLYDEAGNFAYRVGLPGKSGVGGGIVAVVPGQFTVCVWSPELNTAGNSLAGMAALEMLSSRIGWSVF

SEQ ID NO: 13477 - protein, 459 aa, Staphylococcus epidermidis ATCC 12228
MNFFDIHKIPNKGIPLAVQRKLWLRNFMQAFFVVFFVYMAMYLIRNNFKAAQPLLKEEIGLSTLELGYIGLAFSITYGLGKTLLGYFVDGRNTKRIISFLLILSAITVLIMGFVLSYFGSVMGLLIVLWGLNGIFQSVGGPASYSTISRWAPRTKRGRYLGFWNTSHNIGGAIAGGVALWGANTFFHGNVVGMFIFPSIIALIIGIVTLFIGKDDPEELGWNRAEEIWEEPIDQENIDSQGMTKWDIFKKYILGNPVIWILCISNVFVYIVRIGIDNWAPLYVSEHLHFNKGDAVNTIFYFEIGALVASLLWGYISDLLKGRRAIVAIGCMFMITFVVLFYTNATSVTMVNISLFALGALIFGPQLLIGVSLTGFVPKNAISVANGMTGSFAYLFGDSMAKVGLAAIADPTRNGLNIFGYTLSGWTDVFIVFYVALFLGMILLAIVAYYEEKKIRKLKI

SEQ ID NO: 13478 - protein, 1217 aa, Coprinopsis cinerea okayama7#130
MSTGVASSLNTESTQKVPNWTASVVKNGATSNGYTVAPSPVASTSSGSLVWQPPIQPAVQQPAQNETSYPSSAWKPHKAEKRTAEELEITAATAARVATRIAEDQAAVLNPDVDTPFEDEHDVVKRLLPYHIYQQPKDDLQAILDSKGKGKSVDRGLEAEIEETKFAIECYKRLERLKARWRRVKIREGQRASPDDQAYVLAQLVLEAERTETAVLSNELKTARNELDRIQKEQRLAANTARMTQFPAAPASTPTTTTPAPISAPYYRSYSYAYAQPYGNPAAHATTSTFPATPTTAPSPTTYTPYQPGGAIPVQLPVSSLPALHALGIIPVPATALPPEGQPQPPAILRGSSANGSMLSLEINVSLLQSAQMSGLAIILNSLVARNTSLAASAPGADDTPVYTPQSLRGFAYARLSSARPISAYDPPIDHKDPEEVDLDAKINGIRVWYSSYTSIDWLHDAIKDSLRFSKLRKRKSIRARLRLAFDKSLGWIIVTIVGFLSAVVAFLVVRSEQLLFDFKEGYCADGWWKAQRFCCPVGDTPASGSPSEATELCDAWIKWPETFSAGEGHQAVLVEYTSYIGVALSLALVSCLLTIYLTKSTTFVTRKESGVAGIKSTGASGSKAPKVPVTHGRKVLYYAAGSGIPEIKTILSGFVIHGYLGVRVLFTKAVGLALSVASGLSLGKEGPFVHIASCVGNIVSRIASKYELNEAKRREILSAACAAGVAVAFGAPIGGTLFSLEEVSYFFPPKVMWRSFFCAMIAAITLKMLDPFGTGKLVLFQVTYDKDWHAYELGPFLLLGVLGGLYGACFSKLNYRWSKNIRGKTWLGRHPICEVLIITFITSCLCFLNPYTRMGGTELVYNLFSECRPGGDSHSGLCIVSPGSWEHAWPVAKAILIAMMVKGGLTVVTFGIKVPAGIFIPTLGVGACAGRVMGIAMQYLQIRNPDARLFASCHGDLGCIVPGLYAMVGAAATLSGVTRTTVSLAVIMFELTDTLTYAVPVMLSVLVAKTVADALEPKGIYDLVIELSELPYLDYKNDYVWGNLQLSDVISRDMASIRIDEKNTVQSLSDKLLTLISTGAHDLGFPILRPDGNDDGVRLVGYIGTNELEHALSIVADNPTAEVYFGAPYTNDMASSISSFAEPAMPTHSSSDPYDFTPYMDQAPLTLTNQSPLEMLHRFFVKLGARYVVVVDSEGLYEGIVEKKNWLAFLTEFEEK

SEQ ID NO: 13479 - protein, 459 aa, Pseudomonas putida GB-1
MGACPIHNNYKSDAMRNINAAALLERARFNAFHARLLFWCALIIIFDGYDLVIYGVVLPSLMAEWGLSAVQAGVLGSCALVGMMAGALFFGSLSDRIGRRKTIMTCVLLFSGVTALNGLATSPETFALCRFVAGLGIGGVMPNVVALMNEYAPGKMRSTLVAIMFSGYSLGGMLSAGLGMLFIPQWGWQAVFYVAVIPLLLLPLLIHQLPESMDFLLRSGQAERAKVLLAQATSDYLPEHDDQLSLVATRAGKVSIREIFSEGRVVNTLTLWAAFFCCLLMVYALSSWLPKLMSSAGYGLNSSLAFLLVLNSGAIVGAIAGGWLGDRVGIANVLLCFFACGALSLSLLALKAPVAVLYLLIAVAGASTIGTQILANACAVQYYPPHIRSTGLGWAMGIGRLGAIVGPVLGGVLHSANLPYQSSFLAFAIPGAIGAVAILLFIRRQVVATRSRGVQRVIG

SEQ ID NO: 13480 - protein, 291 aa, Coprinopsis cinerea okayama7#130
MPSEYPFWLGGVAASMAASCTHPLDVTKVRMQTLAREAGEKRPSTIRVIQLSIQQSGFRGLYVGLTASLMRQMSYSLVRLGSYETIKGYMSKDGPPSTLKSLFAATLAGGLGGIAGNPADILLVRMTSDITRPADKRYNYSNAFTGLISLVREEGFAGLTRGLGVNMSRAVLMNASQVGSYDLIKTNLLGKVVPGTDYHLRDNLLLHVISSTLAGTVATTVSSPADVIRSRVMASASEHTTPARVLVDSLRQEGIRFLFKGWTPAFVRLAPNTVLLFVFYEVLTVTHLLLP

SEQ ID NO: 13481 - protein, 253 aa, Glycine max
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNESNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 13482 - protein, 482 aa, Caulobacter crescentus CB15
MTALNLVETAALIDGQWVRGEASFDVLNPADGTLIAAVADLGAAETTLAIDAAHRALPAWAARTAKERGAILRRWSDLILAHADDLARLMTDEQGKPLAEAKGEVVYGASFIDWFAEEAKRAYGHTIPTPMPGKRLASIKQPVGVCAAIAPWNFPIAMITRKVGPALAAGCTVVVKPAAETPLSALAIARLATEAGVPAGVLNIVTTTRSSEVGKVLCDDSRVRKLSFTGSTPIGKVLYQQCAGTMKKLSLELGGNAPFIVFDDADLEAAVDGAIASKYRNAGQTCVCANRLIVQSGIHDAFAARLAEKVAALKVGPGTGEGVQIGPLINEKALTKVVGLVSGAVQAGAEVLTGGDVHGLGGHFYQPTVLVGATPEMRIFQEEIFGPVAPIVKFETEAEAVELANATPFGLAAYFYSRDVGRCWRVAEQIEAGMVGINEGLISTEVAPFGGVKESGLGREGASEGLDEYLETKYLCFGGVAG

SEQ ID NO: 13483 - protein, 1070 aa, Listeria monocytogenes str. 1/2a F6854
MPKRDDIKTILVIGSGPIVIGQAAEFDYAGTQACLSLKEEGYRVVLVNSNPATIMTDAEMADKVYIEPITLDFVSRIIRKERPDAILPTLGGQTGLNMAMELSAAGILDECNVEVLGTDLTAIKKAEDREAFRDLMNELGEPVPESDIIHNLDEAYAFVERIGYPVIVRPAYTLGGSGGGICHNGQELIETVTSGLKLSPVTQCLLEKSIAGFKEVEYEVMRDANNNAMVVCNMENIDPVGIHTGDSIVVAPSQTLSDREYQLLRDVSLKIIRALEIEGGCNVQLALDPDSYNYYVIEVNPRVSRSSALASKATGYPIAKLAAKIAVGLTLDEVRNPVTGTTFAHFEPTLDYVVAKIPRFAFDKFEQADRRLGTQMKATGEVMAIGRSWEEALLKAVRSLEIGADHLLLEEAENADEATLERKICFPEDDRLFFLAAALRRGQTIEQLHEKTKIDLFFLYKLSKTIELENRIKENPQNQEILAEAKQAGFSDAFLATCWNVDEQAIYDLRKAQNLFPVYKMVDTCAAEFESTTPYFYSTYEEENESTRSAKESVIVLGSGPIRIGQGVEFDYATVHSVWAIQQAGYEAIIINNNPETVSTDFSISDKLYFEPLTLEDVMHVIEIEQPLGVVVQFGGQTAINLADGLAKRGVKILGTSLEDTDRAENRDAFEKALEILQIPQPAGKTATSVEEAITVATDIGYPVLVRPSYVLGGRAMEIVESEEALKHYMTNAVKVNPKHPVLVDRYVSGQEVEVDAISDGVNVLIPGIMEHIERAGVHSGDSIAVYPAQRLSIQVKNTIVDYTTRLATGLNIIGMLNIQYVVDGEEVFVIEVNPRSSRTAPFLSKITEIPMANVATRVILGENLIDLGYTPGLAPEKQEIFVKVPVFSFAKLRSVDTSLGPEMKSTGEVMGKDVTLEKALYKGFVASGTTMHDYGTVLLTVADRDKEEAVELAKRFNRIGFTIMATKGTASTLEEASIPVSQVKKIGENQETLIDYIRNGQVTLVVNTLTTGKRPERDGFQIRRESVENGIPVCTSLDTAEAILRVLESRSFELESMNASEVKQPKSRV

SEQ ID NO: 13484 - protein, 496 aa, Caulobacter crescentus CB15
MTLPADMTERLAKLAPPSQAVIDGDLVEAASGATFHNVSPRDGQVLNLVTACQADDVERAVAGARAAFEDGRWRDQGPRQKKAVLFRLAELMERDADELALLESLDVGKPISDARNVDIPLAINTCRWYAEALDKVYGEVGTSPADRLSYAVHEPLGVIGAIVPWNFPLHMAMWKVAPALAMGNSVVLKPAEQSPLTALKLGALALEAGLPPGVLNVIPGLGGVAGEALALSMDVDMIAFTGSGPVGRRLMEYSARSNLKRVSLELGGKSPQIVFADCPDLEAAAQAAAWGVFYNQGEVCTAASRLLVEAPIKDAFLARVIEVAKGMKVGDPLDPSTQFGAMVSERQMNTALDYIATADSQGARRVLGGQRVRQEAGGFYVEPTIFDQVRPDQTLAREEVFGPVLGVMTFSSEDEAMRLANDTVYGLAAGLWTADVSKALRGARRLKAGLVWVNGWDACDITMPFGGFKQSGFGRDRSLHALHKYADLKSVSVTLR

SEQ ID NO: 13485 - protein, 380 aa, Phaseolus acutifolius
MSSTAGQVIKCKAAVAWEAGKPLVMEEVEVAPPKAGEVRLKILYTSLCHTDVYFWEAKGQTPLFPRIFGHEAGGIVESVGEGVTHLKPGDHALPVFTGECGECAHCKSEESNMCDLLRINTDRGVMIHDSQTRFSIKGQPIYHSVGTSTFSEYTVVHAGCVAKVNPAAPLDKICVLSCGICTGLGATVNVAKPKPGSSVAIFGLGAVGLAAAEGARISGASRIIGVDLVSSRFEEAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPLVVEQYMNGELELDKFITHTVPFSEINKAFDYMLKGESIRCIIRMGE

SEQ ID NO: 13486 - protein, 156 aa, Zea mays
MRTMVDLGKQRDHSYDHMQIITTPTSVDCSREFRHRRTLRSLIECMIPYCCTYQQQPYQNDTLSVSSTSSSSSSSDHSSSSQSSSTVSGTFFGHRRGRVSFCLQDAAVGSSPLLLLELAVPTAALAKEMDEEGVLRIALECDRRRSSNSPSSSIFD

SEQ ID NO: 13487 - protein, 188 aa, Zea mays
ATERFEVAYRTIKELALAGPPGSKTVKQASQQLLPLCAKAMQENNAELTREAVDVFIWCLTQNAESYKQWERIYLENIEASVAVLSKVVIDWRDVSPKLSSEALKATVKNFKAKNEAALESTTDAGKQASIKEADKHCKAIFGKLTRGATCLKSSLVVIALAVAASYVLSPGMDLEKVQAMVSSHLSF

SEQ ID NO: 13488 - protein, 380 aa, Phaseolus acutifolius
MSSTAGQVIKCKAAVAWEAGKPLVMEEVEVAPPKAGEVRLKILYTSLCHTDVYFWEAKGQTPLFPRIFGHEAGGIVESVGEGVTHLKPGDHALPVFTGECGECAHCKSEESNMCDLLRINTDRGVMIHDSQTRFSIKGQPIYHFVGTSTFSEYTVVHAGCVAKVNPAAPLDKICVLSCGICTGLGATVNVAKPKPGSSVAIFGLGAVGLAAAEGARISGASRIIGVDLVSSRFEEAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPLVVEQYMNGELELDKFITHTVPFSEINKAFDYMLKGESIRCIIRMGE

SEQ ID NO: 13489 - protein, 439 aa, Caulobacter crescentus CB15
MPDFGANDLDAFWMPFTPNRRFKRHPRMLSSASGMWYRTPESREVLDATSGLWCVNAGHDRPKIREAIQKQAAEMDYAPCFNMGHPLAFQFASRLAQITPKGLDRIFFTNSGSESVDTALKIALAYHRARGKGTKTRLIGRERGYHGVGFGGISVGGIPKNRMYFGSLLTGVDHLPHTHGLPGNTCAKGQPENGAHLADDLERIVALHDASNIAAVIVEPVAGSTGVLIPPKGYLERLRAICDKHDILLIFDEVITGFGRVGAPFAAERFGVTPDLICMAKGLTNAAVPCGAVAASGKIYDAMMDGADAPIELFHGYTYSAHPLACAAGLATLETYREDDLFARAAGLEGYWQDAMHSLADARHVVDVRNLGLVAGIELEPRPGAPTARAMEVFETCFDEGLLIRVTGDIIALSPPLILEKDHIDRMVETIRRVLGQVD

SEQ ID NO: 13490 - protein, 504 aa, Zea mays
  misc_feature (258)..(258): Xaa can be any naturally occurring amino acid
MATANGSSKGSFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAXAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDNKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 13491 - protein, 470 aa, Bacillus subtilis subsp. subtilis str. 168
MSDGKKHVVIIGGGITGLAAAFYMEKEIKEKNLPLELTLVEASPRVGGKIQTVKKDGYIIERGPDSFLERKKSAPQLVKDLGLEHLLVNNATGQSYVLVNRTLHPMPKGAVMGIPTKIAPFVSTGLFSLSGKARAAMDFILPASKTKDDQSLGEFFRRRVGDEVVENLIEPLLSGIYAGDIDKLSLMSTFPQFYQTEQKHRSLILGMKKTRPQGSGQQLTAKKQGQFQTLSTGLQTLVEEIEKQLKLTKVYKGTKVTKLSHSGSCYSLELDNGVTLDADSVIVTAPHKAAAGMLSELPAISHLKNMHSTSVANVALGFPEGSVQMEHEGTGFVISRNSDFAITACTWTNKKWPHAAPEGKTLLRAYVGKAGDESIVDLSDNDIINIVLEDLKKVMNINGEPEMTCVTRWHESMPQYHVGHKQRIKELREALASAYPGVYMTGASFEGVGIPDCIDQGKAAVSDALTYLFS

SEQ ID NO: 13492 - protein, 451 aa, Staphylococcus epidermidis ATCC 12228
MANTRELNHKDAQYVWHPFTQMGVYAKNDNIIIEKGRGSYLYDTEGNKYLDGYASLWVNVHGHQHKKLNKAIHKQLDKIAHSTLLGSSNIPSIELAEQLVKLTPDRLQKVFYSDTGSASVEIAIKMAYQYWKNIDAKQYAKKNKFLTLHHGYHGDTIGSVSVGGIDSFHKIFKDLIFENIQIETPCLYKSKYRNEAEMLNSILNQIENILSERNDEIVGFILEPLIQGATGLFVHPHGFLKAVEQLCRKYDVLLICDEVAVGFGRTGEMFACNHEDVQPDIMCLGKAITGGYLPLAATLTSQKIYDAFLSQSHGKNTFFHGHTYTGNQLVCSVALENINLFKKKHLIGHIQKTSQTLKQRLEALQPHKNIGDIRGRGLMYGVELVENKSTQTPLDIPTVELIIRRCKENGLMIRNLENVITFVPILSMSNKEIKKMVKIFNKALHQTLGKK

SEQ ID NO: 13493 - protein, 341 aa, Oryza sativa (japonica cultivar-group)
MAPPQLAGKMTAKAAAAVKPATRAYVTFLAGDGDYWKGVVGLAKGLRKVGSAYPLVVAVLPDVPESHRRILISQGCIVREIEPVYPPENQTQFAMAYYVINYSKLRIWEFVEYERMVYLDADIQVFDNIDELFELPKGHFYAVMDCFCEKTWSHTPQYQIGYCQQCPDKVAWPTAELGPPPALYFNAGMFVHEPSMATAKSLLDTLRVTTPTPFAEQDFLNMFFREQYKPIPLIYNLVLAMLWRHPENVQLEKVKVVHYCAAGSKPWRYTGKEANMDREDIKMLVKKWWDVYNDGSLDFKGLPPIAAADDADEVEAAAKKPLRAALAEARTVKYVTAPSAA

SEQ ID NO: 13494 - protein, 889 aa, Arabidopsis thaliana
MGASRKLQGEIDRVLKKVQEGVDVFDSIWNKVYDTDNVNQKEKFEADLKKEIKKLQRYRDQIKTWIQSSEIKDKKVSASYEQSLVDARKLIEKEMERFKICEKETKTKAFSKEGLGQQPKTDPKEKAKSETRDWLNNVVSELESQIDSFEAELEGLSVKKGKTRPPRLTHLETSITRHKDHIIKLELILRLLDNDELSPEQVNDVKDFLDDYVERNQDDFDEFSDVDELYSTLPLDEVEGLEDLVTAGPLVKGTPLSMKSSLAASASQVRSISLPTHHQEKTEDTSLPDSSAEMVPKTPPPKNGAGLHSAPSTPAGGRPSLNVPAGNVSNTSVTLSTSIPTQTSIESMGSLSPVAAKEEDATTLPSRKPPSSVADTPLRGIGRVGIPNQPQPSQPPSPIPANGSRISATSAAEVAKRNIMGVESNVQPLTSPLSKMVLPPTAKGNDGTASDSNPGDVAASIGRAFSPSIVSGSQWRPGSPFQSQNETVRGRTEIAPDQREKFLQRLQQVQQGHGNLLGIPSLSGGNEKQFSSQQQNPLLQQSSSISPHGSLGIGVQAPGFNVMSSASLQQQSNAMSQQLGQQPSVADLLEPQFLDSSIESTDKNISKIKGFVFDVCADVDHVRNDDQSQQNLPDDSASIAASKAIQSEDDSKVLFDTPIDFKADKKLLSLLVLSGMPSYMLDPVQVSSGPDFSPGQPIQPGQSSSSLGVIGRRSNSELGAIGDPSAVGPMHDQMHNLQMLEAAFYKRPQPSDSERPRPYSPRNPAITPQTFPQTQAPIINNPLLWERLGSDAYGTDTLFFAFYYQQNSYQQYLAAKELKKQSWRYHRKFNTWFQRHKEPKIATDEYEQGAYVYFDFQTPKDENQEGGWCQRIKNEFTFEYSYLEDELVV

SEQ ID NO: 13495 - protein, 338 aa, Escherichia coli CFT073
MISSGQTGYIPLTSCLKRNTIMTDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAVDQEKLEKMIGDLL

SEQ ID NO: 13496 - protein, 286 aa, Kineococcus radiotolerans SRS30216
MKAAVCGSPIQHSLSPALHRAAYAALGLDGWSYDLLEVDEERLPSVVGALDATWAGLSLTMPLKQAVVPLVDEVSDFARAVGSVNTVVVTPRLDRRNTPGRRGVRLRAENTDVIGLVTALAEAGADRVRRGVVLGGGATARSAVVALLQAGCPRPVVVVRSPDRAVELKGVAARLGGEVEVRDWSELPVALSADVVVSTVPIGGSDAMADAVLGAFRPVWWPLLLDVVYAPWPTPLAQRWGGTVVGGFEMLLHQAVAQVELMTGRAGPVEAMRAAGLAALRKRARA

SEQ ID NO: 13497 - protein, 380 aa, Silicibacter sp. TM1040
MTIHWCGTGLSAIPGLRRLLEAGHDVAVWNRTPEKAAEAVGDLTTNIHKFSIARLSELLSPADVVVSMLPGDWHVELAELAISKGAHFVSSSYISPEMRALDQKAKDAGVALVNEVGLDPGIDHLMAHALVAEYAESPAFDADNEISFLSYCGGIPKIPNPFRYKFSWSPLGVLKALRSPSRSIRDFEVLDVARPWDAISSYDAPLATPETFEVYPNRDSLPFMEQYHFDKDWKVKTFVRGTLRLNGWTEAWADVFKEVETLEGPEGDARLKEMSDQFWDENAYDEGEPDRVVLCVDLKAEKDGQTKWHKTYVMDAWGDERGSAMARLVSYPVSYAIEAAMNGKIAPGVSAAPSDPALVDSWMGRIGALAQHLQVVSHRS

SEQ ID NO: 13498 - protein, 550 aa, Cryptococcus neoformans var. neoformans JEC21
MSAIIPQVQQLLGQVAQFFPPWFAALPTSLKVAIAVVGIPALIIGLNVFQQLCLPRRKDLPPVVFHYIPWFGSAAYYGEDPYKFLFECRDKYGDLFTFILMGRRITVALGPKGNNLSLGGKISQVSAEEAYTHLTTPVFGKGVVYDCPNEMLMQQKKFIKSGLTTESLQSYPPMITSECEDFFTKEVGISPQKPSATLDLLKAMSELIILTASRTLQGKEVRESLNGQFAKYYEDLDGGFTPLNFMFPNLPLPSYKRRDEAQKAMSDFYLKIMENRRKGESDHEHDMIENLQSCKYRNGVPLSDRDIAHIMIALLMAGQHTSSATSSWTLLHLADRPDVVEALYQEQKQKLGNPDGTFRDYRYEDLKELPIMDSIIRETLRMHAPIHSIYRKVLSDIPVPPSLSAPSENGQYIIPKGHYIMAAPGVSQMDPRIWQDAKVWNPARWHDEKGFAAAAMVQYTKAEQVDYGFGSVSKGTESPYQPFGAGRHRCVGEQFAYTQLSTIFTYVVRNFTLKLAVPKFPETNYRTMIVQPNNPLVTFTLRNAEVKQEV

SEQ ID NO: 13499 - protein, 304 aa, Zea mays
  misc_feature (27)..(27): Xaa can be any naturally occurring amino acid
ARGARKVKKILKRFEGVEDVVADSKSXKVVVKGKKAAADPMRVVERVQKKTGRKVELVSPIPPPPPPEEEKKAEEEPEPPKPEEKKEPPVIAVVLKVHMHCEACAQGIRKRILKMKGVQSAEPDLKASEVAVKGVFEESKLAEYVYKRTGKHAAVVKSEPVPAPPPESGAGDNTGAKEEEKGQEEEKEKEGGGDGGGEEKKKEGGKEEEKKDGEKQEEEKEGGGGGEKVEEKEGDKDAAAAAAASMYMHYPRFPFPGGYYAPPPGYVYQPVYPAPAYAGYAPPHHQPMAPQIFSDENPNACSVM

SEQ ID NO: 13500 - protein, 591 aa, Debaryomyces hansenii CBS767
MVFILAVRPRLLYIANRQIQSNKRLISSSTQKLLQSSNTLSNASKVNRQVTEKTNKFFKKRHVALVSGIIIIGSYISFNQSNYYNLDTVPPIGGGGRSGISPKLFPPSNTTVIGDDSRYFSTSTNSMHQKNSIGNQQQKQGVFLLNDEQVSERLRQFEESYSVNRGKGVTRYDICQLPSNSPIEDDRAEEIVQVPILQDNNIKTSTDWMFFGVFDGHGGWTTSSKLRDQLISYIVHELGTIFKPTNEDNLRYVPNGATIDQAIKNGFLKLDHEVVNKNMEKLLNDNNKAKAAELLMPALSGSCALLSFYDTNSKLLKVAVTGDSRALLGSFKDNHWTVRQLSIDQTGSNPTEVARIISEHPDEPNVVRNGRVLGTLEPTRAFGDCRYKLPASIQERIYKQFFGRRLPNNLKSPPYVTAEPVITTTKINPENNDFLVMASDGLYEMLSNEEIIGLVVKWMEKERMVKPQKSFWNYFGSTENKLPEISDITNDKSSKQPFRKNKQSSGYGGFLLDDRNVSTHLIRNALSNGGSREQTSMLISIPNPVSRRYRDDLTVTVVFFGKDLRGENEAGKLEINADATAGGIDSAKPKL

SEQ ID NO: 13501 - protein, 426 aa, Salmonella enterica subsp. enterica serovar Typhi str. CT18
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAELVTNLVPTMDMVRMVNSGTEATMSAIRLARGFTGRDKIIKFEGCYHGHADCLLVKAGSGALTLGQPNSPGVPADFAKHTLTCTYNDLTSVRAAFEQYPQEIACIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGIHETLDELTTRLAEGLLEAAEEANIPLVVNHVGGMFGIFFTDAESVTCYQDVMACDVERFKRFFHLMLEEGVYLAPSAFEAGFMSVAHSMDDINNTIDAARRVFAKL

SEQ ID NO: 13502 - protein, 339 aa, Trichodesmium erythraeum IMS101
MIRVAINGFGRIGRNFLRCLLTRTDSQLDLVAVNDTSDPKTNAHLLKYDSMLGTLKDVDISTDENSITVNGKTIKCVSDRNPLNLPWADWGIDLIIESTGVFVTEEGASKHLQAGAKKVLITAPGKGGQIGTFVVGVNHQDYKHEDYNIISNASCTTNCLAPIVKVIHDNFGIIKGTMTTTHSYTGDQRILDASHRDVRRARAAAVNIVPTSTGAAKAVALVIPEMKGKLNGIAMRVPTPNVSVVDLVAQVEKKTFVEQVNEVMEVAAKGPMKGIIEYSDLPLVSIDYRGHDCSSIVDASLTMVMDGDMVKVIAWYDNEWGYSQRVVDLAEVVAQNWAA

SEQ ID NO: 13503 - protein, 429 aa, Chlamydophila abortus S26/3
MISLLKMPKLSPTMEVGTIVKWHKNNGDKIEFGDVLLEVSTDKAVLEHTATEEGWFRDCLVKEGTKVQIGTPIAVISSEKDESFDLDHILPKTPEPELSIENVRLEEKEEVTKAQPYVAPTQLAFQFKPEPPLSKPLSLKVDSSKSPISPLAKRVAKERNLDISGIKGSGPGGRIVEKDLDKAPTKGIAGFGYPEAPEVHPGSYHEETLSPIRDIIAQRLQAAKASIPHFYVTQKVYASPLLALLKELQVQGIKLSINDCIVRACALALKEFPEVNSGFNSVDNTIVRFETIDISIAVAIPDGVITPIVRCADRKNIGMISAEIKNLAAKAKSQSLKEEEYKGGSFCVSNLGMTGITAFTAIINPPQAAILTVGSVQEEPVVINGEIIVGSTCILTLSIDHRVIDGYPAAMFMKRLQKILEAPSVLLLN

SEQ ID NO: 13504 - protein, 328 aa, Chlamydophila abortus S26/3
MPKYVTLEIREAIREAIDEEMARDPNVCILGEEVAEYNGAYKVTKGLLDKWSSSRVIDTPISEAAFAGIGIGAALTGLRPIIEFMSWNFSLVAADQIISHAAKMHYMTGGMFSVPIVFRGPNGAAAQVSCQHSHCVEALYANIPGLIVISPSNSYDAKGLLKSAIRNDNPVLFLENELEYNLKCEVPVEEYLIPIGKSQIVEEGKDLTIITYGRMVSIVKQAVKVAKQRYGLSIEILDLRTIKPLDISGIFSSVKKTGNCIVVEEGHYFAGISAEIITEITEHVFDYLDSPPLRVCQRETPMPYNKTLEQATLPNANRILDTIEKIMR

SEQ ID NO: 13505 - protein, 341 aa, Chlamydophila abortus S26/3
MPDAFHYNIASKASDEATVKNIIDIYGPPRCVELLKYMLLIREFETRGEEAYLEGLVGGFYHSYSGQEAVATAALANTGLDQWFFSSYRCHALAVLLNIPLRSLAAELLGKETGCALGRGGSMHMCGPNFPGGFGIVGGQIPLAAGAAFAIKYRGEDKISLGFMGDGAVAQGVFHETLNFTALHSLPLMLIIENNGWGMGTALNHAIAKQPIGESQGASYGIRSFTLNGFDLFNCLLGFKEAYEYMQKTRLPVIVECLCSRFRGHSISDPNLYRSKEEMECLIKKDPIVFAKKWLIQLGVMSEESFQALREECKNKVLKAFTEAKSDPEPTIATLEEGVYA

SEQ ID NO: 13506 - protein, 494 aa, Euglena gracilis
MSATQLLGGYQTISERTAPQNKLAVVGAVAVIAVASGVAAGYALNLSMPPLLPPCAPLAHGHLSRTTWHRPTPAAVAFASASEGAQTFVAPAAQSSNTFATSSVAASIGMVMGAGAVLLARMNQKPVAMNAWTGSVYGVLSQLWRSHGPSMLMSVRQDHLHPWQGILAADESRPNKTCGARLKSIGVENTEENVHSSRSCVHRTWLQRGNILGVIMYEETLYQKDKNGKPFVQIINEAGAVAGVKVDTGIAPLPGADDEGYTMGLDGLRERCQEYYRQGARFAKWRAVLRIDSKGLPSDRSILANATGLAQYAAICQECGLVPIVEPEILMDGDHDIETAAAAAERVLVAVYDALATQGVLLEGTLLKPNMVTPGVDSGIKATPETLPIFTCALLATVPAAVAGISFLSGGSSEEDASLNLNAINAIPYERKPWALTFSFGRALQASTLKTWGGKDENIARLRRCSLSVPSQWPGKYQGSGQAGESLFVKGYKY

SEQ ID NO: 13507 - protein, 287 aa, Zea mays
MASDGSGVVTVYGSNGAELLEPSKQPKSATFSVKVGLAQMLRGGVIMDVGGVARMSDPGLIRDIKRAVTIPVMAKARIGHFVEAQILEAVGVDYVDESEVLTPADDAHHINKHNFRVPFVCGCRDLGEALRRVREGAAMIRTKGEAGTGNVVEAVRHVRSVMGDVRALRSMDDDEVFAYAKRIAAPYDLVMQTKQLGRLPVVQFAAGGVATPADAALMMQLGCDGVFVGSGIFKSGDPARRARAIVQAVTHYSDPTILADVSTGLGEAMVGINLNDPKVERYAARSE

SEQ ID NO: 13508 - protein, 181 aa, Vibrio angustum S14
MNQETLNLIKNSIQSIQDYPKPGILFRDVTSLMEQPEAYRATIAILAEKYKDQGITKIIGTEARGFLFGAPLALELGVGFVPVRKPGKLPREVIAESYELEYGKDTLEIHKDAIKPGDRVLLVDDLLATGGTIEATTNLVRRLGGIVDDAAFVINLPDIGGEARLQGLGLNVYAICDFPGH

SEQ ID NO: 13509 - protein, 325 aa, Listeria monocytogenes str. 1/2a F6854
MNLKKHSERKFDLITVGRACIDLNAVEYNRPMEETMTFSKYVGGSPANIAIGTAKLGLKVGFIGKISDDQHGRFIEKYMRDLAINTDGMVKDTEGRKVGLAFTEIKSPDECSILMYRENVADLYLTPEEISEDYIKEARVLLISGTALAKSPSREAVLKAVSLARKNDVVVAFELDYRPYTWKNSEETAVYYSLVAEQADVIIGTRDEFDMMENQVGGKNEATKAYLFQHQAKIVVIKHGVEGSFAYTKAGETFQAQAYKTKVLKTFGAGDSYASAFLYGLFSDESIETALKYGSAAASIVVSKHSSSDAMPTADEIKALIAQAE

SEQ ID NO: 13510 - protein, 315 aa, Caulobacter crescentus CB15
MNGRDLALALVSPGDAPRGHRDLACASLKALEEHLIDAVSEHSADGLIGAAVCGAGPEIDGAIALTAGDFTLTQAWLRAVLKTPRVSLLNDFAACALGAPRLAPSAMRLIHEGKPGRNAQIAVIGPNLGLGVAALTPHRTDGWTPVVSEGGHIDFTPGEPREVPVFEALQARHGRVSAEHFLSQQGLADIYAALGGGLDDSDEVILARVRDGDETAREALSIFSALLGAFAGDAALSFAARGGVYINSPLMERIDGLLDQAAFSRRFEDKGRMSAYLKDIPVYLAVGRCTLLGLSALFTASDLRYEAAEVKVLDC

SEQ ID NO: 13511 - protein, 420 aa, Methanosarcina barkeri str. Fusaro
MVSKDLPFTKEKIQEIIKKYPTPFHIYDEKAILENAEKMKAVFREVPGFKEFFAVKALPNPFILKILREKGFGADCSSLPELILAEKAGITGEDIMFSSNDTPAEEFLKAKELGAYINLDDISHIDYLEKYAGLPDIVCFRYNPGPLKEGNAIIGRPEEAKYGFTRDQLFEGYRILRDRGVKRFGMHTMVASNELKADYFVETARILFELIVEISKELNIKFEFVNLGGGIGIPYRPEEEPVSFEAVAKGVKEAYEATITASGLYPLKVFLECGRVITGPYGYLITQVRHLKHTYKDYVGMDSCMANLMRPGIYGAYHHITVLGKENEAPVHKYDVTGSLCENNDKFAIDRHLPEIEIGDILAIHDTGAHGHSMGFNYNGKLRSAELLLRKDGSVVQIRRAETIEDYFATLDFEALKDFK

SEQ ID NO: 13512 - protein, 270 aa, Magnetospirillum magnetotacticum MS-1
MAMVHSPHFRGYTEAGREITRGRPDWREQFDAGAERTVLPWHPGLPAWTRLQGPNLWPDSLPDLRTGVLAWQEAVTGIGIRLLRAFALSLGQPADAFEPIYAGAPNQHLKIIRYPGRDEAEDAQGVGAHKDSGFLTLLLQDGEGGLEVEGEDGGWIAAAPVEGAFVVNVGELLELASNGFLRATVHRVVAPAAGRDRLSVAFFLGARHDATVPLLSLPPDLAAQARGPASDPDNPLFREVGRNYLKGRLRSHPDVAARHYADLVEDVRAA

SEQ ID NO: 13513 - protein, 471 aa, Mycoplasma mycoides subsp. mycoides SC str. PG1
MCKNREFLFFIFNNFNSIFIGKASMKIVIIGGAASGMTVASRLKKADKKAQIIVIQKEKYVSLGACGLPYFVANPSLKSTDLLARTVEQFIEQDILVYSESVVKKIDAENQKVWYEKNDQLLELDYDKLVISTGAKPIVPPIKGIDLPNIFTLTRLEDATELKEKLKDKNIKKVAVIGSGFIGLECCEMLEHFNKEIVLIEKTSRLNQRVFDQEITDLLEQNLIKNNVEIIKENGLKSITQTKDKRLSLTLDQNEEIEVDLIILAIGFRPATEFLKDTKLEMLGNGAIVVDKHGRTNLKNIWSCGDCATVYHKITNQITYTPLATVARKFAKVVADDILNVNSEFVGTLQTAILKVFESELVSTGINETLAKELGYDIKTIFIKDADHPSYYPNPTPLALKLILNKKTNTLIGAQMYGSNLSVLRINFLISLIWNQIEINQELTQVDLPYSPPFSRVVDIIHIALEKLIKN

SEQ ID NO: 13514 - protein, 513 aa, Bacillus subtilis subsp. subtilis str. 168
MNLVSKLEETASEKPDSIACRFKDHMMTYQELNEYIQRFADGLQEAGMEKGDHLALLLGNSPDFIIAFFGALKAGIVVVPINPLYTPTEIGYMLTNGDVKAIVGVSQLLPLYESMHESLPKVELVILCQTGEAEPEAADPEVRMKMTTFAKILRPTSAAKQNQEPVPDDTAVILYTSGTTGKPKGAMLTHQNLYSNANDVAGYLGMDERDNVVCALPMCHVFCLTVCMNAPLMSGATVLIEPQFSPASVFKLVKQQQATIFAGVPTMYNYLFQHENGKKDDFSSIRLCISGGASMPVALLTAFEEKFGVTILEGYGLSEASPVTCFNPFDRGRKPGSIGTSILHVENKVVDPLGRELPAHQVGELIVKGPNVMKGYYKMPMETEHALKDGWLYTGDLARRDEDGYFYIVDRKKDMIIVGGYNVYPREVEEVLYSHPDVKEAVVIGVPDPQSGEAVKGYVVPKRSGVTEEDIMQHCEKHLAKYKRPAAITFLDDIPKNATGKMLRRALRDILPQ

SEQ ID NO: 13515 - protein, 200 aa, Lactococcus lactis subsp. lactis
MTRISHITRNTKETQIELSINLDGTGQADISTGIGFLDHMLTLLTFHSDFDLKIIGHGDHETVGMDPHHLIEDVAIALGKCISEALGNKLGIRRYGSFTIPMDEALVTCDLDISGRPYLVFHADLSGNQKLGGYDTEMTEEFFRALAFNAGITLHLNEHYGQNTHHIIEGMFKSTARALKQAVSIDESKVGEIPSSKGVL

SEQ ID NO: 13516 - protein, 345 aa, Lactococcus lactis subsp. lactis
MSKKIVTLAGDGIGPEIMSAGLSVLKAVSKKIDFEYELEAKDFGGIAIDKHGHPLPEETLQAVKNADAILLAAIGHPKYNNAKVRPEQGLLALRKELGLYANVRPLKIYPALKKLSPIRNVENVDFLVIRELTGGIYFGQHELADDKARDVNDYSADEIRRILHFAFKSAQSRPRKLLTSVDKQNVLATSKLWRKMADEIADEYPDVRLEHQLVDSCAMLLITNPQQFDVIVTENLFGDILSDEASSLAGSLGVMPSSSHGFNGLALYEPIHGSAPDIAGKGIANPVSMILSIAMMLRESFGQEDGAAMIEKAVTQTFTDGILTKDLGGTATTKEMTEAILKNCQ

SEQ ID NO: 13517 - protein, 325 aa, Oryza sativa (japonica cultivar-group)
MTIYIAREASKVWRKVTTETSVELSLLREKWGLLLAGIVFQYIHGLAARGVHYLHRPGPLLQDLGFMALPEFGQDKGYLSESIFASIFASFVLWTFHPFIYHSKRFYTVLIWRRVLAFLVASQVLRIITFYSTQLPGPNYHCREGSKLATLPPPNNVFEVLLINFPRGVLFGCGDLIFSSHMIFTLVFVRTYHKYGSKRFVKLLAWFMAIVQSLLIIASRKHYSVDVVVAWYTVNLVVFFVDNKLPEMPDRTNGVPLLPLSTREKDGRLKEEKDSRLKEEFHKLLNGNHGDPTDRRQRAQMNGRHDEDINHAHSTLSDAAVNGGT

SEQ ID NO: 13518 - protein, 124 aa, Vitis vinifera
MAYQQDPCANPTHQTGKTGGQTDQYGNPVHQTEALGAYGAGTGTGMHGGEHQQQPHQQSGSSSSEDDGQGGRRKKGMKEKIKERIPGMGRKDEQKHTSATSTPGQGQQQKGMMEKIKEKLPGGH

SEQ ID NO: 13519 - protein, 130 aa, Vitis vinifera
MAYQQDPCANPTHQTVKTGGQTDQYGNPVHQTEAMGAYGAGTGTGMHGGEHQQQPHQQPGVLHRSGSSSSEDDGQGGRRKKGMKEKIKERIPGMGRKDEQKHTSATSTPGQGQQQKGMMEKIKEKLPGGH

SEQ ID NO: 13520 - protein, 941 aa, Pichia pastoris
MPDASLFNGTSFITLFAPNISLLQASIDFYTNFLGFAIRKNSNQKLFWLQLEEDQNNVSIQLILDPEHAASVSQIDQNIRNLTRSLYRKDWRSIQSNIAFKSSSLSKLVKLLKDGGHPVQQSPNEISPFEVYTVDPLGSLIGFSGFKNPFAVNERSLLPKVSEEKAYRAEDDSEKLLNPVRKTIGVMTSGGDSPGMNPFVRAVVRAGIYKGCKVFCIHEGYEGLVRGGEKYIKETQWHDVRGWLVEGGTNIGTARCKEFRERSGRLKACKNMIDMGIDALIVCGGDGSLTGADRFRSEWPSLIEELLQTEQISQQQFNTHQNLNICGAVGSIDNDMSSTDATIGAFSSLDRICRAIDYIDATANSHSRAFIVEVMGRHCGWLGLLAGLATSADYILIPEKPASSREWQDQMCDIVGKHRARGKRKTIVIVAEGAISNDLSPISCDQVKDVLVNRLGLDTRVTTLGHVQRGGTAVAFDRIYATLQGVEAVNAVLECDADTPSPMIAIKEDQITRVPLVDAVELTQQVAKSIESRNFKKAISLRDSEFVEHMKNFISTNSADHVPPSLPLEKRKKIAIINVGAPAGGMNSAVYSMATYCMSRGHVPYAIHNGFSGLARHESVRSINWLDIEGWGSLGGSEIGTNRTLPNDADIGMIAYFFEKYGFDGLILVGGFEAFISLHQLERARINYPSLRIPLVLIPATISNNVPGTEYSLGSDTCLNSFMEYCDVIKQSAAATRNRVFVVEVQGGNSGYIATHAQLACGAQISYVPEEGISLAQLEMDINSLKESFANDQGKTKSGRLILKSENASKVLTTEVISTIIDDEASGRFDSKTAIPGHVQQGGIPSPMDRVRASRFAIRAVSFIERHSDRCQTFKNSISFRQTDEITSTAVVLGIHKSQLRFTPIRQLYDFESDVPRRMRKNIFWSNVREISDMLSGRTSL

SEQ ID NO: 13521 - protein, 556 aa, Vibrio angustum S14
MCSVFGILDIKSDAAALRPIALEMSKKLRHRGPDWSGIYASEHAILAHERLAIVGLNSGAQPLYSPDKKLILAVNGEIYNHKEIRARYEGKYDFQTDSDCEVILALYQDMGEELLEELNGIFAFVLYDEEKDTYLVGRDHIGIIPLYQGFDENGNYYVASEMKALVPVCKTVSEFPPGCYYGSADAEPQRYYTRDWNEYAAVQGNSTSKEELTEALEAAIKRQLMTDVPYGVLLSGGLDSSITSAVAKRFAAMRIEDNDQSEAWWPQLHSFAVGLEGAPDLKAAREVADKIGTVHHEMTYTIQEGLDAIRDVIYHIETYDVTTIRASTPMFLMGRKIKAMGIKMVLSGEGADEIFGGYLYFHKAPNAKEFHEETVRKLLALNMFDCARANKSLAAWGVEGRVPFLDKEFIDVAMRLNPEDKMCGNGKMEKHILRECFEHYLPESIAWRQKEQFSDGVGYSWIDTLKEVAEEKVTDQQLETAAYRFPYNTPTTKEAYAYREIFEELFPLESAAKCVPGGPSIACSSAKAIEWDESFKNAADPSGRAIAAVHNEAYKK

SEQ ID NO: 13522 - protein, 97 aa, Brassica napus
MGKSWALLTHLHSVAGPSITLLYPLYASVCAMESPSKVDDEQWLAYWILYSFITLLEMLAEPVLYWIPVWYPVKLLFVAWLALPQFKGASFIYDKVV

SEQ ID NO: 13523 - protein, 318 aa, Rubrobacter xylanophilus DSM 9941
MTRSGFTVSEAEWCYHDGEFVRLGEVRLSPATHALNYGTGVFEGIRAYWNAERQTLRVLKMREHYERFEKSCRVLHIDLGLGVDELCEITLEILRRNAPREDTYIRPLAYKSAESIGVKLDLPASLSIFTTPMGNYVELTGLRCCVSSWRRIPDNAMPARAKLTGSYVNTALAVDAAHRAGYDEAIFLTHDGFVSEASAANIFLVRKGRLITPPVTADILEGITRDAVMELALEELGLETEERDVARTELYAADEVFLTGTGFQIAPVVEIDDRPVGSGEVGPVASRLQELYFRAARGGWEKYAGWTVPVELKERTAR

SEQ ID NO: 13524 - protein, 518 aa, Glycine max
MASNNHSPPLEILVRGPEDFSLWTGPPFANGQPSIKLEKVKCINAKFSDDGSKLMVTKSNSLISVYDCRIAEEIRAFEVPNVVAAALSPNGTYLQTFQKPSAPQEKNVTLWSIETGAAVHQQSQKNMTKANWPAIQFSSDEATACRLATNEVQFFDTGDFSKGVVCRLRVPGVAAAELSSLPGSHVAAFVPESKGVPASVQIFACGNASQSQPVARRSFFRCSTTQLKWNHGSTGLLVVVQSDVDKTNQSYYGESKLCYLTTDGMHEGLVPLRKDGPIHDAQWSYSGLEFAVVYGFMPAKATLFDKKCNPLLELGTGPYNTIRWNPKGKFLCLAGFGNLPGDMVFWDYIDKKQLGATKAEWSVTSEWSPDGCYFMTATTAPRLQVDNGIKIFHYNGSLYFKKMFDKLYQVDWKPESPGKFGDIAELIKSLNLVQLEDKKPSGQGPPKSTQTSTKASSANPTTQKPAAYRPPHAKNASAIQAELFGETTAETLSKNALRNKKKREKQKEKKAASDASSS

SEQ ID NO: 13525 - protein, 355 aa, Rubrobacter xylanophilus DSM 9941
MSQRFRVLLLPGDGIGPEVVAAARRVADAAAARFGLTLEYEERRIGAAAIREEGAPVSKETLRRAGEADAVLLGAVGDPEFDGGEVRPEAGLLALRRELGTFANLRPVAAIPALSGSSPLRPGVAEGVDLLIVRELTGGAYFGEKEEGEERASDLSVYTRGEVERVARVAFEAARGRRGRVASVDKANVLATSRLWRRVVGEVARDYPDVALEHVLVDAAAMHLVTDPGRFDVILTENLFGDILSDEAAVLPGSMGMLPSASLGEPGSPGIFEPVHGSAPDIAGKGVANPYAAILSAAMMFRHGLGRPEAAEAIERGVEAAVAAGCLTPDLGGSSGTEEAAEAVARRVAAEEGAA

SEQ ID NO: 13526 - protein, 387 aa, Oryza sativa (japonica cultivar-group)
MEGGGAKDGSAAAAQTRGSGDDGSHKPLPPCCLKAKAAAAESEAKCHATVVSGWFTEPRSHSGKTSKVQYFNNPMWPGEAHSLKVENILYQGKSPYQEILVFESSTYGNVLVLDGIVQLTEKDECAYQEMVTHLPLCSIPSPKSVLVVGGGDGGVLREIARHASVENIDICEIDQLVIDVCKDFFPQLSVGFKDPRVQLHVGDAVDFLRNAPEGKYDAIIVDSSDPIGPAQELVEKPFFQTIARALKPGGVLCNQAESMWLHTHLIQDMLSICRETFKGAVHYAWTSVPTYPSGVIGFLLCAKEGPAVNFLSPVNPIEKLEGAMEAGREIRFYNSEVHRAAFVLPTFVRRELESHNTCAEKDKSETKPVAKPKKMKIMPNSAIPTAS

SEQ ID NO: 13527 - protein, 302 aa, Rhodopirellula baltica SH 1
MKMSTATEERIQLVDPRQAYARPPFKDQEAMKMPGSTEKMKPRPDHGEESYEGSGKLKGLTALITGADSGIGRAIAICYAREGANIAINYLSEDTDAKQTAEVAKQAGVDVSVIRGDLREESFCNELVEQTRQEHGAIDILVNNAAYQETGNDVDEFSTELFDRIFKTNVYAPFWLSRAVMKHLPPGGSIINTVSIQGYDPSPYLLPYASTKSAMLGMTKGLAKLAMDHGVRVNAVAPGPVWTPLIPGSMPKEKFEEFGADNLFGRPAQPIELAPLYVWLASPDASYVTGEVFGCTGGRTPV

SEQ ID NO: 13528 - protein, 1221 aa, Xanthomonas axonopodis pv. citri str. 306
MKRMLINATQAEELRVAIVDGQTLYDIDIEQPSKEQKKSNIYKGRITRLEPSLEAAFVDYGAERHGFLPLKEISRDYFQAGVDHNKSTIRELLREGQEIVVQVDKEERGNKGAALTTFISLAGRYMVLMPNSPSAGGVSRRIEGEDRAALKEALDKLDIPDDMGVIIRTAGVGRDAEELQWDLDYLLQTWKAIAEAALSKPAAFLIYQESRLIIRALRDYLRADVGEILVDTPELYADAQEFMKQVMPQSLRKLKHYTDDIPLFNRFQIESQIEGAYERNVRLPSGGSIVVDQTEALTAVDVNSSRATKGSDIEETAFQTNLEAAEEVARQLRLRDLGGLVVIDFIDMASSKHQREVENRLQNALKYDRARVQLGRISRFGLMEMSRQRLRPSLGESSQIVCPRCDGHGRMRSVESLSLSIIRVAEEHAMKENTGQVLVQAPVEIANYLLNEKRSALREIEQRHESPIIIVADEQLHTPHYEVTRLRENELGEESGKPSYQRGTPRKLPVHALTKAQLNIPAAPAVTSIKPSQPAPVREEAPAPVAPVAAPVPVVTVPIPAPVTGVVGWLKRIFGGVEPVAPAPESTPRPRQNDAGRNNRSERGERGGQRRDGRDARNGGNSGNQQRGNGGNGNGANKERRDERRQPANAQGAQNGAQAQQQVQVPKPPRNEAQAPKPQQQKPKPQNQSPRPPRAPAQQDGAPAERQPRPARQDEGTAAAQTPTPTAATATTSSVVSAIADAAAAPPTNAQTNAHEAAQAHPVDVTVSESTADRGADANAAAPAQEAAGDDAANGEGGSRRRRGRRGGRRRRRGAGANGEGGASVDGLEGDDLDSDADNDLDGDSEGDDAGMHAHASAAPRAGQPEFDFDDDAPAPAVRAKPEPAVQATAKPRPVPKERAEPQVGSDTASTTAPVSNTVPASQPSATPVANADAARERPAAPVAATDATAKPAPAATASTVAGTEGAAAQAAEQRPATIAQQASATPAPIAAPAPGVSAPAAAVAPAAGTAPVAAAVAPAPAVASPVTSNAATSSPQQPSAPASAAPPAAAQAAKPDQQQPAASADVETPSVQATPVQPARATPAEDLSAPAAASPASQAAVVTVTSPHAEQSASQAPSSEVATTSTSTVVQASPSADTAPVRRPYAPVQTTMLDALSPNEAAPAASSASKPPAAPAAAQESQADKPKPTVVVSEAVKPVAPSAEADRPRDDDSNKPRGDH

SEQ ID NO: 13529 - protein, 388 aa, Dehalococcoides sp. CBDB1
MKLSKRIENLPPYLFVQISKKIAEKRAKGEEVISFAIGDPDLPTPKHILAELCKAAEDPSNHRYPETEGLPVLRKAMAEWYQKRFGVKLNPDTEVLPLIGSKEGIGHAAWCFLDPGDIALVPNPAYPVYAISSQLAGAEVFNLPLNKGNNFLPNLEAIPQNILSKAKVLWINYPNNPTGAVAGLSFFQEVANFAAKHNLAVCHDGPYSEIAFDGYKPVSFLEADGAKDVGIEFHSLSKSYNMTGWRIGMAVGNAKMIDALRRFKSNLDSGIPQAIQLMAIAALNGSQEIINQNCAIYQRRRDRLVESLRNIGMEVTAPKASLYIWAPVPESYTSASFATELLDKTGVVVTPGTGYGTAGEGYIRLSLTVPDEQIEKGIAKLAGYKKSS

SEQ ID NO: 13530 - protein, 565 aa, Photorhabdus luminescens subsp. laumondii TTO1
MELEHESKRPLYIPYSGPILLEFPLLNKGSAFTEEERRNFNLHGLLPEAVETIEEQAERAYRQYLDFKNDADKHIYLRNIQDTNETLFYRLLDAHLNEMMPIIYTPTVGEACEHFSDIYRRARGLFISHPNKAHIDDMLQNATKQNVKVIVVTDGERILGLGDQGIGGMGIPIGKLSLYTSCGGISPAYTLPVVLDVGTNNPQRLNDPLYMGWRHPRITGKEYDEFVDEFIQAVKRRWPNVLLQFEDFAQKNAMPLLNRYRHEICCFNDDIQGTAAVTLGSLIAASRAAGRQLKDQTVTFLGAGSAGCGIAEQIVAQMKSEGLSDEQARARIFMVDRFGLLTDKLPNLLDFQNKLVQKSSSLAKWDVNNDSISLLDVVRNAKPTVLIGVSGQAGLFTEEIIREMHKHCERPIVMPLSNPTSRVEARPEDIINWTDGAALVATGSPFNPVKYKDQEYPIAQCNNAYIFPGIGLGVIASGAKLVTDGMLMAASRTLANCSPLAQEGQGPLLPLIDDIQEVSRKIAKQVAKEAQIQGVATVTSDGALDEAIERNFWKPEYRVYKRTSF

SEQ ID NO: 13531 - protein, 272 aa, Xanthomonas axonopodis pv. citri str. 306
MLAVSSHNLWIALAVTLAAGLATGLGSLMVVFAKKPNPRLLAFGLAFAGGAMVYVSLTEILNKSIAAFSQAYNDKLGFTFGTLTFLGGMLLIMVIDRLVPNPHQSLSSDDPQFREDNRAYIRRVGLMTAVAITAHNFPEGLATFFATLESPAVGMPLAFAIAIHNIPEGIAIAVPVYFATRNKFYAVGASLLSGLAEPVGAGIGYLALFSVLSDAVFGTVFGLISGVMVFLALDELLPAAKRYAQGHETVYGLVSGMGTLAISLVLFRFATP

SEQ ID NO: 13532 - protein, 253 aa, Dehalococcoides sp. CBDB1
MRQIIIAGNWKMNTTLSEACTLVQSMKCELERIEGIEKIICPPFISLYPIKTILENSSIKLGAQNLFYQEKGAYTGEISPLMLKELCQYVIIGHSERRAYFGETGQVVNQKIKAALQAGLLPIVCVGEKPEENENGQTRQVLETQLKEALDGLNLSCIIIAYEPIWAIGTGKAATASEANSAIGYIRRVLGDTLGNAAAQTSPILYGGSVNEKNITEILSQTNIDGALVGGASLKAESFVSICRQAAVIQNKH

SEQ ID NO: 13533 - protein, 397 aa, Dehalococcoides sp. CBDB1
MENLTIRDLNFSGKKALVRVDFNVPINEETGTINDDSRIRAAIPTIDYLLDHQAKVILCSHLGRPDGMIVESMRLAPVAKRLSEILRQEVFTASDCIGDEVAAKVDALEDSQVLLLENLRFHPEEEANDPIFAKKLADLADIYVDDAFGTAHRKHASIVGVAKYLPAVAGLLLEKELNALGKVLEHPPRPFMILLGGAKVSDKVGMLENVMDKVDTILIGGGMAATFLKAQGLEIGDSLIDDSLDTAKMLMDKAKSKNVKIILPDDVLVTFDKIGPEARAENVSVENIPHTAKIVDIGLLTITHFTKHLEKCKTVFWNGPMGIYEIPQFSEGTRAMVNTMTRLHATTIIGGGSTAEIVTELNIASKMSFVSTGGGASLKFLSGEKLPGVEVLAKKNE

SEQ ID NO: 13534 - protein, 350 aa, Cryptococcus neoformans var. neoformans JEC21
MAAPQATLGADLEPPATDLITLTRHILSQQYALGESATGDLTMLLIAIQVTSKYIASNVRKARLINLVGLAGASNVQGEDQKKLDVLSNDIMVNALSASGKCSVMVSEEVDEAIIVSGIKGTYCVVFDPLDGSSNIDAGVNVGTIFGVYKVQEGSRGTVEDVLRPGREMVAAGYTMYGSSCNLVLSTGNGVDGFTLDESLGEFILTHPAIKIPSRGKIYSFNEGNSLHFYPPTNDYLNSIKYPENGKPYSARYIGSMVADVHRTLLYGGIFGYPDDKKSKDGKLRMLYEAFPMSFLTEQAGGVATTGSQRILDIVPTSIHGRCPVFLGSKEDVEDLKKFYVNYKDDSRKW

SEQ ID NO: 13535 - protein, 303 aa, Arabidopsis thaliana
MALKFSGAYKQCKPCTGSSSSPLKKGHRSFPDYDNASEGVPYPFMGGSAGSTPAWDFTNSSHHPAGRLESKFTSIYGNDRESISAQSCDVVLDDDGPKEWMAQVEPGVHITFASLPTGGNDLKRIRFSREMFDKWQAQRWWGENYDKIVELYNVQRFNRQALQTPARSDDQSQRDSTYSKMDSARESKDWTPRHNFRPPGSVPHHFYGGSSNYGPGSYHGGPPMDAARTTTSSRDDPPSMSNASEMQAEWIEEDEPGVYITIRQLSDGTRELRRVRFSRERFGEVHAKTWWEQNRERIQTQYL

SEQ ID NO: 13536 - protein, 1073 aa, Escherichia coli CFT073
MPKRTDIKSILILGAGPIVIGQACEFDYSGAQACKALREEGYRVILVNSNPATIMTDPEMADATYIEPIHWEVVRKIIEKERPDAVLPTMGGQTALNCALELERQGVLEEFGVTMIGATADAIDKAEDRRRFDVAMKKIGLETARSGIAHSMEEALAVAAEVGFPCIIRPSFTMGGSGGGIAYNREEFEEICARGLDLSPTKELLIDESLIGWKEYEMEVVRDKNDNCIIVCSIENFDAMGIHTGDSITVAPAQTLTDKEYQIMRNASMAVLREIGVETGGSNVQFAVNPKNGRLIVIEMNPRVSRSSALASKATGFPIAKVAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKDAGAERIWYIADAFRAGLSVDGVFNLTNIDRWFLVQIEELVRLEEKVAEVGITGLHAEFLRQLKRKGFADARLAKLAGVREAEIRKLRDQYDLHPVYKRVDTCAAEFATDTAYMYSTYEEECEANPSTDREKIMVLGGGPNRIGQGIEFDYCCVHASLALREDGYETIMVNCNPETVSTDYDTSDRLYFEPVTLEDVLEIVRIEKPKGVIVQYGGQTPLKLARALEAAGVPVIGTSPDAIDRAEDRERFQHAVERLKLKQPANATVTTIEMAVEKAKEIGYPLVVRPSYVLGGRAMEIVYDEADLRRYFQTAVSVSNDAPVLLDHFLDDAVEVDVDAICDGEVVLIGGIMEHIEQAGVHSGDSACSLPAYTLSQEIQDVMRQQVQKLAFELQVRGLMNVQFAVKNNEVYLIEVNPRAARTVPFVSKATGVPLAKVAARVMAGKSLAEQGVTKEVIPPYYSVKEVVLPFNKFPGVDPLLGPEMRSTGEVMGVGRTFAEAFAKAQLGSNSTMKKHGRALLSVREGDKERVVDLAAKLLKQGFELDATHGTAIVLGEAGINPRLVNKVHEGRPHIQDRIKNGEYTYIINTTSGRRAIEDSRVIRRSALQYKVHYDTTLNGGFATAMALNADATEKVISVQEMHAQIK

SEQ ID NO: 13537 - protein, 532 aa, Oryza sativa (indica cultivar-group)
MVFRGWLMWAPASAPVLVVFGLLFGLALVWQAGRLLHRLWWRPRRLEKALRARGLRGSSYRFLTGDLAEESRRRKEAWARPLPLRCHDIAPRIKPFLHDTLGEHGKQRQPCITWFGPTPEVNITDPELAKVVLSNKFGHLERVRFKEVSKLLSQGLTYHEGEKWVKHRRIINPAFQLEKLKLMLPAFSACCEELISRWIGSIGCDGSYEVDCWPELKSLTGDVISRTAFGSSYLEGRRVFELQAEQFERAMKCMQKISIPGYMSLPIENNRKMHQINKEIESILRGIIGKKMQAMKEGESTKDDLLGILLESNTKHMEENGQSSQGLTMKDIVEECKLFYFAGAETTSVLLTWAMLLLSMHPEWQDRAREEILGLFRKNKPDYEGLSRLKIVTMILYEVLRLYPPFIEIGRKTYKEMEIGGVTYPAGVSIKIPVLFIHHDPDTWGSDVHEFKPERFSEGISKASKDPGAFLPFGWGPRICIGQNFALLEAKMALCLILQRLEFELAPSYTHAPHTMVTLHPMHGAQIKVRAI

SEQ ID NO: 13538 - protein, 139 aa, Bacillus cereus G9241
MTRVRDFMSTHIVQCTPLDNVYEAAVKMKEESIGLIPVVENEQVVGLVTDRDLVVRGIAEKHPGSNKITNVMTTNIVSIAPDDSIEKATELMAQYQIRRLPVVENGQLVGMLALGDLATREAADDQAGFALGEISEHKE

SEQ ID NO: 13539 - protein, 557 aa, Methanosarcina mazei Go1
MTNSLWMLGKTKRYLEVTRVLFKYNLIPELYHDLRTEYISNPDCTCTFDLENRETAAKLRQAFEELGPTFIKMGQTMSKRPDLVPQPYVVEMANLQDRVKPVPFEEMAESLDLACVCEYQTREERKRKKSEEELKAARERKAKAFIDIFDSFDPEPIACGSIAQVYKGVLEGKPVAVKILRPHLIDIINIDLSILDDFKPVMKKVMGVGKNFDIDAFLLEIREMLTREVDLRIEAVNMRRFEDNFKNVKNVSVPKIYPDYCSANVLTMEFIQGTQVKDIIDTPLPQSKKSEYTRTITKSYLKQVYIDGFYHADPHGGNMLVEENDTVSFIDFGAVGSIDDELKRNMLEFYYAINNRDVEGATQGFLKIGGADSRDVDVRRLRKDMDELIANQNYGLEGRQSDNYAKLGLKYDIRLPGEFSTLQRAILLIEGVCLELDPRYNIKSIAIPVLMDAYKKLNTPKGAALHIEFSSEPVDEKAEMRAAIREVADKMEGMGDRFLEVRQKDKRREVFSKEIFLAVLLVVSAYILLYGEVFYWVGLAGFGGAILIAVIASLKGK

SEQ ID NO: 13540 - protein, 147 aa, Arabidopsis thaliana
MKADPRKETGIKLVAVEISLTFGNRKWQPHKNSGAKDEEAKFNKRTKYKMRIRPRSSISKRRRLIGGLSAYTTDQSLRQLFAPFARLIKDQQTQRPKGFGFITFESEDDAQKALKALNGKIVNGRLIFVETAKEVEAPTTSLKSNKD

SEQ ID NO: 13541 - protein, 521 aa, Populus tremula x Populus tremuloides
MPAVGIAVGDNKKEYPGNLTPFVTVTCVVAAMGGLIFGYDIGISGGVTSMPSFLRKFFPSVYHKQQDSITNKYCQYDSQTLTMFTSSLYLAALLASLVASIVTRKYGRKLSMLFGGLLFCAGAIINGFAKAVWMLILGRILLGFGIGFANQSVPLYLSEMAPYKYRGALNIGFQLSITAGILIANVLNYFFVKIHGGWGWRLSLGGAMVPALIITVGSLVLPDTPNSMIERGQHDEAREKLKRVRGVDDVDEEFNDLVAASEASKKVENSWKNLLQRKYRPHVAMAVMIPFFQQLTGINVIMFYAPVLFNTIGFGNDAALMSAVITGIVNVVATMVSIYGVDKWGRRFLFLQGGCQMLICQIVVAACIGAKFGIDGNPGELPKWYAIVVVLFFCIYVAGFSWSWGPLGWLVPSEIFPLEIRSAAQSVTVSVNMLFTFIIAQVFLTMLCHLKFGIFLFFAFFVVLMSIFIYYFLPETKGIPIEEMGQVWTTHWFWSRYVTDEDYPMGGGYEMTKGGQGPKSV

SEQ ID NO: 13542 - protein, 307 aa, Oryza sativa (japonica cultivar-group)
MRAAAAAAGQIDPSPGAPAKSRLKRLFERQLLRVSPAERLPSVAGVGEKDESSEPSSVCLDGMVRSFLEDGVGVERPAGAARCCNCFHGGEASDDDDDGPAAAEAAATSDAAETIKGLVHCASLRERNLLADVSTLVERHRAAGARKRDLLRLLADSLRAAGHDAAVCISRWDKSSSHPKGEHAYLDVLLPPASDRAERERILVDVDFRSEFEVARPTKAYRAVLQRLPSVFVGKEDRLRLLVAAAADAARASLKKRGLHLPPWRKPEYMRAKWLSPYERDVPSPQQPDASAGELAVDGEGGGAWTQ

SEQ ID NO: 13543 - protein, 396 aa, Oryza sativa
KSWLSLCQTCVLATLLCSDTCLKLKTIEEKIGRGCRGGRKEGRKKATMVDLVNGVLNWVATPAMVASLLLFYPPYYLFKTVHSFLSYLFPDDLARKVVLITGASSGIGEQLAYNYALNRASLVLVARREWSLRKVADQAFELGAPDVIILPGDVANPEDCKRFVQTAIDHYGRLDHLVCNAGIASVGAFQEIPDVTNYSSQFDVNFWGSVQSTFEALPHLKRSRGRIVVTASATGWNPVPRMTFYNAANAALINFYETLRTELGSQVGITIVTPGWIESEMSKGKFLKDHGEMEVDQEMRDAQIGLFPVEYAKNCAKAMVQAVRQGKRCLTVPPWFSTMYLWRVFAPEVVEFCYRLLYMHRHGGSQADAPSKKMAEAGGKKLLYPTSLRSDDIKDE

SEQ ID NO: 13544 - protein, 356 aa, Oryza sativa (indica cultivar-group)
MENMRSENFNQGVSMEGVKHAPEMANTNRRALRDIKNIIGAPHQHMAVSKRVSLMGLNFLTCFSKPAAKNQSGHRPMTRKFAATLANQPSSAPLIYMQKLEMAPIGSERQKRTADSAFHGPADMECTKITSDDLPLPMMSEMDEVMGSELKEIEMEDIEEAAPDIDSCDANNSLAVVEYVDEIYSFYRRSEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKVGQKHTGASIFVLIYSSFAMECSKMMVELHQKAGHGKLTGVHRKYSTFRLLPIKSVGT

SEQ ID NO: 13545 - protein, 350 aa, Medicago truncatula
MDSLSLHLSYPPFPKTQKLFTTKPFSLLSNPNPLHSSSFPQPHFNKKISISHSPIPLQNLFKKSTFSFSIINLFTPFQSLAVEAPTLTESDAGRINLESILVSIDDFFNRYPFFVAGCSFIYLVAIPLAEEYFRKYKFVSAIDAFRKLRDEADSQLLDIRDRKNVKFLGSPSLKMVNKEVVQFEFVEGNEDGFVKKVLERFKDASNTAVFVLDSFDGNSMKVAELLFKNGFKEAYAIKGGVRGQQGWMAIQDTLLPPSVHINRRKKTKVPKELNTNGNGAIQQSDNKNESLVSSDTPAVGNQETENDHVKKSVESNPEMKISSVVSSSPYPNVCNSQLSLSLAFTSFFPL

SEQ ID NO: 13546 - protein, 471 aa, Mycoplasma mycoides subsp. mycoides SC str. PG1
MCKNREFLFFIFNNFNSIFIGKASMKIVIIGGAASGMTVASRLKKADKKAQIIVIQKEKYVSLGACGLPYFVANPSLKSTDLLARTVEQFIEQDILVYSESVVKKIDAENQKVWYEKNDQLLELDYDKLVISTGAKPIVPPIKGIDLPNIFTLTRLEDATELKEKLKDKNIKKVAVIGSGFIGLECCEMLEHFNKEIVLIEKTSRLNQRVFDQEITDLLEQNLIKNNVEIIKENGLKSITQTKDKRLSLTLDQNEEIEVDLIILAIGFRPATEFLKDTKLEMLGNGAIVVDKHGRTNLKNIWSCGDCATVYHKITNQITYTPLATVARKFAKVVADDILNVNSEFVRTLQTAILKVFESELVSTGINETLAKELGYDIKTIFIKDADHPSYYPNPTPLALKLILNKKTNTLIGAQMYGSNLSVLRINFLISLIWNQIEINQELTQVDLPYSPPFSRVVDIIHIALEKLIKN

SEQ ID NO: 13547 - protein, 535 aa, Oryza sativa (japonica cultivar-group)
MVLGGWLLMWAPASSPTILVAFGLLFGLVLAWQAGLQLHRLWWRPRRLEKALRARGLRGSSYRFLTGDLAEESRRRKEAWARPLPLRCHDIAPRIEPFLHDAVVRPEQHYGKPCITWLGPTPEVHVTDPELAKVVMSNKFGHFEKIRFQALSKLLPQGLSYHEGEKWAKHRRILNPAFQLEKLKLMLPVFSACCEELISRWMGAIGSDGSYEVDCWPELKSLTGDVISRTAFGSSYLEGRRIFELQGELFERVMKSVEKIFIPGYMYLPTENNRKMHQINKEIESILRSMIGKRMQAMKEGESTKDDLLGILLESNMRHTEENSQSSQGLTIKDIMEECKLFYFAGADTTSVLLTWTILLLSMHPEWQDRARKEILGLFGKNKPEYDGLNNLKIVTMILYEVLRLYPPFIELKRRTYKEMKIGGVTYPAGVIINLPVLFIHHDLKIWGSDVHEFKPERFSEGISKASKDPGAFLPFGWGPRICIGQNFALLEAKMALCLILQRLEFELAPTYTHAPHTMITLHPMHGAQIKIRAI

SEQ ID NO: 13548 - protein, 502 aa, Agrobacterium tumefaciens str. C58
MGNNPIPMTAAGNRANREKMRRQPIRSRATGANHKEQIFLHGDEPGWESPEDACRAFPGGTTMSDTGGYFPRWRLKTEGRIMPDERLPAGQTAVLGLQHVVAMFGSTVLAPLIMGFDPNVSILFSGISTLIFFIAVGGRVPSYLGSSFAFIGPVLVATGAAAGAASPDIALALGGIIAAGVLYALIGVIVMIVGHNWIEKLMPPVLTGAIVAAIGLVLAPIAIASASGTGPGNPDGDQLSRWIAILTVTSVGAIAVYAPGMTRRLPILLGGAIAYLAYLVLANGFGLGKPVDFAGVAAAAWFGLPAFTTPVFSAPAIALIAPVVVILVAENLGHIKAIGAMTGRNLDPYLGRAFIGDGIATIFSGAFGGTGMTTYAENMGVMAITRIFSTLVFIVAALVAIILGFSPKFGALIQTIPGPVIGGLSVVVFGLIAATAGRIWVENKVDFSEPRNLITVGIALVLGAGNFKLNVAGFTLDGIGTATIGAIAFYHLLGLGRPAQGR

SEQ ID NO: 13549 - protein, 311 aa, Zea mays
MADAKQQQQQQQQPQQAAAAATGVWKTVKPFVNGGASGMLATCVIQPIDMVKVRIQLGEGSAGQVTRNMLANEGVRSFYNGLSAGLLRQATYTTARLGSFRVLTNKAVEKNEGKPLPLIQKAFIGLTAGAIGACFGSPADLALIRMQADSTLPAAQRRNYKNAFHALYRISADEGVLALWKGAGPTVVRAMALNMGMLASYDQSVELFRDKFGAGEISTVVGASAVSGFFASACSLPFDYVKTQIQKMQPDANGKYPYTGSLDCAVKTFKSGGPFKFYTGFPVYCVRIAPHVMMTWIFLNQIQKFEKKIGI

SEQ ID NO: 13550 - protein, 464 aa, Cryptococcus neoformans var. neoformans JEC21
MSFIASRNALRSQLRPSLARSFATTPAAYAQSLKDRMAELIPQEIENVKATRAAHGAKSLGDVTVDMAYGGMRGIKGLIWEGSVLDPNEGIRFRGLTIPECQQKLPTAPGGSEPLPEALFWLLLTGEVPTDEQVKGLSQEWAARAAIPKFVEELIDRCPNTLHPMTQFAIAVNALNHDSAFAKAYSNGVHKKEYWKTTFDDSMDLIAKLPNIAGRIFRNVFGDGKLPPIDPSKDYSANLATLLGFGDNADFVELMRLYITIHSDHEGGNVSAHTGHLVGSALSDPFLAFGASLNGLAGPLHGLANQEVLRWVQKMRSQIGEDASDEKVAEYVWSTLKSGQVVPGYGHAVLRKTDPRYTAQREFALKHLPEDPLFKLVGQIYKIVPNILLEAGKAKNPWPNVDAHSGVLLTYYGLHQQDFYTVLFGVSRAFGVVSQLIWDRALGMPLERPKSYSTEAIKKMFEGK

SEQ ID NO: 13551 - protein, 175 aa, Lactobacillus acidophilus NCFM
MAIDFSKYIASVQDFPNKGIVFRDITPILQNGELYRAATHELAEYAKSRNADVIVGPEARGFIVGCPVATELGLGFVPARKPHKLPREVERASYDLEYGSNSLEMHKDAIKPGQRVVLCDDLMATAGTLRASKELIENLGGKLVGAAFYIELPDLKGREKLPDVDIYSLVKYHGA

SEQ ID NO: 13552 - protein, 418 aa, Glycine max
VYRAPPRVSYVGPPPVTDDYDGVKVWWVSNKVMSPTRSPMSYYPEQEKRFYKLTFHSKNRDTITESYLKHVMREGKEIRLRNRQRKLYTNSPGYKWPSYKQTMWSHIVFEHPATFDTMAMEPEKKKEIIEDLVTFSKSKDFYARIGKAWKRGYLLYGPPGTGKSTMIAAMANLLAYDVYDLELTAVKDNTELRKLLIETTSKSIIVIEDIDCSLDLTGQRKKKGDKSSWDEDEAEKDVIGRKEAKEEGGSSGCSKVTLSGLLNFIDGIWSACGGERLIVFTTNYVEKLDPALIRRGRMDKHIQLSYCTFDGFKVLANNYLKLETHPLFDTIESLIGEVKITPADVAENLMPKSPLDDPHKCLSNLIVALEEAAKVEEMKQSSPIKEELLQQNGSIKENGELHGDKAMNQCQMWLVNDT

SEQ ID NO: 13553 - protein, 435 aa, Arabidopsis thaliana
MFSSSARSSGSDSLMSSMATCALSVKTFTLSELEKATDRFSAKRVLGEGGFGRVYQGSMEDGTEVAVKLLTRDNQNRDREFIAEVEMLSRLHHRNLVKLIGICIEGRTRCLIYELVHNGSVESHLHEGTLDWDARLKIALGAARGLAYLHEDSNPRVIHRDFKASNVLLEDDFTPKVSDFGLAREATEGSQHISTRVMGTFGYVAPEYAMTGHLLVKSDVYSYGVVLLELLTGRRPVDMSQPSGEENLVTWARPLLANREGLEQLVDPALAGTYNFDDMAKVAAIASMCVHQEVSHRPFMGEVVQALKLIYNDADETCGDYCSQKDSSVPDSADFKGDLAPSDSSWWNLTPRLRYGQASSFITMDYSSGPLEDMENRPHSASSIPRVGGLILPNRSGPLRPMRSRRNFFRLRGSMSEHGGPSSSRHLWSGNGDWL

SEQ ID NO: 13554 - protein, 141 aa, Pseudomonas syringae pv. tomato str. DC3000
MAVQRTFSIIKPDAVAKNVIGEITTRFEKAGLRVVASKLKQLSKAEAEGFYAEHSARGFFGDLVAFMISGPVVVQVLEGENAIALNRELMGATNPKEAAAGTIRADFADSIDANAVHGSDSEAAAAREISYFFAATEVTAR

SEQ ID NO: 13555 - protein, 384 aa, Lactobacillus acidophilus NCFM
MAQEDYYKVLGVDRDASDQEISKAYRKLAKKYHPDLNHEPGAEEKYKQVNEAYEVLHDKQKRAQYDQFGSAGVNGQGGFGGAGQGFGGAGFDTSGFGDFGDIFGDIFGQGARQQRVDPTQPQRGQDLDYTLTIDFMDAINGKKTQVSYTRDETCETCGGNGCEKGTHPITCDKCHGTGVMTVTQQSMLGMIRRQTTCDKCNGRGVIIEHPCKTCGGKGTVERKNTIEVDIPAGIDNGQQLRYQGQGEAGRNGGPYGDLYISYRIKPSKDFERRGQNIYTEVPISFAQATLGDEITVKTVHGDAKLTIPAGTQPNKKFTLRGQGVPYLRGNGNGDQITTVNIVIPKHINDKQKEDLTNFVHDGGGNITPQEKGFFERLKDKLSGE

SEQ ID NO: 13556 - protein, 513 aa, Oryza sativa (indica cultivar-group)
MVLGGWLLMWAPASSPTILVAFGLLFGLVLAWQAGLQLHRLWWRPRRLEKALRARGLRGSSYRFLTGDLAEESRRRKEAWARPLPLRCHDIAPRIEPFLHDAVVRPEQHYGKPCITWLGPTPEVHVTDPELAKVVMSNKFGHFEKIRFQALSKLLPQGLSYHEGEKWAKHRRILNPAFQLEKLKLMLPVFSACCEELISRWMGAIGSDGSYEVDCWPEMKSLTGDVISRTAFGSSYLEGRRIFELQGELFERVMKSVEKIFIPGYMGMIGKRMQAMKEGESTKDDLLGILLESNTRHMEENGQSNQGLTIKDIMEECKLFYFAGADTTSVLLTWTMLLLSMHPEWQDRARKEILGICGKNKPDYDDLSRLKIVTMILYEVLRLYPPFIELKRRTYKEMKIGGVTYPAGVIINLPVLFIHHDPEIWGSDVHEFKPERFSEGISKASKDPGAFLPFGWGPRICIGQNFALLEAKMALCLILQRLEFELAPTYTHAPHTMITLHPMHGAQIKIRAI

SEQ ID NO: 13557 - protein, 365 aa, Triticum aestivum
  misc_feature (181)..(181): Xaa can be any naturally occurring amino acid
SNLLDWPEPIVPVQTLSNSGMSSLPQQYVKPPSERPSGVTNDPNLSIPVIDLASFSNAPEHHQEMLKAIASACKNWGFFQLVNHDVDTEAVRRMRSAWREFFDLPMEEKKAHANLPVTYEGYGSRLGVEKGAILDWSDYYFLNLFPSDIRNLDKWPKIPTDLREATEKYACQLISLCQVLXKAMSSSLRAGREGLPPIMPLGASEGISATMRVNYYPRCPQPELTLGLSSHSDPGGITLLLTDDNVEGTQVRKGDAWVTVQPVPGSFLVNVGDQIQILSNGRYRSVEHRALVNSDKERFTIAFFCNPRGDLPVAPASELVGPGSPALYQEPVTFSDYRKYIRTKGPSGKTQVQSISSTMQPGPAA

SEQ ID NO: 13558 - protein, 270 aa, Hyphomonas neptunium ATCC 15444
MTHLLGVVGDPVAHSLSPFIHNGWLRAHQIDAVYSAFEVKAGELVSGLQSLSSQGVIGLNVTLPHKEEAMRLATSVSGTAHRLGAVNFLVRREDGWIGDNTDAPGFGLTLDFGDIEVSGRNVFLLGAGGSARAVASVLADRGARLTICNRTVGRAEDLARDLAPGARVRSLDEGLRKLSSAALVVNTLSLGHSGGRLELPPSAGGIFYDISYGKGAEAALKEAREKGWRALDGLGMLVAQAAISFEHWFGIKPDMAEAHARCRKLVEATS

SEQ ID NO: 13559 - protein, 100 aa, Zea mays
  misc_feature (42)..(43): Xaa can be any naturally occurring amino acid
THPSCERELVPSSSLGARLCRGRRPWGGWATTLIFFLSPIPXXLFTLLCFNRLPSTNLFHFTLVTTPLIFCWIMYAIVYLAHMKPFINPILNLELTLHLF

SEQ ID NO: 13560 - protein, 429 aa, Vibrio angustum S14
MADKKATLHIEGKAPIELPIIGGSEGQDVIDVRKLGANGFFTFDPGFLATASCESQITYIDGEEGILLHRGFPIDQLANNADYLEVCFVLLYGEVPTRAEYEQFRTTVTRHTMVHEQIASFFHGFRRDAHPMAVMCGVVGALSAFYHDSLDINNDTHREIAAFRLLSKMPTLAAMCHKYTIGQPFIYPRNDLDYAENFLHMMFATPCEEYEVSPVVARAMDKIFTLHADHEQNASTSTVRLAGSSGANPFACIAAGIASLWGPAHGGANEACLKMLEEIGSVDNIPEFIDRAKDKDDPFRLMGFGHRVYKNYDPRATVMREACHEVLEELKIEDPLLDVAMELERIALSDDYFVSKKLYPNVDFYSGIILKAIGIPVSMFTVIFAMSRTIGWIAHWNEMHSDPTNRIGRPRQLYTGESYREFKPLHERE

SEQ ID NO: 13561 - protein, 459 aa, Oryza sativa (japonica cultivar-group)
MKTSLCVLLCILVISEVVGVPRCAAALGINYGQVGNNLPSPAQVVSLLASLRIGKVRIYDANPQVLAAFAGTGIELIVTVPNDLVRPMAASPGEALQWVSSSVRPYFPATRVTGIAVGNEVLTDDDEALKAALVPAMRNLHAALAQLGMDGYVHVSTASSLAVLATSYPPSQGAFTAEVAPLMAQFLRFLAETNAPFWINAYPYFAYKGDPTRVSLDYALSNPYHVGAIDPYTRLQYTSMLYAQVDAVAYATSQLGYNNIPVYVSETGWPSKGDTDEVGATVENARAYNRNLLLRQAAGEGTPLRPRQRLEVYLFALFNENMKPGPTSERNYGLYQPDGRTMVYNVGLMQQSTSAASLSLAASPATKTDAKKNFAGLCFLSSLAILQCPNASSAQRKSFWHKQNGLTIVDQKPLQDQRGDAPFQGGKRKIKGSSCCQEEKLEEATLGCGRHYLGDGTEL

SEQ ID NO: 13562 - protein, 434 aa, Oryza sativa (japonica cultivar-group)
TLLPPLRFCSPLKTPPPSPPPPHLRRLQTLTRALASSSSAMASPPAKKVLVPIASGTEPMEAVITVDVLRRAGADVSVASVDPGSAQVGGAWGVKLAADALLDDLADAEFDLISLPGGMPGSSNLRDCKLLENMVKKHAGKGKLYAAICAAPAVALGSWGLLNGLKATCYPSFMDKLPSEVNAVESRVQIDGNCVTSRGPGTAMEYSVVLVEQLYGKEKADEVAGPMVMRPQHGVEFSLKELNSTSWNVGETPQILVPIANGTEEMEATMIIDILRRAKANVVVASLEETLEIVASRKVKMVADVLLDDALKQQYDLILLPGGLGGAQAYAKSDKLIGLIKKQAEANKLYGAICASPAIALEPHGLLKGKKATSFPGMWNKLSDQSECKNRVVVDGNLITSQGPGTSMEFSLAIVEKLFGRERAVELAKTMVFM

SEQ ID NO: 13563 - protein, 178 aa, Oryza sativa (japonica cultivar-group)
MAKKLLAAAAALLLLLAAAAQALASSSSSPGSANLTATPTAYEMVERYGFPRGILPEGVESYVLRPDGSFEVRLSGDGNGGGDCEFRVGDGGAYLLRYGRRVAGVAMEGSIRSLEGVSVKVLFAWLGIGRVDRAGDDLRFFVGPLSAAFPLANFADCPRCRCGFDCDTAAAADVIAAS

SEQ ID NO: 13564 - protein, 375 aa, Rubrobacter xylanophilus DSM 9941
MKSRAALLYGEGQEFRVEEIEVDDPKQNEVLVHLAATGLCHSDYHMVTGEYGPLHFPMIGGHEGAGVVEKVGPGVTRVSPGDHVLLTFIPACGHCRFCSMGLSFLCDRGAAILQGPQLDGTFRMHTADGQDAGQFCCISTFSEYTVVPEASIVPIDRDLDLTKVCIVGCCVPTGFGSAVNKADVQPGETVVVFGIGGVGINAVQGAAVKGASKVVAVDPVDFKLETAEELGATHTINPNERDPVQTVVDLTNGVGADKAIITIDNVLPEHVGQAFKAIRKGGRVVVTGVARYDHQHIDVPPYELTLFAKEVVGTMYGDSPVNADLARYLELYRTGKLKVDELITRTYSHDEINQGYRDMLDGKNIRGVIVYDWAR

SEQ ID NO: 13565 - protein, 708 aa, Dehalococcoides sp. CBDB1
MDLSWLVWTAGLIAVLFALYLIRDVMRRDSGTPAMQDIAGRILEGAVAFLRRQYRTIAILAVVAAVAVGAVVGLLGGERGLEAYGITGIGIAWRTALAFLAGALCSGISGVIGMYISVKSNLRCAAAAAKGGLSEAVTVAIRGGAVSGFLIVALSLLGVAGIYYMYGGNPEVTPHLIIGFGFGASFVALFAQLGGGIYTKAADMGADLVGKVEAGIPEDDPRNAAVIADLVGDNVGDCAGRGADLFESTAAENIGAMILGITLYLATGNAAWVLFPLVVRAFGILASIVGIMFVRGKDNESPMNALNRGYFTAVGLSIIGIFIANQTIGGDLWLFGAGVIGILTSVAMVFITQYYTEFRYKPVQEIANASRTGAATNIVSGTAVGLETAMPTAITIGAALLLSYWMGGQTGIAGGAVFGTAAATMGMLMTCPFILAMDTFGPITDNANGVIEMAGVGGKVRKITDRLDAVGNTTKALTKGYALASAGLAAFLLFEAYLERVAFLRGETEMMAVDLSRIEVFVGGLLAVALVYFFSAVAIKAVGRTASKIIEEVRRQFKADPGILAGTSRPDYARAVDITAAAGLREMIFPGLLPVLSPIVLGVFLKLTGYDSAMAIAGFLMVGTIGGIMMAAYLNNSGGAWDNAKKYIETGEMLEKDGSPVLKHTVTHAATVVGDTVGDPFKDTAGPSIHVLIKLLSTITLVLAPLFI

SEQ ID NO: 13566 - protein, 196 aa, Triticum aestivum
  misc_feature (75)..(75): Xaa can be any naturally occurring amino acid
  misc_feature (109)..(109): Xaa can be any naturally occurring amino acid
  misc_feature (113)..(113): Xaa can be any naturally occurring amino acid
MADELDELIEFLSNGSPQVRGAAADIVRGLTGDSDGLRSLAVRADRALPALLRLLASEGAGCADEAEADSLVKLXQDGDLAARLVVLGAVAARMDEMSSAGGEQPKFAXSLVXLLGNPTKAEAANPAPPPGWRGKGARCAFFKKLGPSIRPTFRGPSKKAKYFGPLPHTLGKNSQGPKLGREKMCWEPQARLLQNQ

SEQ ID NO: 13567 - protein, 382 aa, Pseudomonas syringae pv. tomato str. DC3000
MIDSKLPNVGTTIFTVMSQLAAETGAINLSQGFPDFDGPQALRDAVCRHITQGHNQYSPMTGLPALRQQVAAKIARSYGREINPDSEITITPGATQAIFCAIHSVIRPGDEVIIFDPCYDSYEPAVELAGGRCVHVQLGLDDFSIDWQKLSDALSPRTRMIVINSPHNPSGALISRAELDRLASLIADRDIYLLSDEVYEHLVFDGARHVSVLDHDELYQRAFVVSSFGKTYHVTGWKTGYVVAPPALTAELRKVHQYVSFCGVTPLQYALADFMAEHPEHIDELPGFYQAKRDYFCNQLAGSRFSFKPVGGTYFQLVDYSQIRPDLNDVDMALWMTREHGVASIPISVFYQSPPPGQRLIRLCFAKQEDTLRLAAEKLCAI

SEQ ID NO: 13568 - protein, 425 aa, Medicago truncatula
MGHDTDDEWIAYEDNMVQPSQLRPKRNKTHPKYLKDYDVSIKEKKTIIFIVVPIIILVMLFSIGYFLIKRWRRKSRKTILRENFGEESATLEPLQFDWMVIEAATNNFSKDNYLGKGGFGEVYKGILSDGREVAIKRLSRSSKQGVEEFKNEILLIAKLQHRNLVTFIGFCLEGHEKILIYEYVSNKSLDYFLFDSQQQKLLTWVERFNIIGGIAGGILYLHEHSRLKVIHRDLKPSNILLDENMIPRISDFGLARMVEISQDEGSTNRIVGTYGYMSPEYAMFGQFSEKSDVYSFGVMILEIVAGKKNISSYEPQHVANSLLNSVWRQWMDKTPLNILDPNIKGDYSKTEVIKCIQIGLLCVQNDPEARPSILTIASYLSSHSIELPTPQQPAFFLQGRNYNEYANSSALFSSNGMPSTTFFPR

SEQ ID NO: 13569 - protein, 266 aa, Triticum aestivum
  misc_feature (100)..(100): Xaa can be any naturally occurring amino acid
  misc_feature (109)..(109): Xaa can be any naturally occurring amino acid
  misc_feature (221)..(221): Xaa can be any naturally occurring amino acid
  misc_feature (231)..(231): Xaa can be any naturally occurring amino acid
  misc_feature (239)..(239): Xaa can be any naturally occurring amino acid
  misc_feature (256)..(256): Xaa can be any naturally occurring amino acid
  misc_feature (258)..(261): Xaa can be any naturally occurring amino acid
  misc_feature (263)..(264): Xaa can be any naturally occurring amino acid
MEEEPTEAPLYIHIETNVFSYRRHKRQKEEDIAVCECQYDLMDPDSACGERCWNVSTNTECTPGYCRCGVYCKNQRFQKSQYARTRLVKTEGRGWGLLAXENITAGQFXVIEYCGEVISWKEAKRRSQAYEDQGLTESYIIYLNADESIDATKKGSLARFINHSCQPNCETRKWTVLGEVRVGIFAKQDIPIGTELSYDYNFEWFGGVMVRCLCGATGCSXFLGAKSRGFXEATYLWEXDDDRFSVENIPLYDSTXDXXXXIXXDT

SEQ ID NO: 13570 - protein, 299 aa, Silicibacter sp. TM1040
MKTTNWSVPMFKGSMPALVTPFRNGELDLDTLKHLVEWHIAEGSTGLVPVGTTGESPTLTHEEHELVIKVVVETAAGRVPVIAGAGSNNTVEAIRFVEYAHRVGADAALVVTPYYNKPTQRGMIAHFSALHDCADIPIIIYNIPPRSVVDMSPATMGELAKLPRIIGVKDATGKLERVSQQRASCGADFIQLSGEDATALGFNAHGGVGCISVTANVAPKLCAEFQAATLAGDYKKALDYQDRLMPLHEAIFIEPGLVGAKYGMSKLGLCTEEVRSPLTGLEDSTKAKIDAAMAHAGLL

SEQ ID NO: 13571 - protein, 216 aa, Rhodopseudomonas palustris CGA009
MTQTYPEPPYPSQRQSMPGSTDKMTPRPDHGEHSYKGSGKLTGKVAIITGGDSGIGRAVAIAYAREGADLLIAYLSEDEDAQQVKELVEAEGRKAVLVAGDIAQPDHCRKVVDHAVEEFGRIDLLVNNAAHQAAFKDIGDISDEEWQTTFAVNIHAMFYLTKAAVPHMKPGSAIINTASVNSDMPNPMLLAYATTKGAIQNFTRLGADARQQGHPR

SEQ ID NO: 13572 - protein, 300 aa, Geobacter sulfurreducens PCA
MNPALVALGLTLFAGMATGIGSAIAFFARRTNFRFLSVATGFSAGVMVYVSFVEILPKGLDSLVRSCGESWGHWLNAASFFGGMLCIGLIDAVIPAAKNPHEIHADHEIAPLHDRSAPLPDFGSLAADPRCAPTGTHDHRPPQRHLLRMGLFTALAITIHNFPEGMATFLAALESPRVGAAIAVAIALHNIPEGVSVSVPIFYATGNRRKAFALSLLSGMAEPVGAAIGYLALLLFSGGASGAIPDQVTGALFGGVAGIMVYISLDELLPASRAYGKGHDSLLGLVGGMAVMALSLLLMK

SEQ ID NO: 13573 - protein, 389 aa, Rhodopseudomonas palustris CGA009
MKALTWHGKNDIRCENVPDPKIQHGRDAIIKVTACAICGSDLHLMDGVMPSMQSGDVLGHETMGEVVEVGSENTKLKVGDRVVVPFTISCGECFFCQRGFYSGCERSNPNAKMAEKMWGHSPAGLFGYSHMLGGYAGGQAEYLRIPYADVGPIKVPDGLTDEQVLFLSDIFPTGFMAADFCNLKGGETVAVWGCGPVGQMAIKSAFLLGAERVIAIDTVPERMELARQSGAIVINFMDDDVYDKIQDLTNGRGADACIDAVGTEAAATASLDSMIDRVKVATFMGTDRPHVLRQAIHCCRNFGTVSIVGVYGGLLDKIPMGSAINRGLTMRMAQTPVQQYLPQLLGRIQQGEIDPSFVITHRATLDEGPELYKTFRDKKDGCIKVVMRP

SEQ ID NO: 13574 - protein, 323 aa, Oryza sativa (indica cultivar-group)
MGISHPLSDDFDASPVLSPPPPPSSCCPPAHDDHYLEHQISDIKRANSLMTDSQMFAHKILLIPLPGRPMPSSVRLNGSGQKMKRAWAPNNQQNRDVTDSLDSSKYNSSKQQMSLAMSTLQSYYGLTPQNGAMTDAGTEMSLYSKGSLERINSETLVTSSRLPDTHNTDRSRNSEDTSNGFSATNGASGAKINGTAKAKQDGSIRRRQKVEADQVSNTTDTQDDVFTDPIKMTKSLLPRPISSIRQNMDTSNPESSLKSNGSFLSGFRSVRKSPSTPNFADAENGISMWSSSAWTFNHESFTRPLLDGLPKPTAPRRTKAALD

SEQ ID NO: 13575 - protein, 889 aa, Aspergillus nidulans FGSC A4
MADEPRRSGRSTKGQHKSLDMVNETPTKKTKAKAQPRDKPPKPSAEPTPAPSEEEEIIRCICGEYEEEEDIERDMICCDQCSAWQHNDCMGLTFAKGEVPDQYFCEQCKPEDHPVLMDKIARGEKPWLEVAERRRKEAEELKQARRKKGRRGGKRGRPSEPKEPKPEKSTPSRTPAPRASGTPAAEPPAPVIATPAPEKNSHSPEKPPSSSQKRKLSEQEVSTPESGPKTKQAKISPPAASPAPHVNQSPEDKEPVGQDTNQTPAADTTKTERLKTLEDITNPARRNAASALTKVFVDQISSALAGGSFKMSEGKTGEEVGQQLGISVEEALYQNLMGGGGEATSEAYKIQLRAILFNVKKNPSLRDRLLVGSLTPDALSRMSSQEMASEELQQKDAEIKREAERQHMIIQEQGPRIRRTHKGEELVEDDQTNVSTEPVFSNIPRRVTETDGSPAAQSPTSPSAKQPETDGHKVKTDATPAEPTPHDEHFPTRSHSPGAGQDQVFPEVATHISQPIPTGNVQADAEIDQLLKDDDEPESPPYSPKDHHDEGAVWHGRVVMNPVAEFSSFAKHVAGADLSGRIPWNDLIPSTLLIDGRIKIQSAGEYLCGLRFSQSTDVSVVAISSPDSSKDKSNFDKLFDYFQGRERYGVMGKHPLEAVRDTYLIPIEAGSTKKPEFIELLENNALEDPTPERLFLVVFAVKTGESNPPSVQPPSLHASMEPAASASPLTVTSGTPQQPFATPGPRHLLQYPQTPSPAFPGASHATAPYSQPQPQPQIQHQQPPPKATQYNSSLQPQLPTEPTGLPAAIQVLGGHANTPAIQELLQKAPTITVTQLNVVRDILVRRPQAAADYTTLMDELLGESTTRTNGSGTGSGNGHPPPQQQQPAQ

SEQ ID NO: 13576 - protein, 431 aa, Dehalococcoides sp. CBDB1
MTQLKQARKGIVTPEMEAVAKTEGLQPEFILKGIADGNIVIPANKLRKNLKLCGIGKGLSTKVNANIGTSTDFGSVASEVEKLKMAEMVGADTIMDLSTGPKINTIRKAILENTCLPLGTVPVYQAAVEAKDHYGAMVKMTADDLFGAIESQAKEGVDFVTVHCGVTRQVIDTFKGQGRLTDIVSRGGTFTAGWMVFHGAENPLYEHFDRLLDICREYDVTLSLGDGLRPGCIADATDRAQVAELLVLGELVKRAREAEVQVMVEGPGHVPLNQIEANVRLQKSICEDAPFYVLGPLVTDIAPGYDHITGAIGGAIAAAAGADFLCYVTPAEHLSLPDVTDVRNGVIASRIAAHAADIVKGVNGAAERDHQMAIARKKLDWETQLKLSLDPEHARVTRDRFKTRGKACSMCGDFCAMELAEKHLGVSVSRC

SEQ ID NO: 13577 - protein, 610 aa, Leifsonia xyli subsp. xyli str. CTCB07
MTSLGAELRQTIEADPTRIAVVGGGMAGLVAARECARPGFEVIVLEAADRIGGSVAPLELDGMTLDAGAESFATRGGHVAELLDELGLAGDVVSPNPAGAWVRTGTKSVPLPKAGLLGIPSSPLASDVVAAIGWGGALRAYLDRLLPVLKIGQERRLGTLVRKRMGAKALHELVAPVVTGVYSAAPDDLDIEVVAPGLNAALTRLGSLSGAVGELWSQAKAGSAVQGLRGGMWRLPAALAADFRARGGSVRTAAAVTAIEPWAASETHAPAGVAHPESDGGRRPARWTLRLADGTAIDTDAVVMAAPAHAALALLPTASPSLAGLAGLDWPPASSVELVTLVLTTPAAAEAPRGTGVLVADAPGSGVTAKALTHASAKWAWVAEAAGDGCHVVRLSYGRAGQPGTRELGDQRLREIALADASALLNIPLAVSDVAAFARILWTNALPYATVGQRERIQRVRDGVGSVEGLEVTGSWLTGTGLASVVPDARQAAERARGSTLESTDRGHGGVRMRGKILFVAGAAVGYVLGARAGRKRYDQLKAAAARVWESPSVQKRVHAVEDFMAEKACEAPEAVFVAIKKAVVRVNERRREARSPIPEPETAGDGSAS

SEQ ID NO: 13578 - protein, 509 aa, Dehalococcoides sp. CBDB1
MPELLTDDLNALLEVLPPHIRQPLTDPANRKNLIEIVMDLGRTPEARFPDREIILSERDVTQEDIDYVSSRTGDFGDDNRAGIERTLHRISAIRNRKDKIVGLTLRVGRAVFGTIKIIQDLIKSDQSVLMLGRPGVGKTTMLREVARVLAGDLKKRVVIVDTSNEIAGDGDIPHPAIGHARRMQVRTPDMQHAVMIEAVENHMPQVIVIDEIGTELEALAARTIAERGVQLVGTAHGNVLDNLMLNPTLSDLIGGIQSVTLGDEEARRRGTQKTILERRAPPTFQVIVEIQDRNKVAVHPDVGAAVDSILRGVSPSAEIRYLDGNGEVVISKQQPSEEKVKSAPESLTVFRGKELPIMYLFGVNRSRMEEIAREMHLDIQISERLEQAQLMVTSRNYYRSKPQRVRDAENMNIPIYVLKSHTPGQFKQLLATLSGRDVAYAVEKPPEIDVAIHEAEEAVAQVKTSHIPVELSPQGAYIRRFQHIIAEKEHLSSHSLGREPHRRVRISRG

SEQ ID NO: 13579 - protein, 463 aa, Streptococcus pyogenes MGAS315
MTIFRKKKKYSNKTEMQRHFKVIDLIFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWFHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 13580 - protein, 525 aa, Pseudomonas syringae pv. tomato str. DC3000
MALDIHAHRILILDFGSQYTQLIARRVREIGVYCELHPFDMDDEAIREFAPKGVILAGGPESVHEANSPRCPQAVFDLGVPVFGICYGMQTMAEQLGGKVAGSELREFGYARVDVVGKSRLLDGIEDHIDADGLFGLDVWMSHGDKVTKLPEDFHILASTPSCPIAGMADDARGYYGVQFHPEVTHTKQGGRILSRFILDICGCEALWTPSKIAEDAIAQVRAQVGTDSVLLGLSGGVDSSVVAALLHKAIGDQLTCVFVDNGLLRLHEGEQVMAMFAENMGVKVIRANAEEQFLNNLEGESDPEKKRKIIGRTFIDVFDAESCKLDNIKYLAQGTIYPDVIESAGAKSGKAHVIKSHHNVGGLPEEMNLKLVEPLRELFKDEVRRLGLELGLPYDMVYRHPFPGPGLGVRILGEVKKEYADILRRADHIFIEELRKADWYHKVSQAFVVFQPVKSVGVVGDGRRYAWVVALRAVETIDFMTARWAHLPYELLETVSGRIINEIEGISRVTYDVSSKPPATIEWE

SEQ ID NO: 13581 - protein, 302 aa, Capsella rubella
MADDWDLHAVVRGCSAVSSSATTSTTTVFSGGVSSHTNPTFTVGRQSNAVSFGEIRDLYTPFTQESVVSSFSCLNYPEEPRKTKNQKRPLSLSASSGSVTSKPTGSTTSRSKRRKIQHKKVCHVAAEALNSDVWAWRKYGQKPIKGSPYPRGYYRCSTSKGCLARKQVERNRSDPKMFIVTYTAEHNHPAPTHRNSLAGSTRQKPSDQPMTTKSPTTTIATYSSSPVTSADEFVLPVEDLAVGEGLDGDEDLLSLSDTVVSDDFFDGLEEFAAGDSFSGNSAPACFDLSWVVNSAATTTGGI

SEQ ID NO: 13582 - protein, 187 aa, Capsella rubella
QPRDGVTAGYTCRVILPERHKSIIRPEAMNARLINVVHHFHLRDEFTFADVDKDVMVINHYKYQVWEVFKEKFYRRVATYVADWQNEENVGSRDRAPGLGTRPVEPPDWSERFCELNDTGLRDRVFQMFKNSKTQRLIWDKTDDAERMVNESPSRVTTHRSGDGSKEASIMREKNGENAEIFISPRS

SEQ ID NO: 13583 - protein, 414 aa, Glycine max
SRAESARDSQHQHSVTSISSTTDNNFGNPLAMTAVVVVPLGLLFFASGLIVNLIQAICYVVVRPVSKNLYRRMNRVVAELLWLELVWIIDWWAGVKVQVFTDPETFRSMGKEHALVISNHRSDIDWLVGWVLAQRSGCLGSTLAVMKKSSKFLPVIGWSMWFSEYLFLERSWAKDERTLKSGLQQLRDFPLPFWLALFVEGTRFTQAKLLAAQEYAASAGLPVPRNVLIPRTKGFVSAVNHMRSFVPAIYDVTVAIPKSSPAPTMLRLFRGKSSVVHVHIKRHAMKDLPEEDEAVAQWCRDMFVAKDTLLDKHIAEDTFSDQELQDTGRPIKSLVVVISWACVVVMGVVKFLQWSSLLSSWKGVAFSAFGLGVVTLLMHILIMFSQSERSTPTKVAPAKSKNSEQLEARDNKQD

SEQ ID NO: 13584 - protein, 868 aa, Physcomitrella patens
MTSIVYNDGFASTGKELDGPTSVSGGEVWRLCKAGRLREAIQLLGIIKQRGLLVNSNTYGCVIEHCAKARRFEDGKMVHKQLDELGVEIDIYLGNSLINFYSKFEDVASAEQVFRRMTLRDVVTWSSMIAAYAGNNHPAKAFDTFERMTDANIEPNRITFLSILKACNNYSILEKGRKIHTIVKAMGMETDVAVATALITMYSKCGEISVACEVFHKMTERNVVSWTAIIQANAQHRKLNEAFELYEQMLQAGISPNAVTFVSLLNSCNTPEALNRGRRIHSHISERGLETDMIVANALITMYCKCNSVQEAREIFDRMSKRDVISWSAMIAGYAQSGYKDKESIDEVFQLLERMRREGVFPNKVTFMSILRACTAHGALEQGRQIHAELSKVGFELDRSLQTAIFNMYAKCGSIYEAEQVFSKMANKNVVAWTSFLSMYIKCGDLSSAEKVFSEMPTRNVVSWNLMIAGYAQNGDIVKVFELLSSMKAEGFQPDRVTVITILEACGALAGLERGKLVHAEAVKLGLESDTVVATSLIGMYSKCGQVAEARTVFDKMSNRDTVAWNAMLAGYGQHGDGLEAVDLFKRMLKERVSPNEITLTAVISACSRAGLVQEGREIFRMMQEDFKMTPRKQHYGCMVDLLGRAGRLQEAEEFIQSMPCEPDISVWHALLGACKSHNNVQLAERAAHHILELEPSYASVYITLSNIYAQAGRWDDSTKVRRVMDDRGLKKDRGESSIEIDGRIHTFVAEDCAHPEIDAIHAELETLTKEMKEAGYTPDMRFVLHDVDDVQKEKALCHHSEKLAIAYGLLKTPSGTPIRIMKNLRVCGDCHTATKFISKIRKREIVARDANRFHYFNNGTCSCGDFW

SEQ ID NO: 13585 - protein, 486 aa, Oryza sativa (indica cultivar-group)
MASYDKAIESYKRAVTTAASLAASAMLVRGVVNELVPYEVRDLLFSGVGYLRSRMSSQHTVIIEETEGWTNNQLYDAVRTYLATRINTDMQRLRVSRVDETKSMMFSMEEGEEMADVHEGSEFRWRLVCRDNSSSSNGNGNGRGGNGNYRLEVRSFEMSFHKKHKDKALNSYLPHILATAKKIKDQDRTLKIYMNEGESWFAIDLHHPSTFTTLAMDHKQKQSVMDDLERFIKRKEYYKKIGKAWKRGYLLYGPPGTGKSSLIAAMANYLKFDVYDLELTEVNWNSTLRRLLIGMTNRSILVIEDIDCTLELQQREEGQESSKSNPSEDKVTLSGLLNFVDGLWSTSGEERIIVFTTNYKERLDPALLRPGRMDMHVHMGYCCPESFRILASNYHSIDNHATYPEIEELIKEVMVTPAEVAEVLMRNDDTDVALEGLIQFLKRKKDVGKEGKAENVEQVVKAEETEKGMMKKNDVPENQDPQDASK

SEQ ID NO: 13586 - protein, 343 aa, Bartonella henselae str. Houston-1
MNERLEDIALTLVGAGKGILAADESTATIGKRFESIGVECTEDNRRAYREMLFTAKEAMESAISGVILFDETLRQKASTGQMLTDLIRDAGAVPGIKVDTGAKPLAAFPQETITEGLDGLRERLKDYYTLGARFAKWRAVIAIDAQTLPTRGAISQNAQALARYAALCQEAGLVPIVEPEVLMDGPSRQHSITRCFEVTKVVLHTVFKELFEARVLFEGMILKPNMVIDGKDARIASVEEVAEKTVHVLKQTVPAAVPGIAFLSGGQTDEEATAHLSAMNALGALPWKLTFSYGRALQAAALKAWAGKNENIVVAQKAFCHRARMNHLAALGQWTKDQEKSCA

SEQ ID NO: 13587 - protein, 397 aa, Bartonella henselae str. Houston-1
MGFRTLDDVDVTGKRVLVRVDFNVPMAQGKVCDDTRLKRHKETLLELQKRGAKLILLSHCGRPKGQVEPEFSLHPVVQVLEKIINQPVNFASDCIGVAVQTAVEALQNGGILLLENVRFHSGEEKNAGSFAEALAHNGDLYVNDAFSVSHRAHASVEGITHFLPSYAGRSLQCELQALEKGLGKPERPVIAIVGGAKVSSKLFVLNHLVKKVDYLVIGGGMANSFLAAQGVCVGKSLCEHALIETVKKVIEKARECQCTLLLPVDAIVGFRFEKDAPHRLYDIGDIPEDGMILDVGTRSIAHINAVIDKAATLVWNGPLGVFEMSPFDQGTIAVARHAAELSLTGKLVSIAGGGDTVFALNHAGVADDFTYLSTAGGAFLEWMEGKMLPGILALTQA

SEQ ID NO: 13588 - protein, 450 aa, Bordetella bronchiseptica RB50
MAFDFDLYVIGAGSGGVRAARFAAGYGARVAVAESRYLGGTCVNVGCVPKKLLVYGAHFHEDFEQAAGFGWNPGRPEFDWPTLIANKNREIERLNGIYRNLLVNSGVALHEGHARIVDPHTVEINGQRHSAQHILVATGGWPFVPDIPGKEHAITSNDAFFLPELPRRVLVVGGGYIAVEFASIFNGLGAQTVQVYRRELFLRGFDGSVREHLRDELVKKGLDLRFNTDVERIDKRADGVLAVTLSDGSVLETDCVFYATGRRAMLDDLGLENTGVRLAESGYIEVDDEYRTSEPSILAIGDVIGRVPLTPVALAEGMAVARRLFRPQEYRKVDYDLIPTAVFSLPNIGTVGLTTEQALERGFRVTRYESRFRPMKLTLTQSQEKTLMKLVVDADSQKVLGCHMVGPDAGEIVQGLAVALKAGATKQVFDDTIGIHPTAAEEFVTMRTAT

SEQ ID NO: 13589 - protein, 335 aa, Bartonella henselae str. Houston-1
MSVRVAINGFGRIGRNILRAIIESGRQDIEVVALNDLGSVETNAHLLRYDSVHGCFPGTVQVVGDAIDIGSSLIKVFAERDPAQLPWKALDIDIALECTGIFTARDKASAHLDAGAKRVLVSAPSEGADLTVVYGVNHQFLSKEHHVISNASCTTNCLAPVAQVLHNTVGIEKGFMTTIHSYTGDQPVLDTMHRDLYRARAAALSMIPTSTGAAKAVGLVLPELKGLLDGVSIRVPTPNVSVVDLTFTAKRSTTIEEINTAIRTAAQGSLKGILDYTDEKLVSCDFNHNPHSAIFHNDQTKVIDGQLCRVLVWYDNEWGFSNRMCDTAVAFAKTI

SEQ ID NO: 13590 - protein, 140 aa, Bradyrhizobium japonicum USDA 110
MAIERTFSIIKPDATARNLTGAVNAVIEKAGLRIVAQKRIRMTKEQAETFYAVHKARPFFGELVEFMTSGPVVVQVLEGENAVAKYRDAMGATDPSKAAEGTIRKLYAKSIGENSAHGSDAPETAAIEIAQFFSGNEIVG

SEQ ID NO: 13591 - protein, 232 aa, Nicotiana tabacum
MGYWQAKVVPKIKQIFDKNGPKKAAAAEACKTFDEAKALYSKEFEDKKTELQPKVVEIYEAAAVEIKTLVKEPKVSGLKKHSTEVQKLLDELVKIEFPGSKAVSEASSNFGPSYVCGPVLFVFEKVSTFIVTENKKVEEAAVPVAASSSEEEAAASVAAASEAEAIAAAPVEVKKKEIVVEAEAKKEEEPAPAPAAEVAPAPAAEVAPAADVAPAKVEERAPAAAAPEPPKA

SEQ ID NO: 13592 - protein, 668 aa, Bartonella henselae str. Houston-1
MTNTETKKQMANAIRFLAIDAIEKANSGHPGLPMGAADIATVLYTKFLAHDPKNPHWPNRDRFVLSAGHGSMLLYALLYLSGYEDISLEDLKNFRQIGSKVAGHPEYGHAAGIETTTGPLGQGIANAVGMALGERLLNARFGDLINHYTYALVGDGCLMEGISQEALSLAGHLKLNKLIVLWDDNNISIDGEISLADSTDQIARFKASGWNTHKVDGHDQAAIARAIEAARNSDKPTLIACKTTIGFGAPNKAGTNKIHGAPLGASEIAETRIALGWEAEPFVIPADILDNWRLAGLNAAKKRQKWKEKFAALPLSERIEFERLMRGDLVGGFDGAIDVYKKKLVEDCPCVATRKASEMALEVINEVVLETIGGSADLTGSNNTKSSQMKTISAEDFSGRYLHYGVREHAMGAVMNGLALYGGFIPYGGTFLCFSDYMRPAMRLSSLMGLRVIYVMTHDSIGLGEDGPTHQPVEHLASLRTLPNHLVFRPADAMETVECWQLALKTRGTPSTLALSRQNLPLLRREYEEENLCMLGAYELLTASDDAQVTLFASGSELQIAVHAHAVLEEKGIPTRVVSVPCFELFTQQSPSYQRALIGDAPIKIAIEAALRQGWDYFIGTNGVFIGMQGFGASGTIDALYAHFGITCENVVAAVEKKLEDIHKENVK

SEQ ID NO: 13593 - protein, 342 aa, Pichia anomala
MIKTYQYRSILNSRNVGIRFLKTLSPSPHSKDPNSKSIFDIGTKLIVNPPPQMADNQYVTHPLFPHPKYSDEDCEAVHFVHREPKTIGDKIADRGVKFCRASFDFVTGYKKPKDVNGMLKSWEGTRYEMTEEKWLTRCIFLESVAGVPGMVAAFIRHLHSLRLLKRDKAWIETLLDEAYNERMHLLTFIKIGNPSWFTRFIIYMGQGVFANLFFLVYLIKPRYCHRFVGYLEEEAVSTYTHLIKDIDSKRLPKFDDVNLPEISWLYWTDLNEKSTFRDLIQRIRADESKHREVNHTLANLEQKKDRNPFALKVEDVPKEQQPDEYSLKTPHPEGWNREQMRL

SEQ ID NO: 13594 - protein, 288 aa, Bacillus cereus G9241
MPQQKNFVTMPAQHQNKQPGIESLMNPLPQFEDPNYKGSEKLKGKNVLITGGDSGIGRAVSIAFAKEGANIAIAYLDEDGDANETKQRVEQEGVKCVLLPGDLSNEQHCKDIVEETVKQLGSVNVLVNNVAQQYPQQGLEYITAEQLEKTFRINIFSYFHVAKAALSHLKQGDVIINTASIVAYEGNETLIDYSATKGAIVAFTRSLSQSLVQKGIRVNGVAPGPIWTPLIPSSFDEKKVSQFGSNVPMQRPGQPYELAPAYVYLASGDSSYVTGQMIHVNGGVIVNG

SEQ ID NO: 13595 - protein, 362 aa, Neurospora crassa
MNTPKVNILHAPGQAAQLSRALISTCHTRPLLLAGSRVATSLHPTQTNLSSPSPRNFSTTSVTRLKDFFPAKETAYIRQTPPAWPHHGWTEEEMTSVVPEHRKPETVGDWLAWKLVRICRWATDIATGIRPEQQVDKHHPTTATSADKPLTEAQWLVRFIFLESIAGVPGMVAGMLRHLHSLRRLKRDNGWIETLLEESYNERMHLLTFMKMCEPGLLMKTLILGAQGVFFNAMFLSYLISPKITHRFVGYLEEEAVHTYTRCIREIEEGHLPKWSDEKFEIPEMAVRYWRMPEGKRTMKDLIHYIRADEAVHRGVNHTLSNLDQKEDPNPFVSDYKEGEGGRRPVNPALKPTGFERAEVIG

SEQ ID NO: 13596 - protein, 179 aa, Nicotiana langsdorffii x Nicotiana sanderae
ISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRFLAAKGSVPIGIGKNSHIKRAIIDKNARIGDNVK

SEQ ID NO: 13597 - protein, 215 aa, Nicotiana tabacum
MGYWQAKVVPKFKQIFDKNGPKKAAAAEACKTFDEAKEQYSKEFEEKKTELQPKVVEIYEAAAVEIKTLVKGPKVSGLKKHSTQVQKFLDELVKIEFPGSKAVSEASSNFGPSYVSGPVLFVFEKVSTFIVTEDKKEEEAAASEAEATTAAPVEVKEKEIVVEAEAKKEEEPAPAPAATPAAEVAPAEVAPAADVAPAKVEEAPAAVAAPEPPKA

SEQ ID NO: 13598 - protein, 389 aa, Rickettsia prowazekii str. Madrid E
MTNKTITLNLGPQHPATHGVLRLILEMDGEVVNNADPHIGLLHRGTEKLIEHKTYLQAIPYFDRLDYVSPMCQEHAFALAVESLLECSVPRRAQFIRVLFSELTRILNHTLNIGSQALDIGATTPLLWLFEEREKIMEFYERVSGSRMHSNYFRPGGVAEDLPENLLEDINKFIEQFPSKLNDIENLLNENRLWKQRLVDIGVVSQKDAMDWGFSGPMLRGSGIAWDLRKSNPYDVYDEMDFEVPIGKNGDCYDRYLVRILEMYESIKIIKQCIVKMPKGQVKTDDPKLTPPTRGKMKESMEAMIHHFKLYTEGYDVPIGETYKAVEAPKGEFGVYLYSQGGNKPYRCRIKAPGFAHLQGLNFMSKGHLIADVITIIATLDIVFGEIDR

SEQ ID NO: 13599 - protein, 465 aa, Methylococcus capsulatus str. Bath
MRIFRTKAVSTDDCSGGSLKRCLGALDLTLLGIGAIIGTGIFVLTGIAAATQAGPAVVLSFVFAGLACAFAALAYAELAACVGGCGSAYGYSYAAFGELIAWIIGWDLILEYAISVAAVANGWSGYFANALTAVGLELPDYLTKAPEKGGIINLPASAIIILLMALLIAGVKESARLNTVMVSVKVLAIAVFVAVASAHVDPAHWDPFLPFGWFGHDAEGRPTGVLAGASIVFFAYVGFDAVSTAAEEARNPMRDVPIGIIGSLVFCTLIYIVVAGLLTGVVPYTELNVSSPVAHALQLLGIRWASGLVATGVIAGLTTVMLVLYYALTRIIFAMSRDGLLSPWFSAVNTRTQTPVRVIVLCGLFISLVAGFVPLGELAELVNIGTLFAFVLVCLGVIVLRVTRPELHRPFKTPVVPWFPILGALSCGALMAFLPALTWLRFVVWLLLGIGIYFAYSYRHSRLAD

SEQ ID NO: 13600 - protein, 447 aa, Leifsonia xyli subsp. xyli str. CTCB07
MAAAAIGEANLAQFGRAQRVIPGGVNSPVRAFRSVGGTPRFMVFANGPYIVDAEGREYVDLVASWGPAILGHAHPAVVSAVQEAAARGLSFGASTPAETELAEAVIARVPFVEKLRLVSTGTEATMTAIRLARGFTGRPLLIKFAGHYHGHSDSLLAEAGSGLATLSLPGSAGVTEATAAQTLVLPYNDLGAVRAVFEANGPDIAAVIAEAAAANMGVVPPDEGFNAALTDLAHEYGALLILDEVLTGFRVSEAGFWGLDRGYTPDLVAFGKVIGGGMPLAAVGGRAELMDILAPAGPVYQAGTLSGNPVAVAAGLATLAHAGEAVYDRLDIVAGTLSAAVSDALTAEGVAHSVQRAGNLFSFVFGDVAAAPRTFAEVQRQEAFRYRAFFHAMLDAGVSLPPSVFEAWFVTAAHDDAAVGRVLEALPAAARAAASACPGRPLLFVRR

SEQ ID NO: 13601 - protein, 302 aa, Oryza sativa (japonica cultivar-group)
MASFRLMIAAVSLSLVQLSMGSRRLMELYIPPASDQLTYHHGSVLSGDIPVSILWYGKFTPTQMSIIADFVVSLTGAPNAATPSVGQWWGTIEQLYLSNAATNSQTSTRVLLDEQVSDEQCSLGKSLTLAQIDQLAARVGTKRGGVALVFTDEDVTVEGFCSSRCGKHGSDASAGTTHIWVGNSAKQCPGQCAWPFAQPVYGPQGTPLVAPNNDVGADGMVMILASMVAGTVTNPYGDGFYQGPQDAPLEACSACPGVYGSGAYPGNAGKLLVDATTGASYNANGANRRKYNPATSSCDTLV

SEQ ID NO: 13602 - protein, 268 aa, Israeli tick typhus rickettsia
AIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKALGQLDNNPLLQIAIELEAIALKDEYFIERKLYPNVDFYSGIIYKAMGIPSQMFTVLFVIARIVGWMAQWKEM

SEQ ID NO: 13603 - protein, 316 aa, Oryza sativa (japonica cultivar-group)
MSHAAIVLVSVLLLCSAHPSAGARRLMELYKPPPSEQLTYHNGTVLRGDIPVSVVWYGRFTPAQKAVVSDFLLLLTVASPAPTPSVSQWWNTINQLYLSKAAAQGKNGGGGGKITTQVRLAGQLTDDQCSLGKSLKLSQLPALAARAKPKKGGIALVLTAQDVSVEGFCMSRCGTHASNAKARTAYVWVGNSATQCPGQCAWPFHQPVYGPQTPALVPPSGDVGMDGMVMNIASMVAGVVTNPFGDGFYQGPKEAPLEAATACPGVYGSGAYPGYAGNLAVDPATGASYNANGAHGRKYLLPALFDPATSTCSTLV

SEQ ID NO: 13604 - protein, 207 aa, Zea mays
YIGTHNFHNFTTRTKAEDPAAKRFIISFAADRVVSLDGIDFVRCEVVGQSFMLHQIRKMIGLAVAVMRNCAPESIYDVAFRKDVNLNVPTAPEVGLYLDECMFTSYNKKWKDSHEAVFMEPYSEEAEEFKVKYIFTHIAAMEHKEGAVALWLHSLNHRNYPDFRYMETAEHNAGAEVESIAAGAEPKVGAEVENTEEVQMPSDNLSE

SEQ ID NO: 13605 - protein, 503 aa, Nostoc punctiforme PCC 73102
MNIRKVSTTPLSDQKPGTSGLRKSVKVFQQPHYLENFIQSIFDSVGDLHSQTLVLGGDGRYYNRQAIQIILKMAAANGIGRIKVGQRGILSTPATSAIIRKYQAIGGIILSASHNPGGPNGDFGVKYNISNGGPAPEKVTEAIYDRSKVIDSYQILEAPDVDLETLGESHLGETVVEVIDSVQDYQELMESLFDFERIQQLLTRGNFRFSIDALHAVAGPYAHAIFEQRLGAPVGTVQNGTPLEDFGGGHPDPNLVYAHDLVDILYGENAPDFGAAFDGDGDRNMILGRKFFVTPSDSLAVLAANAKLVPGYSEGLAGVARSMPTSQAVDRVAAQIGIESYETPTGWKFFGNLLDAGKATLCGEESFGTGSNHIREKDGLWAVLFWLNILAVRQQSVEQIVREHWQTYGRNYYSRHDYEEIQTEQGNTLIERLRSLLPNLKGKQFGNYQVEYSDDFSYTDPVDGSISEQQGVRIGFTDGSRIVVRLSGTGTQGATLRHHVKIT

SEQ ID NO: 13606 - protein, 213 aa, Arabidopsis thaliana
MGLKAGTFVLLLLGLILVSDARSFVDSTISEKVSNKEDVCTLCEEYVTDALSYLEKNVTQAEIIEDLHDRCSQLRGYSQQCISLVDYYVPLFFLQLESFQPHYFCKRMNLCGKVVALVEEARQDSCGVCHRTVSEILIKLQDPDTQLDIVELLIKGCKSLKNYEKKCKTLVFEYGPLILVNAEEFLVKNDVCTLLRACPPEKSVLRQPELADS

SEQ ID NO: 13607 - protein, 254 aa, Rhodopseudomonas palustris CGA009
MNSIATSPNRSGLRFLVFQHVDVEHPGIFREFWREAGIVWDAVELDAGEPIPALEPYDALIVMGGPQDVWQEDEHPWLMPEKAAIRRFVQQLGRPYLGICLGHQLLAAALGGEVRLGNSPEVGPGEVELTAAGAADPLFAGLSSPLQTFQWHGAEVAALPAGAEVLARNEACAVQAFRFGFAAYGLQYHVEITDRTVPEWQQIPAYAASLETALGCERAAKLADETAGLLPGFAQAARRLNDNFLQIVTRAIAR

SEQ ID NO: 13608 - protein, 550 aa, Geobacter sulfurreducens PCA
MTDTLIPRTPSAYDYPLLIKSLLRNPVVDNPDQEIVYRGVIRHTYRDLRERVRRLANVLTGLGVKAGDTVAVMDWDSHRYLELFFAVPMIGAVLHTINVRLSPEQILYTIDHAEDDLLLVNSEFLPILEQIRGRIDTVRGYVLLTDEEKMPESHIPFVGEYEALLAAASGEYDFPDFDENTRATTFYTTGTTGLPKGVYFSHRQLVLHTMGVMASLGTVFAHGRLHQGDVYMPITPMFHVHAWGVPYLATMLGIKQVYPGRYSPDLLLDLIEKERVTFTHCVPTILHMLLKHPHAKRVDLAGLKMIIGGAAMSRALCCEALERGIDVFTGYGMSETCPILTFSRLTPEMLAGSPAEQAEVRCLTGLSLPFVDLRVVDPETGAEQPRDGRSAGEIVVRAPWLTQGYLKDHRTSEKLWEGGFLHTGDVAVRDERGYVRITDRTKDVIKVAGEWVSSLELEDILAHHPAVAEVAVIGQPDEKWGERPLALVVLKPEEAGRVGEKDLAHFVREYADKGMVSKQVVLLKVRLVDAIDKTSVGKISKVTLREKYLA

SEQ ID NO: 13609 - protein, 266 aa, Methanosarcina mazei Go1
MLTFIGLGLFDEYDISLKGLEAVKEADLVYAEFYTSCLMGTNPEKMEKLYGKKVHLLSREDVEQHPDWLDNARDKKVAFLTGGDTMVSTTHVDLRLRAEKLGIETRLIHGASITSAVSGLTGLQNYRFGKSASIPYPYESRRGTKVISETPYDTIKQNSSFGLHTLVFLDIDKDKGFMSVNIALKLLLEVESKRGEGVMDRAVAVGIARAGSEKPVVKAGYAEDLKGFDFGKPLHILVVPGKLHFLEAEALVKLADGPEEIMENIE

SEQ ID NO: 13610 - protein, 460 aa, Bradyrhizobium japonicum USDA 110
MSMLPNSQEARDVAYQLHPYTNARAHQQAGPLVIERGEGPYVFDASGKRYFEAMAGLWSVGLGFNEKRLVEAAHKQMLALPFYHTFSAKSHGPSIDLAEKLVALAPVPMSKVFFTNSGSEANDTVLKLIAYRSNALGQPQRKKVISRMRAYHGVTIASASLTGLPNNHRSFDLPLPNILHTGSPHFYKDGAPGESEEAFATRRAEELDALIQKEGPDTIAAFFGEPVMGAGGVIVPPATYWDKIQAVLKKYDILLVADEVICGFGRTGKMFGCETYGIKPDAIVVSKQITSSYFPLSAILMNDRMFEPIADESNKIGVLGHGFTAGGHPVGSAIALENLKIIEERGLVAHAAELGGYMQGKLRELAGHPLVGEVRGVGMIAALELVLDKQRKTAAATPGAVGGIASRMLQERGVISRNMLDAIAICPPLIVNKTQIDELVAAISGVLEDMKAEVAKLTPA

SEQ ID NO: 13611 - protein, 446 aa, Methylococcus capsulatus str. Bath
MRNLSRRIQSHQIRLRPPPFGAKRPVRRSESTSPPPRRRLIVGKRNRSAQVQYSMSHGLTHLSFWPLLFATLALTHVTIVSVTIFLHRHQAHRALSLHPLASHFFRFWLWLTTATVTKEWVSIHRKHHARCETPDDPHSPQCLGIFTVLLRGWMLYRKEARNTATLAQFGNGTPDDWLERKLYSRFPDLGITLMLALNLLLFGIGGLGVWAVQMLWIPFWAAGVVNGLGHHLGYRNFETPDASTNLWPIGFIIGGEELHNNHHAYPASAKFSSRRWEIDIGWLYIRLMTLLKLAKIRNMPPKTIIHTAEPSVDMDTVKAVLRNRAHVLSLYGRRVIVPVLRSEQAKSPKAGRRLLRQTRPLLLREYIKADPAAWHNFSRMLEDSQTLATIFQFKQQLKAVWTDSFTSHEERLERLRAWCLQAKQSDLPWLQHFADTLSGYRLQPAH

SEQ ID NO: 13612 - protein, 353 aa, Nicotiana tabacum
MMTRGATRMTRTVLGHMGPRYFSTAIFRNDAGTGVMSGAAVFMHGVPANPSEKAVVTWVRHFPVMGSRSAMSMALNDKQHDKKAENGSAAATGGGDGGDEKSVVSYWGVQPSKVTKEDGTEWKWNCFRPWETYKADLSIDLTKHHAPTTFLDKFAYWTVKSLRYPTDIFFQRRYGCRAMMLETVAAVPGMVGGMLLHCKSLRRFEQSGGWIKTLLDEAENERMHLMTFMEVAKPNWYERALVFAVQGVFFNAYFVTYLLSPKLAHRIVGYLEEEAIHSYTEFLKELDKGNIENVPAPAIAIDYCRLPKDSTLLDVVLVVRADEAHHRDVNHFASDIHYQGQQLKDSPAPIGYH

SEQ ID NO: 13613 - protein, 362 aa, Coprinopsis cinerea okayama7#130
MFRAPIRKLTTAATRQSLKIGLIPADGIGKEVIPAARAAIVALGNDIPKPEFIDLNAGWETFTRTGVALPEETVRVLREECDCALFGSVSSPSRKVTGYSSPIVALRKELDLYANIRPVTSVAPEAGQQPAVDLIVVRENTECLYVKQEQQTIGENGKEARATRLITERASRRIGQMAFELAAARPRKHLTVIHKSNVLSITDGLFRETVRAVPRLPEVNGKYDDVTIMEQLVDSAVYRLFREPEVFDVMVAPNLYGDIISDAAAALVGSLGLIPSVNAGDNFVMGEPVHGSAPDIEGKGIANPIASIRSAALMLRHLGYTKGADRLDLAVDQVIREGKYLTPDLKGKSTTREVLDAVLAKI

SEQ ID NO: 13614 - protein, 270 aa, Oryza sativa (japonica cultivar-group)
MSSAAGEPSSSSAAAAAISCSSSNDDEKPPPSLEGKELRRVEEEEPAAAARPEKLTEGSSRAAEAEEEEEVVEDEEDDDEEDEGKVAEAIDLGPRVSIKEQLEMDKEDESLRRWKEQLLGSVDLNSVGESLEPDVRITSLCILSPGRPDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKFVDDDRKCYLEINYTFDIRRDWPCKS

SEQ ID NO: 13615 - protein, 115 aa, Lactobacillus acidophilus NCFM
MDPLIQELTKEQIRDDIPAFRAGDTVTVHVRVVEGTHERIQLFEGVVIKKKGTGIGATYTVRKIASGVGVERTFPVNDPRVAKVEVKRHGRVRRAKLYYLRERHGKSARIAEARR

SEQ ID NO: 13616 - protein, 475 aa, Lactobacillus acidophilus NCFM
MNLWQKMNKKEDPRVYENKDGHLVRSLKVKDFLALGVGTIVSASIFTLPGEVAALHTGPAVAISFILAAVAAGLVAFAYAEMAAAMPFAGSAYSWINVVFGEFWGWVAGWALLAEYFIALAFVGSGLSANFRALIAPLGIKLPAALSNAFGTNGGVIDIISLISILLVALLISHGVSRAARVENALVVLKVLAILFFIVVGLTAIKGSNFVPFIPKYRPTAHGPFGGWQGIYAGVSMIFLSYIGFDSIAANSAEAINPQKTMPRGILGSLAIAVTLFVGVSLVLIGIMPYQKYANSAEPVGLALRYAGHPIVAIVVQTIAVLGMFTALIGMSMAGSRLIYSFGRDGMLPKWLGKLNADRRPNNALWTLTVIGILLGAFFPFSMLSQLVSAGTLIAFMFVSLGIYKLRPREGKDIDDPSFKMPFYPVLPALGFLAALVVFLGLDYQAKLYAGIWFILGLLIYLGYGVHHSVLNNKK

SEQ ID NO: 13617 - protein, 299 aa, Corynebacterium glutamicum ATCC 13032
MTETQETYQATTRVKRGLADMLKGGVIMDVVTPEQARIAEDAGASAVMALERVPADIRSQGGVARMSDPDLIEGIVNAVSIPVMAKARIGHFVEAQVLEALGVDFIDESEVLSPADYTHHINKWKFDVPFVCGATNLGEALRRITEGAAMIRSKGEAGTGDVSEAVRHLRTIRGDINRLRSLDEDELFVAAKEFQAPYDLVREVASTGKLPVVTFVAGGVATPADAALVRQMGAEGVFVGSGIFKSGNPAARAAAIVKAATLFDDPSVIADVSRGLGEAMVGINVSDVPAPHRLAERGW

SEQ ID NO: 13618 - protein, 207 aa, Vibrio angustum S14
MSLLTNINWEKVAGLIPAIVQDNASGQVLMLGYMNEDALQKTLDTKQVTFWSRTKERLWTKGETSGNVLQLKSIQLDCDQDTLLVQVDPIGPTCHLNTTTCFDSDESGAQPPSLVFLHQLEQLLASRKGADPESSYTASLYDRGTKRISQKVGEEGVEVALAATSGDKAELVCESADLIYHLLVLLQDQGLSLSDVTNKLQERHNKK

SEQ ID NO: 13619 - protein, 299 aa, Methanosarcina mazei Go1
MDRIISVVGHTALDYIVDVENIAGKNESSPVIDYEEYPGGGAANIAVAIAKLGGKSQLISPVGTDFSSSGYEKLLKEAYVDLSRLYTIEDRKISKAFIFTDREDNQTTYFYWGASSKFKELEPEPVDFVHLATADCVYNAKIAQIAGFVSFDPGQDLVTYSKENLETILAHTDILFANKHEIKRVSEMTGKSFSELRDMIDVIVVTYDAEGSIIYRGGDQWSIPVVSVKALDPTGAGDAYRAGFLLAYTREYSLPTCGKIGSTVASFAVQSRGCQTSLPTWEEMKSRYEASFGNLGAEI

SEQ ID NO: 13620 - protein, 353 aa, Arabidopsis thaliana
MEGAGETTTSEGHLTSAAAFVEGGIQDACDDACSICLESFCESDPSTLTSCKHEYHLQCILEWCQKSSQCPMCWQSISLKDPTSQELLEAVEQERNFRFNPTRNATIFRHPTLGDFELQHLPVGVDNAEIEERIIQHLAAAAAMGRARHGVRREGHRSRSSSQGHQQFMVFSSQPNASSPPPHPPMPSSPSQRDESDTVSNLPHNALGEGSHQSNTQPPTSSHPRQVSPSASDSNSRPLNQSSPSEQDRAGPSELQSFSESLKSRLNAVSTRYKESISKNTRNWKDRLFSRNTSMADLGSEVKREVSAGIATVSRMMERLETRENSRPSTASVSDVSENHTPETNNEHNSSSG

SEQ ID NO: 13621 - protein, 556 aa, Hyphomonas neptunium ATCC 15444
MASDIEIARGAKKKPIQEVAARAGVSPENLIPYGHDKAKISAAHLAGLAHNATGKLILVTAINPTPAGEGKTTTSIGLADAMNRIGANTLLCLREPSLGPCFGMKGGATGGGLAQIVPMEDINLHFTGDFHAITSAHNLLSTMIDNHIHWGGEPKLEAVRTSWRRVMDMNDRSLRNIVSGLGGPGNGSPSETGFDITVASEVMAILCLATDAEDLEARLARIIVGYTSEKEAVTAADIKATGAMMALLRDAMLPNLVQTLENNPCLVHGGPFANIAHGCNSVMATSAALKMADYVVTEAGFGADLGAEKFLNIKCRQAGLAPDAVVLVATIRALKMHGGLGKNDLGKVSYEALESGLENLGRHIGNLRSFGLPVIVAINRFTTDTEGEVHALQAYCEKLGVPVSLCTHWAEGGKGTEDLARGVTALIEKGEADFKPLYPDDMPLLEKIETVAKSIYRAGRVETTRAVRNQLAAWEKAGFGHLPVCMAKTQYSFSTDPALLGAPEGHVVRLREVRLAAGAGFVVAICGDIMTMPGLPRRPAAEHIHLNRQGQIEGLN

SEQ ID NO: 13622 - protein, 466 aa, Cytophaga hutchinsonii ATCC 33406
MYDVVVIGSGPGGYVAAIRCAQLGMKTALIEKYSTLGGTCLNVGCIPSKALLDSSEHYYNATHTFKEHGIDVKDVKVNLKQMIDRKAGVVKQTCDGINYLMKKNKVDVHTGIGSFVDKNTIKVTAADGSVKELKTAKTIIATGSKPTSLPNVAIDKKRIITSTEALELTEVPKHLIVIGGGVIGMELGSVYARLGAKVSVVEFMDTLIPTMDKALGKELIKVSKNHLGFDFYFSHKVTGATAKGKEVTVTAEDKDGKVLELKGDYVLVATGRRPYTEGLGLEAAGVKLDERGRVAVDGHLQTNVPGIYAIGDVVVGAMLAHKAEEEGVFVAESIAGQKPHINYNLIPGVVYTWPEVAAVGYTEEQLKKDGKAYKVGNFPFKASGRARASMDLDGFVKVLADKETDEILGVHMIGPRVADMIAEAVVAMEFRASAEDISRMSHAHPTFTESFKEACLAATDNRALHI

SEQ ID NO: 13623 - protein, 130 aa, Zea mays
MGTLIVLNDALKSMHNAEKIGKRQAMIRPASKVIIKFLTVMQRHGYIAEFEHVDDHRAGKIVEELNGTLNKCGVITPRFDASVKDIDGCTAMLLPSRQVGYIALTTSAGIMHHDEARRNNVGVKDLSIFY

SEQ ID NO: 13624 - protein, 110 aa, Methylococcus capsulatus str. Bath
MSTIEDTIRDQIAKHPVLLYMKGVPEMPQCGFSAKAVSCLQAAGVPFAYVNVLAAPSIRETLPSVSQWPTFPQLFVGGELVGGSDIVSELAASGELKTLLEAAAAGQAQG

SEQ ID NO: 13625 - protein, 767 aa, Rickettsia prowazekii str. Madrid E
MDEMNKINYTEALEYHEKDKPGKIAITTTKSLVTQQDLSLAYSPGVAAPCLEISKNLEAVYKYTSRSNLVAVISNGTAVLGLGNLGAAASKPVMEGKAVLFKKFADIDAIDLEVNTEDPIEFINAVKYLGYSFGGINLEDIKAPECFLIEEKLKSLMDIPVFHDDQHGTAIITAAGLINAAYLTNRTLKDLKIVINGAGAAAIACIDLLIALGVDKSKIILCDTKGVIYKGRTSGMNKWKERYASDTKIRTLTESLNNADVFIGLSVKGAVTKDMISKMAHKPIIFAMANPDPEITPEDIKFVRDDAIIATGRSDYNNQVNNVMGFPYIFRGALDVRASTINTEMKIAAARAIADLARRPVPEEVYKAYSGRKMVFGNEYIIPVPFDPRLITVVATAVAVAAIESGVARVKDFSIDKYKQQLGSRLNPTANYMNFLAEKIHNVPLKRIVFAEGEEEEVISAALMMRDEKYGNPIIIGRVERIEVTLKKIGKDISLAGIQIMNAALSDRLEQYTDYLYKRLQRKGYLYRDCAKLVKTDKNIFAACMVACGDGDALLTGVTKSYIDSLEDIIKVISPKQNRRILGYSIMIAKDHNIIIADNCITEYPNSLELAQIATQTAEIAKNMGITPRVALIAFSTFGNSSQEKTVRIREAVNILDNFSKDKKKLNGIKVDFEYDGEMSVKVALDHDLRKLYQFCRLSGSANVLIMPGLNSAAISTELLQKFSSNSFIGPITNGFAKPVQILPTTATANEILKIATFACVEAIKEV

SEQ ID NO: 13626 - protein, 453 aa, Rubrobacter xylanophilus DSM 9941
MIEVVNPATEEVLKRLEPASSSEVDAAVDRAKRAFPGWRDVPPAERARLLGRLAEALDAEREDLARTESLNVGKPLSAARAEMKMVVDTFAYYAGAPERLLGETIPVAGGVDMTFREPLGVVGLIVPWNFPLQITSWKVAPALAAGNTVVLKPAELTPLTALKLERIAGEAGIPEGVLNVVVGPGEIVGKRLVEHPEVAKIAFTGSTEVGRKIMAGAAGTVKRVTLELGGKSASIVFADADLEKAAAAAPLAVFDNAGQDCCARSRILVERGAFERFMSLLEPAVKELRVGDPQDETTQMGPLISASHREKVASYVTEEAPVAIRGEAPDGKGFWYPPTVLAPVSNKDRVAREEIFGPVAAVIPFEDEEEAVRLANDTIYGLSGSVWTRDVARALRVARRVETGTLSINSNTSVRVSTPFGGFKQSGVGRELGPHALEHYTEVKNVFVATEEG

SEQ ID NO: 13627 - protein, 338 aa, Streptococcus pyogenes MGAS315
MKAVVVNQASTGVEVVEHDLPNVGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADIVVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVVPVVEKVPVDTAPEVFDEMERGLIQGRKVLDFIS

SEQ ID NO: 13628 - protein, 81 aa, Brassica napus
MALSATMVGALLGLGTQMYSNALRKLPYMRHPWEHVVGMGLGAVFANQLVKWDVKLKEDLEVMLDKARAANERRYFDEDRD

SEQ ID NO: 13629 - protein, 215 aa, Oceanospirillum sp. MED92
MSKPKQTLRVGVGGPVGSGKTALLRSLCAAMRHHYDIAVVTNDIYTQEDAKFLTRHEALDTDRIIGVETGGCPHTAIREDASMNLAAIDQLIDRHGALDVVFVESGGDNLSATFSPELSDLTIYVIDVSAGDKIPRKGGPGITKSDLLIINKIDLAPLVGASLDVMDQDATKMRGDRPFVFSNLKQAKGLDDIIQFIITEGMLEAKELPPAKAVV

SEQ ID NO: 13630 - protein, 179 aa, Nuphar advena
MFPMVTGFMNYGQQTVRAARYIGQSFMITLSHANRLPVTIQYPYEKSITSERFRGRIHFEFDKCIACEVCVRVCPIDLPVVDWRLETDIRKKRLLNYSIDFGICIFCGNCVEYCPTNCLSMTEEYELSTYDRHELNYNQIALGRLPMSVIGDYTVRTIMNSTQIKISMDKSLDSRTITN

SEQ ID NO: 13631 - protein, 280 aa, Brassica napus
  misc_feature (143)..(143): Xaa can be any naturally occurring amino acid
LKRFAAEEQCMSPEVIKKAFQATEEGFLSIVTNQFQTRPQIATVGSCCLVTVICDGTLYVANAGDSRAVLPRVRFKSTPALGDVHATQLSAEHNASIESVRRELHALHPDHPDIVLLKHNVWRVKGIIQVSRSIGDVYLKRSXFNREPLYAKFRLRAPFSRPLLSAEPAVTVHRLQEQDKFIICASDGLWEHMSNQEAVEMVQNHPRNGIAKRLVKVALQEAAKKREMRYSDLKKIERGVRRHFHDDITVIVVFLDAKPGEVRGPAVSVRGAGVSIPKKT

SEQ ID NO: 13632 - protein, 470 aa, Exiguobacterium sibiricum 255-15
MGFFSINKVPNAGIPIEVQRKQWLRQFLKAFLVVFLAYMAMYLIRNNFKAAQPLMKEELGFSTTDLGYIGFAFSITYGIGKTLLGYFVDGKNTKRIISFLLILSAMIVTAMGLLMSAGGSPIGLLMVLWGLSGFFQSVGGPSSYSTITRWTPFEKRGRYLGFWNVSHNIGGAIAGGLALWGANVFFNGSVVGMFIFPAMIALTIGVIGLFIGKDDPEELGWNRSEEIFEEPIEPENLAAESMTKWEIFKTYVISNPWIWTLCIANVFVYIVRIGIDNWAPLYVTEHLHFSTASAVNTIFFFEIGALCGSLIWGYVSDLLKGRRALVATICLLLTAVAVLGYRYGTSETMIYASLFALGALIYGPQLLIGVSVISFAPKKATTVTNGMVGTFGYLLGDSIAKVGLAKIADPETNGLTIGSMTLHGWNDTFVVFNAALVLGVIALAIVAVVEEKKIRRLGLLEKQTKEKLSS

SEQ ID NO: 13633 - protein, 633 aa, Mycobacterium smegmatis str. MC2 155
MSSHPDFRNVAIVAHVDHGKTTLVDAMLRQSGALTHRGDDSTERIMDSGDLEREKGITILAKNTAVHRHNADGTVTVINVIDTPGHADFGGEVERGLSMVDGVLLLVDASEGPLPQTRFVLRKALAAHLPVILVVNKTDRPDARIAEVVSDSHDLLLDVASDLDEDAQAAAEKALDLPTLYASGRAGVASTVQPADGEVPEGDNLDPLFDVLMKHIPPPSGDPEAPLQALVTNLDASAFLGRLALVRIYNGKLKKGQQVAWMREVDGAPVVTSAKITELLVTEGVERTATAEAVAGDIVAVAGIPEIMIGDTLADPDHAHALPRITVDEPAISVTIGTNTSPLAGKVSGHKLTARMVKNRLDSELIGNVSIRVVDIGKPDAWEVQGRGELALAVLVEQMRREGFELTVGKPQVVTKNIDGKLHEPFEAMTIDCPEEFVGAITQLMAARKGRMEEMTNHAAGWVRMDFIVPSRGLIGFRTDFLTLTRGTGIANAVFDGYRPWAGEIRARHTGSLVSDRAGTITPFAMIQLADRGQFFVEPGQETYEGMVVGINPRAEDLDINVTREKKLTNMRSSTADVMETLARPLELDLEKAMEFCAEDECVEVTPEVVRVRKVELTASLRARAKARAKARG

SEQ ID NO: 13634 - protein, 116 aa, Pseudomonas syringae pv. tomato str. DC3000
MTNKIILALEAEQMTKEIPTFAPGDTIVVQVKVKEGDRARLQAFEGVVIAKRNRGVNSAFTVRKISNGVGVERTFQTYSPQIDSMAVKRRGDVRKAKLYYLRDLSGKAARIKEKLS

SEQ ID NO: 13635 - protein, 229 aa, Zea mays
MPASPSMIRRTSGEYLARNGVRIYACSETVKRGHVTFFWNGNRSGYFDQNLEKYEEIPSDAGIPFNVQPKMKALEIAQKARDAILSQKFDQVRVNIANGDMVGHTGDIEATIVGCKAADEAVKIILDAVEQVGGVFVVTADHGNAEDMAKRDKSGEPLRDKDGKVQTLTSHTLNPVPIAIGGPGLAPGVRFRTDLASAGLANVAATVMNLHGFQAPDHYEPTLIQVVDE

SEQ ID NO: 13636 - protein, 514 aa, Cytophaga hutchinsonii ATCC 33406
MAFEVKVPTVGESITEVTIGRWNKKDGEFVDVNELICEIESDKATFELNAEKSGILKLNAKEGDTVAIGTVICSIEEGAGSAAAKPAANAAPAAAPAATPAAPAPAASNAAPVEVKIPTVGESITEVTLGAWSVKSGDAVKAGDLLLEIESDKATFELHAETTGTIEILSKSGDTVAIGTVVCKIVPGAGGASQAAAPASAPAATAAASSGGANYAGGHASPAAGKILNEKGVDASAVAGSGKDGRITKEDALKASAAPAAAAKPAAAASTAAPAAKASAAGRADDRVKMTSLRKTIARRLVAVKNETAMLTTFNEVDMKPVMDMRSKYKDTFKEKYGIGLGFMSFFTKAVCMALQEFPAVNAYIDGDEIVYHNFCDVSVAVSTPKGLVVPVIRNAETMSFNEIEAEIVRLATRARDGKLSIDEMSGGTFTITNGGIFGSMLSTPIINSPQSAILGMHNIVERPVAVGGQVVIRPIMYLALSYDHRIIDGRESVGFLVRVKQLLEDPSRLLLGV

SEQ ID NO: 13637 - protein, 356 aa, Vibrio angustum S14
MSKEKILFIDRDGTLIVEPPVDFQVDRLDKLKFEPNVIPALLALQNAGYKLVMVTNQDGLGTDSYPQADFDAPHNMMMEIFESQGVIFSDVLICPHFDNEGCSCRKPKLGLVKEYLQQGRVDFETSAVIGDRITDLQLAENMAIRGIQYNPEIMNWMQILTDLTTQPRIAEVVRTTKETDIRVKVNLDQTGGNTISTGLGFFDHMLDQIATHGGFQMTLTVDGDLHIDDHHSVEDAALALGEALKKALGDKRGIGRFGFSLPMDECLAQCALDLSGRPYLKFDAQFSRDQVGDLSTEMVPHFFRSLTDTLACTLHLSSTGNNDHHIVESLFKAFGRTLRQAIKVEGNELPSSKGVL

SEQ ID NO: 13638 - protein, 408 aa, Cytophaga hutchinsonii ATCC 33406
MTKLKIGIIREGKVPSDRRVPLLPAQCVEIMQQYPHVEIFVQPSDIRCISNKEYVSAGIPIREDLSSCDILLGIKEVPIYQLMADKTYLFFSHTIKLQPHNQKLLQSVLEKRITLIDYEALRDKENKRVIAFGYYAGIVGAYNAFLLTGKKYNLFDLKPAHKCYDINELIAELKKVVLPPLRFVLTGAGRVGNGAELMLKEMGIQKISPQDFLTKTYKHPVYTQIISADYNRLPSANQSINIWNTEHFHEHPEMYQSNFMRFASVTDVLIAGAYWDQRAPKLFTTEDIKRSDFSIRLIADITCDINGSIPTTVKSTNIYDPAYDFNPFTKDIEAPFSDPRNITVMAIDNLPCEIPRSASEDFGNQLIKNVLPDLLTKPYGDLIQRCALTVKGTLGPHFSYLKEYSEGK

SEQ ID NO: 13639 - protein, 107 aa, Methanosarcina mazei Go1
MLKMPEADLSILNRVYDIILDRKENYDENSYVCKLLNHRKGMNKILEKVGEESIETILAVRNEDHREIVSESSDLIFHLLVLLAANNITLEEIADELSTRHEKMRRD

SEQ ID NO: 13640 - protein, 336 aa, Colwellia psychrerythraea 34H
MKPVICFGEALIDFLNTGSQEDGCLTLNNYRQYPGGAPANAAVAVSRLGGKAFFAGQVGDDAFGDFLINALHTYQVDTQFVSKHPHAKTALAFVLLDEMGERSFSFHRHQTADLLFEKSQVDEIWFCESPIFHFCSNTLTEKDIADCTEYAVERALVHGAIISFDVNLRHNLWATGKVSISVVNKLVKQAHVLKFSSEELTYLAQGNIESYIQSCFDANCQLLIITDGENVLTYYTAAILDAISPPKVITVDTTAGGDAFIGALLFALSHFEQLTELLDDNELLKQIINFSASCGALTVTKAGAFPALPNFEQAVAFVKELGLKQTQLLDIFSRSR

SEQ ID NO: 13641 - protein, 512 aa, Aspergillus nidulans FGSC A4
MGFMLRKPDDAAGSAAPAILIGLFVAFGGVLYGYDTGTISGILAMKYWRRQFSTGYVNPNDHIPDVTSSQSSMIVSLLSAGTFFGALTAAPVADYFGRRIAMILDCFVFCFGVVLQTAATAIPLFVAGRFFAGFGVGLLSATVPLYQSETAPKWIRGTIVGAYQLAITIGLLLAAIVNNSTKDRNDTGCYRIPVAVQFAWAIILVVGMIILPETPRFLIKQDNHEAAIKSLARLRRLDINDLAVVEELEEIKANHEYELSVGKASYLEILRGSIVTVYYGTTFFQHSGINNSFVITLITNIVNVVSTLPGLWMVEKWGRRPLLLFGAVGMCVSQFIVAIVGTTTDSGVANKVLIAFVCVYIFFFASSWGPVAWVVTGELFPLKARAKCLSITTAANWLLNWAIAYATPYMVDSGPGNANLQSKVFFIWGGFCLIAGIFVWTCIYETKGLTLEEVDELYAKVPVAWRSKGFVPSVHYTDVRDVAAGRKGSGLAELEADAQAKQISEHVEKASV

SEQ ID NO: 13642 - protein, 323 aa, Oryza sativa (japonica cultivar-group)
MGISHPLSDDFDASPVLSPPPPPSSCCPPAHDDHYLEHQISDIKRANSLMTDSQMFAHKMLLIPLPGRPMPSSVRLNGSGQKMKRAWAPNNQQNRDVTDSLDSSNYNSSKQQMSLAMSTLQSYYGLTPQNGAMTDAGTEMSLYSKGSLERINSETLVTSSRLPDTHNTDRSRNSEDTSNGFSATNGASGAKINGTAKAKQDGSIRRRQKVEADQVSNTTDTQDDVFTDPIKMTKSLLPRPISSIRQNMDTSNPESSLKSNGSFLSGFRSVRKSPSTPNFADAENGISMWSSSAWTFNHESFTRPLLDGLPKPTAPRRTKAALD

SEQ ID NO: 13643 - protein, 637 aa, Spinacia oleracea
MGGSSKTVRKLEVATPVPADIDIANAVEPLHIADIAADLNLSPRHYDLYGKYKAKVLLSVLDEVQETQDGYYVVVGGITPTPLGEGKSTTTVGLCQALGAFLDKKVVTCLRQPSQGPTFGIKGGAAGGGYSQVIPMDEFNLHLTGDIHAITASNNLLAAAIDTRMFHESTQSDKALFNRLCPPNKEGKRTFCNIMHRRLKKLGIDKTNPDDLTPEEVTKFARLDIDPDSITWRRVMDVNDRFLRKISVGQGPDEKGMVRETGFDISVASEIMAVLALTTSLADMRERLGKMVIGNSKAGEPITADDLGLGGALTVLMKDAINPTLMQTLEGTPVLVHAGPFANIAHGNSSIVADKIALKLVGPGGFVVTEAGFGSDIGTEKFMNIKCRYSGLTPQCAIVVATVRALKMHGGGPQVVAGKPLDRAYLTENVGLVEAGCVNLARHIINTKAYGSNVVVAINMFSSDTEAELNAVKKAAMDAGAFDAVICTHHAHGGKGAVDLGIAVQKACENVTQPLRFLYPLDISIKEKIEAIAKSYGAAGVEYSEQAEKKIEMYSKQGFSNLPICMAKTQYSFSHNAAEKGAPSGFILPIRDVRGSIGAGFIYPLVGTMSTMPGLPTRPCFFDIDLDTTTGKVIGLS

SEQ ID NO: 13644 - protein, 299 aa, Oceanospirillum sp. MED92
MNEQIKNVAITGGTHGNELTGVHLVKHWSENPQEVKRDSFATELHLANPEANQVVRRYIDQDLNRQFNIDDLKNQSLQGCEQQRAKALDAILGPKENPRVDFIIDLHTTTANMGMSLIFNTDDPLQVGMAFYIKQKMPEATLFFNPSERLEDNFLTSLGRLNGFLIEVGPIAQGLLNYQVYSDTHTAVMHALDYLELKNTGQTPDLPMQMGGYRFTKKIRLPENEEGDITAMIHPNLQNKDYEEIRPGDPLFITLGGETIPYQGDKAVYGAFINEAAYYDQHIGLSFMEKINIELKQEG

SEQ ID NO: 13645 - protein, 705 aa, Mycobacterium smegmatis str. MC2 155
MEIWRGKAYPLGATYDGSGTNFALFSEVAERVELCLFDDDGDGGLRETRITLPEVDGFVWHGFIPNIEPGQRYGYRVHGPYDPAAGHRCNPNKLVLDPYAKAIDGQFDWGQPLFSYNFGDPDSRNDDDSAPNMPKSVVINPYFDWGVDRPPSHDYADTVIYEAHVKGLTQTHPDIPDNIRGTYAAVAHPAIVEHLQNLGINAIELMPVHHFANDSTLIDKGLSNYWGYNTIGFLAPDSKYSSSPNPGGQVQEFKAMVRTLHEAGIEVILDVVYNHTAEGNHMGPTLSFRGIDNAAYYRLVDDDKRYYMDYTGTGNSLNVGHPHALQLIMDSLRYWVIEMHVDGFRFDLASTLAREFYDVDRLATFFELVQQDPVVSQVKLIAEPWDVGPGGYQVGNFPPLWTEWNGKYRDTVRDYWRGEPATLDEFASRITGSADLYEQTGRRPFASINFVIAHDGFTLRDLVSYNEKHNEANGEDNNDGESHNRSWNCGAEGPTDDPEVNALRSRQQRNFITTLLLSQGVPMLAHGDELGRTQQGNNNVYCQDSELSWIDWESADTELLEFTQKVSALRSAHPVFRRRRFFNGRPVRRPGEPRLPDIGWYAPDGSEMTDEDWDAGYAKSMAVYLNGQGIPDRDERGQRIVDDSFYMCFNAHYEPIEFVLPPSDFAEQWVEVINTAADCGTDPIEAGTRVTVESRAMLVLQAHHD

SEQ ID NO: 13646 - protein, 711 aa, Oryza sativa (indica cultivar-group)
MAGVVTRAVAAAVLVVVVVVAAAELVAAEPPPSERSALLAFLAATPHERRLGWNSSTSACGWVGVTCDAGNATVVQVRLPGVGLIGAIPPGTLGRLTNLQVLSLRSNRILGGIPDDVLQLPQLRLLFLQNNLLSGAIPPAVSKLAALERLVLSSNNLSGPIPFTLNNLTSLRALRLDGNKLSGNIPSISIQSLAVFNVSDNNLNGSIPASLARFPAEDFAGNLQLCGSPLPPCKSFFPSPSPSPGVSPADVPGAASSSKKRRLSGAAIAGIVVGAVVLALLLLVAAVLCAVSKRRRGASEGPKSTTAAAAGAGAAAARGVPPPGSGEGTGMTSSSKEDMGGASGSAAAAVAAVAAEPSRLVFVGKGAGYSFDLEDLLRASAEVLGKGSVGTSYKAVLEEGTTVVVKRLKDVAVARREFDAHMDALGKVEHRNVLPVRAYYFSKDEKLLVFDYLPNGSLSAMLHGYYSYSRSMAPILIALSLEVFDWRMPEWSRGSGKTPLDWDARMRSALSAARGLAHLHTVHSLVHGNVKSSNVLLRPDADAAALSDFCLHPIFAPSSARPGAGGYRAPEVVDTRRPTYKADVYSLGVLLLELLTGKSPTHASLEGDGTLDLPRWVQSVVREEWTAEVFDVELVRLGASAEEEMVALLQVAMACVATVPDARPDAPDVVRMIEEIGGGHGRTTTEESEEGVRGTSEEERSRGTPPAAPTP

SEQ ID NO: 13647 - protein, 344 aa, Triticum aestivum
MRNQKSRVQECKVEHIDLIPGMPDDVAVDCLARVPHASFRSMRGVCRGWNTAAAAPDFALARAEAGANEDLVYLLQFGNPAAADADGVAPENAQAYGVSVYNVTTGEWRREGAAPPVPMFAQCAAVGSRLAVLGGWDPKTFEPVADVHVLDASTGVWRRGAPMRSARSFFACAEAGGKIYVAGGHDKLKNALKTAEAYDAGADAWDPLPDMSEERDECDGMATVAGDRFLAVSGYRTGRQGGFERDAEWFDPASREWRRLERVRAPPSAAHVVVRGRVWCIEGTAVMEYRGERPSWREARPSPPPGLKAGTARAGPPPRGETLGGTRPHNSKEGAGAPPGGCPR

SEQ ID NO: 13648 - protein, 126 aa, Cytophaga hutchinsonii ATCC 33406
MTKKIINTSNAPAPIGPYSQAILAGNTLYVSGQVAFDPASGNLITDSIQNETHRVMKNIEAILLEAGYSFSDIVKCSIFVKDLNNFAAINEVYGTYVGDGKPARETVEVARLPRDVNVEISCIAVK

SEQ ID NO: 13649 - protein, 218 aa, Medicago sativa
MDHDAIIFEEECDYLFKAVLIGDSGVGKSNLLSRFAKDEFRLDSKPTIGVEFAYRNIKVRDKLIKAQIWDTAGQERFRAITSSYYRGALGALLVYDITRRSSYESVGRWLVELREFGGEEMVVILVGNKCDLGESREVEEEEAKGFAEAEGLCFMETSALKNLNVEQVFLQMITTIFDITNQRSLDAKMDETPINLSNGKEIHIADEVTATKQAPCCS

SEQ ID NO: 13650 - protein, 336 aa, Zymomonas mobilis subsp. mobilis ZM4
MQQSLQTVDDSTPYQDPSFSQFIKHGRNVILSEATAMHHLAASIGVDFAKAVSMLLETRGRIIVSGIGKSGHVGRKIAATLASTGSSAFFIHPAEAAHGDLGMMMNGDILIAISFSGRTRELLPMISYAQTLQVPVIVITSQKGDVLPKEATLSLRLPELKEACPANIAPTTSTTLTMALGDALAVSMMRHRGFSRDAFKLLHPGGQIGFRLQSISRLMHEGAALPLVHCKEPMRDVLVTMSRKSFGSAGVVNDEGELMGVITDGDLRRHADHLMESAAEDVMTSDPVTMRADDMAEDALILMTEKRITSLFILGKNGAKQPVGLLHIHDLTRMGL

SEQ ID NO: 13651 - protein, 218 aa, Zea mays
CGRTSRQRTQKAAASAPPTRQRSSVAKLTTASSSLANLLSAFVSANNSSPDPRPPPPRRSFDERGAVGLGIVAAMGHGAEPIAIGAAARRRAREDDESYTCVIKHVAGAGGASVRKRVYFGFGDGGGGWLVEADDAAPAPAPDFLSRCCLCDKRLDGLDIYMYRGDKAFCSSECRCQQMLLDDRAAKCGSSEALIRSGDYSVSPHSAPMAFSPSVAAA

SEQ ID NO: 13652 - protein, 97 aa, Arabidopsis thaliana
MAINRSLLLILLFISVSLSTARILPGEFVPVIFSGEIPPVSKSAVVGCGGEQETKTEYSSFVPEVVAGRFGSLVLNALPKGSRPGSGPSKKTNDVKT

SEQ ID NO: 13653 - protein, 171 aa, Triticum aestivum
AASTTSVRGIKPDDLTSLKEKLDQEATENLGMAMIYTLLDSAKEWLTEKYGQNAGDEEPDETEEPAEEVIIPHGEAVTVESFMAWRERFEAELALQRAKLMPESALTAPKEKKLSGRQYFESGRHITKGAGTVAEEDEEEEEDIEFDDDFEDDEEDMLEHFLAEQTGKSSA

SEQ ID NO: 13654 - protein, 145 aa, Oceanospirillum sp. MED92
MKEHSDDVLTNRLYLAVRFCVRILSVLMVLVIIMGVIDVGWTIYEKLNSPPVYILTISDMLATFGAFMAVLIAIEILINITVYLRDDVIHVKIVMATALMAVARKVIVLDFETVTPPYIYGLAAIAIAMSIGYWLIHKLPTKLHE

SEQ ID NO: 13655 - protein, 341 aa, Colwellia psychrerythraea 34H
MKSLAKLKAEPGIWLTRTEKPKLGHNDLLIKIKKTAICGTDIHIYNWDEWAQKTVPTPMVVGHEYAGEVVGIGQEVKGFTLGDRVSGEGHITCGHCRNCRGGRTHLCRNTVGVGVNRAGSFAEYLVIPAYNAFKLPDEISDDLASIFDPFGNAVHTALSFDLVGEDVLITGAGPIGIMAAAVAKHVGARHVVITDINEYRLDLARKMGATRAVDVSKESLKDVMTDLGMTEGFDVGMEMSGVPMAFTSMLESMNNGGKIAMLGIPGSDMAIDWSQVIFKGLTIKGIYGREMFETWYKMASLIQSGLDLTPIITHHYNIDDFQQGFDMMRSGQSGKVILDWT

SEQ ID NO: 13656 - protein, 73 aa, Aspergillus nidulans FGSC A4
MADANIQTLLQKPRSECTLARVKAFDRHSNMVLENVKEMWTEPQKGGKGRPVNKDRFISKMYLLLHLVKRRPC

SEQ ID NO: 13657 - protein, 905 aa, Colwellia psychrerythraea 34H
MSDLLPTSPLTSPVIKTGEPSLIQSTCAYCGVGCGVDIGVADGKATSLVGSAAHPSNYGRLCVKGSNLLNTIDLTGRLLSPEIAGEQVSWDKATDYVAEQFNDIIKKYGKDSVAFYVSGQLLTEDYYIANKLMKGYIGSGNIDTNSRLCMSSAVSAYKRAFGEDVVPCTYQDLEETDLLLLTGSNAAWTHPVLYQRIERAKKINPAMKVVVIDPRKTATCELADNFIQLKPGTDAAFFNGLLHFLSENQGLDTDYIAQHTEGFEQALTQATSWTVTKVAEFCQVSIEELTTVYQLFCSSEKAITFYSMGINQSSSGVDKCQTIINCHLASGKIGKAGSGPFSITGQPNAMGGREVGGLANQLAAHMDIDNPQHQDKVQRFWQSPTIANKQGAKAIDLFDKLASGEIKAVWIMATNPVVSLPNRAKITAALKKCELVVVSDCVEQNDTLAFADVKLPATPWLEKNGTVTNSERRISRQRNAVLPAGQAKHDWQIIQDVATKMGFSGFDFDDVSDVFKEHAQLTQFENDGERLLDLSGLSQLTAKEYNELAPIQWPVNDANPEGCARVYADGKFNTPSGKAKFIPVKPQLPLQKTSAEFPFVLNSGRLRDQWHTMTRTGKTNKLSKHTDKPYLYLHPTDAKALAVQNDDMLSITASTGQAIAHVKVDAKQRLGECFMPIHWNQNYASHGNVSDLYQSIVDPLSGQAESKQGAVALGKKTYKQYISVHTTSKITLSADFWVKSTTAYGDSYQVALDEPTIDALLLCQQISGLSGEWLTFIQDNQSYVVCLQAGKLAFLGYFSATWPEIEQSWLEHVFGSKTLEFATIQSLLLGISSDEFNQGKQVCSCYSVGEKTINEAIAQGCGSVEALGEKLQCGTKCGSCKPELASLISQYNADPIETAIVLAED

SEQ ID NO: 13658 - protein, 181 aa, Nicotiana tabacum
AQQVDGENANLYMHSEDVLMCVLPLFHIYSLNSILLCGLRVGAAILIMQKFDIAPFLELIQKYKVSIGPFVPPIVLAIAKSPIVDSYDLSSVRTVMSGAAPLGKELEDACENQIPNAKLGQGYGMTEAGPVLAMCLAFAKEPFDIKSGACGTVVRNAEMKIVDPDTGCSLPRNQPGEICIR

SEQ ID NO: 13659 - protein, 181 aa, Nicotiana tabacum
AQQVDGENPNLYFNSEDVIMCVLPLFHIYSLNSVLLCGLRVGATILIMQKFEIKGLMELVEKYKVTIAPFVPPIVLAIAKSPLVDKYDLSSIRMIMSGAAPMGKELEDTVRAKLPNAILGQGYGMTEAGPVLSMCLAFAKQQFEVKSGSCGTVVRNAEMKIVDTNTGASLPRNHAGEICIR

SEQ ID NO: 13660 - protein, 253 aa, Hordeum vulgare
MGRKFFVGGNWKCNGTVEQVEAIVQTLNAGQIVSPDVVEVVVSPPYVFLPIVKAKLRPEIQVAAQNCWVKKGGAFTGEVSAEMLANLGVPWVILGHSERRSLLGESSEFVGEKVAYALAQGLKVIACVGETLEQREAGSTMEVVAEQTKAIAGKIKDWSNGVVAYEPVWAIGTGKVATPAQAQEVHANLRDWLKTNVSPEVAESTRIIYGGSVTGASCKELAAQADVDGFLVGGASLKPEFIDIINAAAVKSA

SEQ ID NO: 13661 - protein, 253 aa, Mycobacterium smegmatis str. MC2 155
MSAHEHVHEDSVAGQVVTITGASSGIGEATARLLAARGASVVLGARRTDRLDRIVEEIRSTGGAAVAVAVDVTRRADVDNLVATAVREFGRLDVLVNNAGIATLGPLADGDTDTWSAVIDVNVRGVLHGIAAATPVFTCQGRGHVITVVSTAGLKIVPEMGVYAGTKNAVRTIMEALRQESTDGVIRTTSISPGYVRTELGGPPGGPAGNAARATMDRIGLPPDAVARAIAFAIEQPHDVEIGDLTIRPTVQG

SEQ ID NO: 13662 - protein, 221 aa, Aspergillus nidulans FGSC A4
MPDPSDRKAVTRYLEQTHDKIFESNRAWVASKKGADPEFFNKLAAGQSPEYLRVPANEIMGLDAGEVFVHRNIANVVPTIDLSSMSVINYAVGHLKVKHIVVCGHYNCGGVQAALTPTDLGILNPWLRNIRDVYRLHEKELDAIEDDGERFNRLVELNVIESCRSVIKTAVVQQSYEENGFPIVHGWVFNLKDGLLKDLNIDFPGILADIQKIYNLTKGSS

SEQ ID NO: 13663 - protein, 456 aa, Zea mays
MEAAAAVVGFGAGAGLTRWQAAALSAVAGWVWAASFYDLTRRARALVQPWVTRRVHAETAAILRFQRLEHKLLDNIFSMLSCVVSVPFYTGFLPLLFWSGHGRLARQMTLLMAFCDYLGNSVKDIVSAPRPCSPPVRRVTATEDEKENAMEYGLPSSHALNTVCLTGYLLHYVLTYGEHGSVTVAAGLSLAFLLVMLVGIARIYLGMHSLTDVVAGIGFGVVILAFWLAVHDRVDAFVVSGENGTSVNLSALGASNFVEEHDHEVWRWKSIKYHPNSFPRLAVATFWAGLSLLLCFAYPKPEFPTPSFEYHTAFNGVAFGIVYGIQQTYFHFHTPDAPLVFSAELPLLTFAGRVLVGIPTILAVKFCSKALSKWLLPVVCSTLGIPTVSSCYVPALRADSGSGKNRQGAGHLQRLLFSHFPRKAYDVDTGIRFVQYASLAWSVVDLVPAMFAHLNL

SEQ ID NO: 13664 - protein, 347 aa, Listeria innocua Clip11262
MKNAIKWIAIGFAGIILLPLVIVFFIYKKAVGKKEYDPEVLENLDEASQEFVKNTSPLSDVDSRYKYMRLATKALPSAKDIEIGDVENKKIDGPAGKIPIRIYTPKEDGPFEIIVYYHGGGFVLGGLQTHDAIARKLVQTTGARVVTVDYRLAPENPFPAAVEDAYAALLWVQNHRTSLRAKSSDIIVAGDSVGGNLATVVTQIAKAKGKPNVTAQILLYPATDIFSRDASVLYPSMDEFAEGYVLTKESLDKFFKLYIANSSDRKYDPLIAPIRSKDLAGLPKTFIATAEFDPLRDQGEAYAKKLKDAGVEVFAKRFEKVPHGFMTTTSEATDETYELISEFLEEK

SEQ ID NO: 13665 - protein, 455 aa, Lactobacillus acidophilus NCFM
MVKVVSLSQVKKLSTSKSARAISLETLIKVLGNGSYSNISLNNSLKNSDLAIADQNLATRIVYGTIQYRIFLEYQLNGLIKTKLTEKYIKPLLLMSLYQIIFLDKVPNRAILDEANKLAKKFGKHHSSGYRIVNGILRSFIRRGVILPDKNNEIEYLSIKESVPEWLVKYLISNWGIEKTKSVLSSINEPAKNSVRISMFSDKKKVFEELDNEGFNPNWSNLSANDIVLDHGGVSQSNLFKSGNLTIQDEAASLVVEAFDFDKDKPEHVLDACSAPGGKTVQLAESFKNGTVTALDIHEKKLRLVKENAKRMHVSDKVKTQACDAREAQARFDAGEFTKILVDAPCSGLGLLRRKPEIRYTKSLKDLKNLQKIQLAILDSVSLLLHVNGELVYSTCSISMEENEDVVKKFLQTHSNFELKPFKLSKLESKTGMLKIMPDQDGNDGFFIAKFKLRG

SEQ ID NO: 13666 - protein, 335 aa, Coprinopsis cinerea okayama7#130
MLEGLEPSIALTGGPWYTDNELDTEFIQHLMDACYKFISDISFPKRRDAPEGALFPISNAPDYPSAQHIRNSLRKARLTETDLSVEHVESLLNVLVLDGKIEALPAFGTSLWDSAAINEESDDEDDRSRKKRKYGSDDEHERKRSKRKRSKRASSSDDESLDDHRSSSKKKSSKRHRSPATSSDAESEEDTKRKKRKSKKRRDGDSDDSDSEAESRPRSKKKRKKRSSRSSDSETSSESESDHRSRKSSKRSSKRSPSPFDYSGFDQDTGGGGLVYRALKEYTSQLGWAQAPCALCPSFDFCKAEGPVNPQECDYYDEWLAAKPMTTLTDSGIGI

SEQ ID NO: 13667 - protein, 426 aa, Clostridium thermocellum ATCC 27405
MHKKEIIALLLAGGQGSRLGVLTKNIAKPAVLYGGKYRIIDFSLSNCVNSDIDTVGVLTQYQPLELNAHIGIGKPWDMDRINGGVTILSPYLKAEIGEWYKGTANAVFQNIHYVDKYSPKYVIILSGDHVYKMNYSQMLDFHKENNADATISVINVPWEEASRYGIMNTYENGKIYEFEEKPQNPKSNLASMGVYIFNWEVLKEYLIRDDQNEESAHDFGKNIIPMMLKEGRSMWAYKFNGYWRDVGTIQAYWESNMDLISRVPEFNLFDPAWKIYTPNPVKPAHYIGPTGSVKKSIVAEGCMIYGSVRNSVLFPGVYVSEGAEIVDSIVMSDSVIGENTQIYKCIIGEEVKVGKNVRMGIGENIPNELKPHLYDSGITVVGEKAVVPDGCQIGKNVVIDPYITAEEFPSLNIESAKSVLKGGETE

SEQ ID NO: 13668 - protein, 373 aa, Clostridium thermocellum ATCC 27405
MKSTMGIILTGGKNDRLKELAEMRSSTAVPIGGKYRVIDFVLSNMVNSGIKNIGVLTQYSFRSLMDHLGSGKEWDLDRRNEGLFIFPPYLAGEHSGWYQGSADAMYHNITFLKRSYEEYVLVAQGNCVYKMLFDDMLDYHIKKNADITIAYRDMSDFPREELSFMGVMTMDENRRVVDFKEKHKNPESTICSMGIYILKRELLIALLEECNSHGKYDFVKDVIINKLPTLNIYGYKFEGYWRNLNSINAYYRINMEMLNPEIRYQLFEQHGKVYTKVKDEPPAKYNEEAEVRNSIIADGCIIEGTVINSVLFRGVTIKRNAVVKDCIIMQDSVIEEDVDIESLIIDKNVYLSKGIRLKGMVNFPITIGKNAVI

SEQ ID NO: 13669 - protein, 249 aa, Hyphomonas neptunium ATCC 15444
MPRTLIAGNWKMNGLMANLAEVERVAAEVPASSEGAETLLCLPATLIHAGSAKSEGSGLKIGGETCHANEKGAHTGDLAAEMLKDAGASYVIVGHSERRADHGETDAVVAAQASAALRAGITPIICVGETLDQRDAGEVLTVITTQMAESIPEGAEAAAIVIAYEPVWAIGTGRVATSEQIAEVHTSIRNLLVRRFGDAGRTTRILYGGSMNPGNAAEILAVAEVNGGLIGGASLKAADFLAIYRLAAQ

SEQ ID NO: 13670 - protein, 132 aa, Aspergillus nidulans FGSC A4
MSTSARRRLMRDFKVARNAVIIGPADTPFEDGTFRLVMHFEEQYPNKPPGVKFISQMFHPNVYGTGELCLDILQNRWSPTYDVAAILTSIQSLLNDPNTSSPANVEASNLYRDNRKEYIKRVRETVEKSWEE

SEQ ID NO: 13671 - protein, 214 aa, Glycine max
MADETQNKYESSEVEVQDRGVFDFLGKKKDEEDKPHPQEEVIATEFQKVTVSDQGENKHSLLEKLHRSDSSSSSSSEEEGEDGEKRKKKKKEKKGLKEKIEEKIEGDHHHHKDEDTSVPVEKVEVVETAHAEEKKGLLDKIKEKLPGHKKTEEATATTPPPPPPVASLEHGEGAHHEGEAKEKKGILEKIKEKLPGYHSKTEEEKEKEKESGAH

SEQ ID NO: 13672 - protein, 629 aa, Xylella fastidiosa
MDRAARPPWQRRKVPRRRFVPSLSGRTIVNITTALPLPTHLLSEKVTAPLLGARKIYITGSRQDIRVPMREIALTPSSARYGGNENLSLALYDTSGIYTDPQATIDLACGLPRLRAAWIDERADTVEAALYFKVPESVSVTAPPFPTAPRPRRARDNVAVTQLEYARRGLVTPEMEFVAIREQQRREQTVENLRGQRHAGDAWGALVGTPITPEFVRDEIARGRAILPNNINHPESEPMIIGRNFLTKINANIGTSALSSSIAEEVEKLVWAIRWGADTIMDLSTGRDIHATREWILRNSPVPVGTVPIYQALEKVGGHVEALSWAVFRDTLIEQAEQGVDYVTVHAGVLRDFIPLTASRLTGIVSRGGSIMARWCQAHRSENFLYTHFEELCEIMRAYDVAFSLGDGLRPGCIADANDAAQFAELEILGELTHIAWNHQVQVMVEGPGHVPMHLIKANMDKQLAACGEAPFYTLGPLTTDIAPGYDHITSAIGAAMIGWYGTAMLCYVTPKEHLGLPNLQDVHDGIIAYKIAAHAADLAKGHPAAQARDDALSKARFEFRWQDQFHLSLDPEKALALHDESLPKEAHKRAAFCSMCGPQFCSMKISQEVRDASSNELSDGNTNTNDAI

SEQ ID NO: 13673 - protein, 510 aa, Ageratina adenophora
MTILTLLLYTSISALAFYLLLNLRTRHPKRLPPGPTPWPIVGNLPHLGTVPHHSLAALATKYGPLMHLRLGFVDVVVAASASVASQFLKSHDANFASRPPNSGAKHIAYNYHDLVFAPYGPRWRMLRKICSVHLFSAKSLDDFRHVRQEEVAILTRVLISAGETTVKLGQLLNVCTTNALARVLLGRRVFGDGSRDSDPKADEFKDMVVEMMVLAGEFNIGDFIPALDWLDLQGVTKKMKKLHTRFDSFFNLILEEHKSYGNSGDLLSTLIGLKDDADADGEGVKLTDIEIKALLLNLFTAGTDTSSSTVEWAIAELIRHPRLLKQAQEEIDTVVGRDRLVTELDLNQLTFIQAIVKETFRLHPSTPLSLPRISSEACEVDGYYIPKGSTLLVNVWAIARDPEMWTDPLEFRPSRFLPGGEKPNVDVRGNDFEVIPFGAGRRICVGMTLGLRMVQLLVATLVQTFDWELAKGLEPEKLNMDEAYGLTLQRAEQLIVHPKPRLAPGVYESC

SEQ ID NO: 13674 - protein, 103 aa, Zea mays
  misc_feature (43)..(43): Xaa can be any naturally occurring amino acid
MAGRGKGGKGLGKGGAKRHRKVLRDNIQGITNPAIRRLARRGXVKRISGLIYQETRGVLKIFLENVIRDPVTYTEHARRKTVTAMDVVYALKRQGRTLYGFTG

SEQ ID NO: 13675 - protein, 487 aa, Halobacterium sp. NRC-1
MSSSQTRSPDAELGLLDATMIGMGAMIGAGIFVLTGLAAEIAGPAAILVFALNGVVTAFTGLSYAELAASIPKSGGGYAFVREIFGDFSSFIMGWMLWFAYMIAGALYALGFAPNFLELLHVYGLVAPPDQVGAIAVPLLDASVPAAFVLAFIAVLGLVALNAVSTAASGSAETIFTIIKVSILVVFVAFGATSPLFSGAEFQPLFGVGGGPAAILPAMGLTFIAFEGYDLITTVTEEVKNPRENIPKAIFVSLIATVIVYLAVVTVAVGTLGADGLAAAGEAGIAEAATSFMPTGLPIIQNGGALIVFGAVFSTLTALNAVVIASSRVAFSMGREGQLLPSFGQIHHRYGTPFVAIIASAVVMLASVALPTQSAGNMSSLFFLLSFIIVNVAVIRLRRERPDMNRPYEMPFYPAPPLIGIALNLVLSVVLVDYLVRTDPLALALSAAWIVLGTAAYYAHASRQSAAGDDEDTTTISADAEHTPHDH

SEQ ID NO: 13676 - protein, 353 aa, Leifsonia xyli subsp. xyli str. CTCB07
MRRPVTLTGQLGFTERIFARGEARQVATAVDDGLALVEEALHREVRFADNLADVTTRYLLEAGGKRVRPMLTLLTAQLGKGNTPEVLQAAQAVEITHLASLYHDDVMDDSQMRRGVPTAQFVWGNSVAVLTGDLLFARASKLVSSLGERAIQLQADTFERLCLGQLHETIGPQDGEDAVAHYIRVLEDKTGSLIAVAAQMGIVFSGADSSYEEPVVTFGEKIGVAFQLIDDVIDLSSEGVAETGKTPGNDLRAGVATLPVLRLRERALRDPEAAALLDRLDRDVMGSTADDGEVTPEATAAISALREHEVTRQTLEEAHRWAREAFEALEPLPEGPVKKALVRFADTIVERSS

SEQ ID NO: 13677 - protein, 135 aa, Glycine max
MSAAEGAVVFSEEKEALVLKSWAIMKKDSANLGLRFFLKIFEIAPSARQMFPFLRDSDVPLETNPKLKTHAVSVFVMTCEAAAQLRKAGKITVRETTLKRLGGTHLKYGVADGHFEVTRFALLETIKEALPADMW

SEQ ID NO: 13678 - protein, 312 aa, Glycine max
MYHGKFSLTPKNEVKDLTGSSFPSYKHNSQLDPIDVSSSSDDENDLPNDDVSNQLVLYDPVANGNNAIELAPDPLQCEPPLLPRSKPSHSVPRALPSVGVFTVQCASCLKWRLIPTKEKYEEIREHIIEQPFVCQKAREWRPDVSCDDPEDISQDGSRVWAIDKPNIAQPPAGWERLLRIRAEGSSKFADIYYIAPSGKRLRSMVEVQKFLMEHPEYTRDGVTLSQFSFQIPRPLQENYVRKRSARLTSSYEVSEPVEHQQVSPLAWVDPEGCGGRLGLPPPPFMGSHDLDTTINMSISRPAKRQATHKGSL

SEQ ID NO: 13679 - protein, 205 aa, Oryza sativa (japonica cultivar-group)
MDAMTKQEILLEKKRVITVQGRDKAGRPIVRIVGKNFPARELGGGGHAEAALKGYVRRRVTPAIGDAEFVVVYMHSGVDRRENFPGVGAVRTAYESMPAAVRERLHAVYFLHPGLQSRLFFSTLGRFLFSSGLYGKLRYVSRLEYLWAHVRKGELDVPEAVRRHDDELEQRPLMDYGIEASERCGVFDAASMDTTASLHSLRCAS

SEQ ID NO: 13680 - protein, 358 aa, Mesorhizobium sp. BNC1
MGNSRRYRIAVIPGDGIGKEVVPEGLAVLEAVAAKYGIEIIFNHFDFASCDYYLRHGRMLPEDWKQQIGSHDAIFFGAVGWPQIVPDHVALWGSLVQFRREFDQYINLRPVRLMEGVPCPLQGRKPGDIDFYVVRENTEGEYSSIGGRIFAGTEREVVMQETVLTRTGTDRVLRFAFQLAAQRKKKHLTSATKSNGISITMPYWDERVEQMARNFPDVIWDKYHIDILCAHLVLHPDWFDVVVASNLFGDILSDLGPACTGTIGIAPSGNINPERTFPSLFEPVHGSAPDIAGLGIANPIGQIWSVSMMLDHLGEPEAAASIVKAMETVLREPKLRTRDLGGTADTRTCGKAVAAAIS

SEQ ID NO: 13681 - protein, 421 aa, Clostridium thermocellum ATCC 27405
MIKNILILSSNNTGHGHKSITESLLEQFSHYPDVNVHVIDGFTLAGNFGLRIGKLYGSVTRNAKELWKLVWELSLKKPSLLNDFTEVAIKDNFLKLICNIKPDLILSVHPNFNGSVLNILEDYNIKVPFVTLLADIVSITPLWADPRADYIICPSKESKFKCLEFGVSESKLIETGFPVRQKFLKHLEKNGENNTQNIKKYTGDRPLECLIMSGGEGSGNMSRIASILLKNFNCRVKIVTGRNRLLKRRLERTIGERFGDRVEIYGFTENIQDLMLSSDIAFTRGSPNVMMEAVACNVPLIITGNLPGQEEGNPAYMQKYNLGVVCKDVRKLRHTVNELLENNGEKLNRIKQSQKEFLNPNVAKEIVSFLLSIDKQEEPCFPEDLFSGDFPRFWELHKRISMSHNKKIILKRHKKIGTKQK

SEQ ID NO: 13682 - protein, 462 aa, Triticum aestivum
  misc_feature (291)..(291): Xaa can be any naturally occurring amino acid
  misc_feature (319)..(319): Xaa can be any naturally occurring amino acid
  misc_feature (354)..(354): Xaa can be any naturally occurring amino acid
MLQRVASGVYGRPAGGRTSDSSGRPGRSLVVLCGELLREAEKLVNMKIHPMTIIAGYRLAAECARNALLKRTMDNKDNTDKFRSDLMNIAMTTLSSKILSQDKEYFAFFAVDAVLRLKGSTNLESIQILKKPGGSLKDSFLDEGFILDKKIGLGQPKRIENANILVANTAMDTDKVKIYGARVRVDSMAKVADIEAAEKQKMREKVEKIIGHGINCFVNRQLIYNFPEELFADAGILAVEHADFEGIERLALVTGGDIAFTFDSPESVKLGHCKLIEEIMIGEDRLIHFSXGVTMGQACTIVLRGASEHVLDEAERALXHDALCVLSQTGTDPRVIFGGGCPEMVMSKEVDELXARKTRGKNSHPIDAFSRALQAIPTILADGAALDSAELISQLRAEHHKVNSTAGIDVISGGLGDMQKRGICEAFKVKQAIVLSATEAAEMILRVDEIITCAPRRREDRM

SEQ ID NO: 13683 - protein, 287 aa, Oryza sativa (japonica cultivar-group)
MDSSNQKFIDLLSQDSPNHAEKTSHNSPPQQFPNNFPQSQFTQSFNPHFLHNFYPFCSPSNYPPYGHSPPSFQGTPPSFQGIPHQGNWAQPNLATLQGFHLQENMVHSPNQGFGTANHQAIFALQYPLVRATVNSSSHGSESSTPCPARQQEAPVNLESSSESSEDEVRRATRTNWTEEENLRLISAWLSNSVDPIDGNDKKGEYYWKDVADEFNNNRPTNGHKRTVKQLKTHWGNVKKDIGKFCGVYAQVRRTCTSGHSDDMIMEKAHLWYKNQSNQKKPFTLEYM

SEQ ID NO: 13684 - protein, 485 aa, Brassica napus
  misc_feature (133)..(133): Xaa can be any naturally occurring amino acid
  misc_feature (136)..(136): Xaa can be any naturally occurring amino acid
  misc_feature (223)..(223): Xaa can be any naturally occurring amino acid
MASVAASPAFSLLKSTGGAIASSTSTRARASLLPITPSSKSISPRPLGFSAVLDSHRFSLHVASKVHSVRGRGTRGVVSMAKKSVGDLTSADLKGKKVFVRADLNVPLDDNQTITDDTRIRAAIPTIKYLIEXGAXVILSTHLGRPKGVTPKFSLAPLVPRLSELLGIEVKKADDFIGPEVESLVASLPEGGVLLLENVRFYKEEEKNDPEFAKKLASLADLXYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLAKAKAKGVSLLLPTDVVVADKFAPDANSKVVSASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIAVTV

SEQ ID NO: 13685 - protein, 394 aa, Ammophila arenaria
EPASTEDPAVSIAGAVQSQKLAVRAISRLQALPGGDVNLLCDTVVEHVRELTGYDRVMVYKFHDDEHGEVLAESRRADLEPYLGLHYPATDIPQASRFLFRQNRVRMIADCHAAPVRVIQDPAMPQPLCLVGSTLRSPHGCHAQYMANMGSIASLVMAVIISSGGEDEHSMGRGAVPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGITPTEAQIKDIIEWLTVCHGETTGLSTDSLADAGYPGATALGDAVCGVAVAYITPSDYLFWFRSHTAKEIKWGGAKHHPEDKDDGQRMHPRSSFKAFLEVVKSRSLPWENAEMDAIH

SEQ ID NO: 13686 - protein, 394 aa, Anisopogon avenaceus
EPARTEDPALSIAGAVQSQKLAVRAISRLQALPGGDVKLLCDTVVEHVRELTGYDRVMVYKFHDDEHGEVLAESRRADLEPYLGLHYPATDIPRASRFLFRQNRVRMIADCHAAPVRVIQDPAMPQPLCLVGSTLRSPHGCHAQYMTNMGSIASLVMAVIISSGGDQDHNIARGAIPSAMKLWGLVVCHHTAPRCIPFPLRYACEFLMQAFGLQLNMELQLAQHLSQNLILTTQTLLCDMLLRDSPTGIVPQSRSIMDLVKCDGAALYYHGKYYPLGVTPTEAQILDIIEWLTVCHGDSTGLSTDSLADAGYPGAASLGDAVCGMAVAYITPSDHLFWFQSHTAKEIKWGGAKHHPEDKDDGQRMHPRSSFKAFLEVVKSRSLPWENAEMDAIH

SEQ ID NO: 13687 - protein, 394 aa, Anomochloa marantoidea
EPARTEDPALSIAGAVQSQKLAVRAISRLQALPGGDVKLLCDTVVEHVRELTGYDRVMVYKFHDDEHGEVVAESRRADLEPYLGLHYPATDIPQASRFLFRQNRVRMIADCHAAPVRVIQNPSLTQPLCLVGSTLRAPHECHAQYMANMGSIASLAMAVIISSSGDDENNVGRCGISSTMKLWGLVVCHHTSPRCIPFPLRYACEFLMQAFGLQLNMELQLAHQLSEKHILRTQTLLCDMLLRDSPTGIATQSPSIMDLVKCDGAALYYHGKYYPLGVTPTESQIKDIIEWLGMCHGDSTGLSTDSLADAGYPGAASLGDAVSGMAVAYITPNDYLFWFRSHTAKEIKWGGAKHHPDDKDDGQRMHPRSSFKAFLEVVKSRSLPWENAEMDAIH

SEQ ID NO: 13688 - protein, 435 aa, Desulfovibrio desulfuricans G20
MSRNTELHLTVGVDEPVSPLKAFALGLQHVLAMDVYIAPFVMAGLLSLSVPETATFIQMTFVAAGLATLIQAGFGIRLPVMQGPSYVPIGALAAIGNSLGLGAMFGSLLPGALVMTLLGKPLRVFSRIVRFFIPPLVGGTVIVIVGIALMPVALKGCYGYFGDPAHNAVVALVSAAVLVVLTVAGSRPGRFNQVVRMGSVVFSMAAGTLTAAAFGMVNFDSVAAAPWLALPVIFPYGTPHIDVSAALTLVFIYLVVLVETTGTWFAVEAVTGSRLDDERINGGTFGEGVGCFLGAMLGGTPVTGYSTNAGIIAITGVASRWAIMAGGGILLVLGMVPKLMNVIASIPGPVISGVFAVICVVIAMNGFRVVRTVTLSERNMLVMGLPILLTLAAVFMPAELRDRLPALVRYLVESGIAVGAVSAVVLNLILPKDAE

SEQ ID NO: 13689 - protein, 393 aa, Arundinella hirta
EPARTEDPALSIAGAVQSQKLAVRAISRLQALPGGDVKLLCDTVVEHVRELTGYDRVMVYRFHEDEHGEVVAENRRDNLEPYLGLHYPATDIPQASRFLFRQNRVRMIADCHATPVRVIQDPGLSQQLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAVALGDAVCGMTVAYITPSDYLFWFRSHTAKEIKWGGAKHHPEDKDDGQRMHPRSSFKAFLEVVKSRSLPWENAEMDAIH

SEQ ID NO: 13690 - protein, 295 aa, Listeria innocua Clip11262
MEKKVGTDRVKRGMAQMQKGGVIMDVVNAEQAKIAEEAGAVAVMALERVPSDIRAAGGVARMADPRIVEEVMNAVSIPVMAKARIGHITEARVLEAMGVDYIDESEVLTPADDEFHLLKSDFTVPFVCGCRDIGEALRRIGEGAAMLRTKGEPGTGNIVEAVRHMRQVNGQIRQIASMTDDELMVAAKNFGAPYELVKEIKTLGKLPVVNFAAGGVATPADAALMMELGADGVFVGSGIFKSDNPAKFASAIVQATTYYTDYELIGKLSKELGSPMKGIEMSRLNPEDRMQDRSF

SEQ ID NO: 13691 - protein, 258 aa, Oceanospirillum sp. MED92
MCLITFAYKSHPEYSLILIANRDEFYQRPSQPMHFWDDHNEILAGRDLEQLGTWLGFNTAGKFTAVTNYRDGRNPAKNRRSRGELTANFLKCQQSADEYLLQLEQNKQEFGDFNLLVADQTGLYYCSNRGAETHELKPGIYGMSNALLDTPWPKLQRVKQDLTNAINSSALTAEHLMGIMGNRETAPDKDLPDTGISLNWERLLSSSFIQADNYGTRATTLVMQKPNGDTTVIEQGFDVGGPLARSEYKLPLPAIGVS

SEQ ID NO: 13692 - protein, 757 aa, Oceanospirillum sp. MED92
MLDVLRKIVQEVSVAPNLESVLNLIVTSVQRSMKTEVCSVYLFDPSDQRYVLMASEGLNPEAVGSVRLSAAEGLVGLVVDRAEPINLENASEHRAFKYVESTGEERFNSFLGVPIIHHRDVLGVLVVQQRDLRRFDESEEAFLVTLSAQLAGVIAHAEATGSLGTIGEQEKAVVDLRFEGVAGSSGVAIGSATVIAPPADLSSVPDKPAKDVAKEIASFEEALKLVRRDIKVVGRSLAQRLRTEEQALFDVYLRMLDDNALAGEVVARIEKGNWAQGALREVVTEHVRQFSMMDDPYLRERATDIKDLGRRVLAYLQEAAPASLEFTDETILVADELTPAMLGEVPSEKLVGLVSVHGSSNSHAAILARSMGIPTIMGAVDLPLTRIDGRQLILDGYSGRIYVQPGEDLLTAYQDIVKGEKEQAEELAALKDLPAETTDGFRMPLWVNTGLIADVARSLERGAEGIGLYRTEVPFMIRDFFPSEQEQAQTYRKQLEAFHPRPVTMRTLDIGGDKALPYFPIEEENPFLGWRGIRVTLDHPEIFLVQVRAMLKAGEGYENLRIMLPMVTSVREVEEANRQIDRAVRELQEEGHNIKRPLVGVMVEVPAAVYQVRRFARRVDFISVGSNDLTQYLLAVDRNNPRVADLYVSYHPAVLKALEYIAREAHKENASVSICGEVASEPGGALLLMAMGYDVLSMNATNLPKVKAAIRKITKTDADRLLKDVMSMDDADRIQALINERLDELGIALPAQPNIPN

SEQ ID NO: 13693 - protein, 313 aa, Zea mays
  misc_feature (277)..(277): Xaa can be any naturally occurring amino acid
MQTPARLSAPSSPLVSSAPPIPVRPQRVAFPSLRRRDLLLLPAALTLPTAPAPLPASARGLFRMPPPRLVNRYFLVRAGESVYEGQGLLRTNPVAKTSVDRGLSPVGLRQTARAALELQRLGACEDDCWIWPSITQRAYQAAEIIAAANGVNRRRQKARGIPFSQKKLGSMRILNYIAFDCSRIVPEYSFLDARGLGAFEWKSLDTLPEVYASDNISPDLKPPPIRDGTPNESVADVFVRVTQLMSILETQYSGETVVIVSPDSDNLSILQAGLIGXDLRRVRSVSEVFGYGFWGSLLGFSSWINFCRAREIG

SEQ ID NO: 13694 - protein, 598 aa, Zea mays
MVVVAMAVMQGQAGATRVAVSLVLLLLASLTGGSPPPEPVSCARGTSDCTVTSTYGSFPDRAVCRAANATFPRTEKELVAAVAAAAASRRKVKVATSHSHSFPKLACPGGRDGTIISTERLNRTVRVDAARRLLTVESGMLLRDLVRAAADAGLALPHSPYWYGLTVGGLLATGAHGSSLWGKGSAVHEYVVALRIVTPAPASQGFAVVRELVAGDPDLDAAKVSLGVLGVISQVTFELQPQFKRSVTFVTRDDKDMAEKLSVWGGLHEFGDVSWLPRQGKAIYREDDRVDVSTPGNGLNNYIGFRAQPTLGLLTARKAEERLEENGTDVARCLAARLPAATFELQAYGFTNDGFFFTGYPVVGFQHRIQASGTCINGADDGLLSACTWDSRVRGPFFYQSGFSVAMPKVPAFVADMQRLRDLNPRAFCGMDAKMGVLMRYVRASSAYLGKAEDSLDFDVTYYRSYDEGTPRKHADVFDELEQMALRKYGALPHWGKNRNFAFDGVIARYPAAARFLEVKDRYDPDGIFSSEWSDQVLGIRGSPNVVGPGCAIEGLCVCSDDLHCAPEQGYFCRPGKVYTDARVCALERRRTRLVDEL

SEQ ID NO: 13695 - protein, 440 aa, Arabidopsis thaliana
  misc_feature (420)..(420): Xaa can be any naturally occurring amino acid
MVRRQEEEKKAEKGMRLGKYELGRTLGEGNFGKVKFAKDTVSGHSFAVKIIDKSRIADLNFSLQIKREIRTLKMLKHPHIVRLHEVLASKTKINMVMELVTGGELFDRIVSNGKLTETDGRKMFQQLIDGISYCHSKGVFHRDLKLENVLLDAKGHIKITDFGLSALPQHFRDDGLLHTTCGSPNYVAPEVLANRGYDGAASDIWSCGVILYVILTGCLPFDDRNLAVLYQKICKGDPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVKQEERNQKGQVGLSVTAEVFEIKPSLNVVELRKSYGDSXLYERLLKDVGTSSPEQEIVT

SEQ ID NO: 13696 - protein, 399 aa, Bacillus anthracis str. Ames
MLANQINERSLLLHKELVGKIEITSKVEVNSADDLSLTYTPGVAESCKAIAADEETVYDYTARGNMVAVVSDGTAVLGLGNIGPKAAMPVMEGKSILFKKFANVDAFPLCLGTTDVDEIVTLVKNLEPTFAGINLEDIAAPRCFEIEKRLKEETNIPVFHDDQHGTAIVVLAAVINALKVVSKQMDHVKIVINGAGSAGIAIGKLLLKAGAQHITLVSLEGIVCEGEAWMNEAQIEVSKKTNREHVRGTLKEAIHQADIFIGVSAPNVLTKELVQMMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVAQIMKIPSY

SEQ ID NO: 13697 - protein, 336 aa, Streptomyces mycarofaciens
MTVVGPFGLSVRDQALEADVQAGLVAVEEGLLEATKSEVPFITEAAQHLVRAGGKRFRPLLVMLSAQFGDPYAPGIVPSAVVVELTHLATLYHDDVMDEASVRRGVPSANTRWGNSVAVLTGDFLFARASQILADLGPEAVRVQALAFERLVTGQILETAGPQDGRDPVDHYLDVLGGKTGSLVAVSCRFGAMMSGADETVVDVLTQYGERLGVAFQLADDVLDIASDSHESGKTPGTDLREGIPTLPVLRLRERAARLGLAEDVALCELLDSDLSDDARHAEALRLLRAHPALEQARKDTVRYAKDARAALAPLRECEAKSALVELCDAVVHRAG

SEQ ID NO: 13698 - protein, 336 aa, Streptomyces lividans
MTVVGPFGLSVRDQALEADVQAGLVAVEEGLLEATKSEVPFITEAAQHLVRAGGERFRPLLVMLSAQFGDPYAPGIVPSAVVVELTHLATLYHDDVMDEAAVRRGVPSANTRWDNSVAVLTGDFLFARASQILADLGPEAVRVQALAFERLVTGQILETAGPQDGRDPVDHYLDVLGGKTGSLVAVSCRFGAMMSGADETVVDVLTQYGERLGVAFQLADDVLDIASDSDESGKTPGTDLREGIPTLPVLRLRERAARLGLAEDLALCELLDSDLSDDARHAEALRLLRAHPALEQARRDTVRYAEEARAALAPLRECDAKAALVELCDAVVHRAG

SEQ ID NO: 13699 - protein, 136 aa, Coprinopsis cinerea okayama7#130
MRAIARAHQNRNLADFEKALREYKDELSSDPTIRSHLAALYDTLLQQNLLRIFEPYSVVEIAHVAELVGQERQGVEAKLSQMILDKVFNGVLDQGRGCLLVFDPQEVDNMYGPAIETLEEVGKVVQSLYAKTVKIA

SEQ ID NO: 13700 - protein, 336 aa, Streptomyces maritimus
MTVVGSFGLSVRDQALEADVQAGLVAVEEGLLEATKSEVPFITEAAQHLVRAGGKRFRPLLVMLSAQFGDPYAPGIVPSAVVVELTHLATLYHDDVMDEAAVRRGVPSANTRWDNSVAVLTGDFLFARASQILADLGPEAVRVQALAFERLVTGQILETAGPQDGRDPVDHYLDVLSGKTGSLVAVSSRFGAMMSGADETVVEVLTQYGERLGVAFQLADDVLDIASDSDESGKTPGTDLREGIPTLPVLRLRERAARLGLAEDLALCELLDSDLSDDARHAEALRLLRAHPALEQARRDTVRYAEEARAALAPLRECDAKAALVELCVTVVHRAG

SEQ ID NO: 13701 - protein, 255 aa, Glycine max
GSRCVLAGDHLQLPPTIQSVEAEKKGLGRTLFERLAEVYGDEITSMLTVQYRMHELIMDWSSKELYNSKIKAHPSVTAHMLYDLEGVKRTTSTEPTLLLIDTAGCDMEEKKDEEDSTFNEGEAEVTVAHAKRLVQSGVIPSDIGIITPYAAQVVLLKMLKNKEDRLKDVEISTVDGFQGREKEAIIISMVRSNSKKEVGFLSDHRRMNVAVTRSRRQCCLVSDTETVSGDGFLKRLIEYFEEHGEYLSASEYQNE

SEQ ID NO: 13702 - protein, 394 aa, Brachypodium pinnatum
EPARTEDPALSIAGAVQSQKLAVRAISRLQALPGGDVKLLCDTVVEHVRELTGYDRVMVYKFHDDEHGEVLAESRRTDLEPYLGLHYPATDIPQASRFLFRQNRVRMIADCHAAPVRVIQDPAMPQPLCLVGSTLRSPHGCHAQYMANMGSIASLVMAVIISSGGEDEHNMGRGAIPSAMKLWGLVVCHHTSPRCIPFPLRYACEFLMQAFGLQLNMELQLAYQLSEKHILRTQTLLCDMLLRDSPTGIVTQSPSIMDLVKCDGAALYYHGKYYPLGVTPTEVQIKDIIEWLTVSHGDSTGLSTDSLADAGYSGATALGDAVCGMAVAYITPSDYLFWFRSHTAKEIKWGGAKHHPEDKDDGQRMHPRSSFKAFLEVVKSRSLPWENAEMDAIH

SEQ ID NO: 13703 - protein, 394 aa, Buergersiochloa bambusoides
EPARTEDPALSIAGAVQSQKLAVRAISRLQALPGGDVKLLCDTVVEHVRELTGYDRVMVYRFHDDEHGEVVAESRRADLEPYLGLHYPATDIPQASRFLFRQNRVRMIADCHAAPVRVIQDSALPQPLCLVGSTLRGPHGCHAQYMANMGSIASLVMAVIISSGGDDEHNSAQGGIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYLLDVTPTEAQIKDIIEWLTLCHGDSTGLSTDSLADAGYPGAAALGDAVCGMAVAYITPSDYLFWFRSHTAKEIKWGGAKHHPEDKDDGQRMHPRSSFKAFLEVVKSRSLPWENAEMDAIH

SEQ ID NO: 13704 - protein, 393 aa, Capillipedium parviflorum
EPARTEDPALSIAGAVQSQKLAVRAISRLQALPGGDVKLLCDTVVEHVRELTGYDRVMVYRFHEGEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIH

SEQ ID NO: 13705 - protein, 386 aa, Chasmanthium latifolium
PALSIAGAVQSQKLAVRAISRLQALPGGDVKLLCDTVVEHVRELTGYDRVMVYRFHEEEHGEVVAESRRDGLEPYLGLHYPATDIPQASRFLFRQNRVRMIADCHATAVRVIQDPGLSQPLCLVGSTLRAPHGCHAQYMANMGSIASLVMAVIISSGGDDEQTSRGGMSSAMKLWGLVVCHHTSPRFIPFPLRYACEFLMQAFGLQLNMELQLAHQLSEKHILRTQTLLCDMLLRDSPTGIVTQSPSIMDLVKCEGAALYYHGKYYPLGVTPTESQIKDIIEWLMLCHRDSTGLSTDSLADAGYVSAAALGDAVCGMAVAYITPSDYLFWFRSHTAKEIKWGGAKHHPEDKDDGQRMHPRSSFKASLEVVKSRSLPWENAEMDAIH

SEQ ID NO: 13706 - protein, 850 aa, Debaryomyces hansenii CBS767
MSETKLEDKSDFIRVDLKDESTALHEDYKHKLYEKLGHSDVLTDDTSIPEIEYLFQKTDELPLPKALDILKQCLQDHDDDPNFPYDDFEFIQKIVNGYNNDLRMSYDDWVFNVKMYAALNEYHSPYPEVRAISSPLDDPNIPCETIRAYILGFFWCVVGTGVNELFSRRQPSIYLSASVCQMLMYPSGLALEYVLPDWGFTLFGTRHSLNPGPWTYKEQMFATVMFDIAIGGMYVGYNFYVEKLNIFYGNTWITAGYQILLSLCTQLFGFGFAGILRKIVIYPVRAVWPTILPTLALNRALLKKEKKESIHGWTITRYKFFFIVFTCSFLYMWVPDYLFQALSYFNWMTWIKPDNFNLATVTGSIQGLGLNPISSFDWNIIGYWLPLAFPFYTYLNMMIGMFIGFFVIIGLYYSNYKWTAYLPINDNNIYTNTGTIYEVQSVLTNGRLDEDKYKKYGPPYLSAANLVVYGANCALYTFMVPYVFFTERKGIWNSIKSLKELITDFRSSNYSRFKDPHSRMMSNYKEVPDWCFLVIMLIALVFAIVCVKVYPANTPVWGIFLVLGINAVFVIPLCIIYAVTGYYFTLEVLVELIIGYALPGNGDALMFLKALGFNITGQAQQYVYDQKMAHYAKVPPRAVFRGQLLGTIFQIIVSLLVINWEISNIDGICTDEQSNNFTCPSEVSYYSSSVFWGVIGPKRVFNKLYPVLPYCFLIGFLLALVCLAVRHYFYKQTRWFQPAVIIGGLFNYAPYNLSYFLPGLYMCFAFNHYIKKRFGAWWEKYNYILSSSLDAGVAFGGIIIFFAVQYHEKDINWWGNSVSYAGTDGGMGQVSLLDPTTAPDGYFGLRSEEF

SEQ ID NO: 13707 - protein, 393 aa, Chusquea oxylepis
EPARTEDPALPIAGAVQSQKLAVRAISRLQALPGGDVKLLCDTVVEHVRELTGYDRVMVYRFHDDEHGEVVAESRRADLEPYLGLHYPATDIPQAPRFLFKQNRVRMIADCHAASVRVIQGPALPQPLCLVGSTLRAPHGCHAQYMANMGSIASLVMAVIISSGGDDEHNMTRGGIPSAMKLWGLVVRHHTSARCIPFPLRYACEFLMQAFGLQLNMELQLAHQLSEKHILRTQTLLCDMLLRDSPAGIITQSPSIMDLVKCDGAALYYHGKYYPLGVTPTEAQIKDIIEWLTLCHGDSTGLSTDSLADAGYPGAALGDAVCGMAVAYITPSDYLFWFRSHTAKEIKWGGAKHHPEDKDDGQRMHPRSSFKAFLEVAKSRSLPWENAEMDAIH

SEQ ID NO: 13708 - protein, 584 aa, Saccharomyces cerevisiae
MGIHIPYLTSKTSQSNVGDAVGNADSVEFNSEHDSPSKRGKITLESHEIQRAPASDDEDRIQIKPVNDEDDTSVMITFNQSLSPFIITLTFVASISGFMFGYDTGYISSALISIGTDLDHKVLTYGEKEIVTAATSLGALITSIFAGTAADIFGRKRCLMGSNLMFVIGAILQVSAHTFWQMAVGRLIMGFGVGIGSLIAPLFISEIAPKMIRGRLTVINSLWLTGGQLVAYGCGAGLNYVNNGWRILVGLSLIPTAVQFTCLCFLPDTPRYYVMKGDLARATEVLKRSYTDTSEEIIERKVEELVTLNQSIPGKNVPEKVWNTIKELHTVPSNLRALIIGCGLQAIQQFTGWNSLMYFSGTIFETVGFKNSSAVSIIVSGTNFIFTLVAFFSIDKIGRRTILLIGLPGMTMALVVCSIAFHFLGIKFDGAVAVVVSSGFSSWGIVIIVFIIVFAAFYALGIGTVPWQQSELFPQNVRGIGTSYATATNWAGSLVIASTFLTMLQNITPAGTFAFFAGLSCLSTIFCYFCYPELSGLELEEVQTILKDGFNIKASKALAKKRKQQVARVHELKYEPTQEIIEDI

SEQ ID NO: 13709 - protein, 393 aa, Danthoniopsis dinteri
EPASTEDPALSIAGAVQSQKLAVRAISRLQALPGGDVKLLCDTVVEHVRELTGYDRVMVYRFHEDEHGEVVAESRRDDLEPYIGLHYPATDIPQASRFLFRQNRVRMIADCHATPVKVIQDTGLSQPLCLVGSTLRAPHGCHAQYMANMGSIASLVMAVIISSGGDDEQTARGGISSAMKLLGLVVCHHTSPRFIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTLCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIH

SEQ ID NO: 13710 - protein, 542 aa, Striga asiatica
MAKGAAETLKLNMALILLPVCRNTITWLRNRTKLGVAVPFDDNLNFHKVIAIAISLGVGIHAISHLTCDFPRLLAATPKEYEPMEQFFGKQATSYWHFVLSWEGITGVVIVVLMAIAFTLATPWFRRNRVDLPRPFNKLTGFNAFWYSHHLFVIVYALLIIHGIKLYLTHEWYKKTTWMYLTVPIMLYAGERLIRAFRSSIKAVKILKVAVYPGNVLALHMSKPQGFKYKSGQYIFVNCAAVSPFEWHPFSITSAPRDDYVSVHIRTLGDWTRQLKAVFAEVCQPPPTGKSGLLRADFMQGENNPNFPRVLIDGPYGAPTQDYKDYDVVLLVGLGIGATPMISVVKDIVNNIKAMDEEEGGATRGSTPNASPLSTPRRKSGSDRRDFKTRRAYFYWVTREQGSFDWFKGVMNEVSEMDHKGVIEMHNYCTSVYEEGDARSALITMLQSLNHAKNGVDVVSGTRVKSHFAKPNWRTVYKRIALNHPTARVGVFYCGAPPPVKELRQLASDFSHRTTTSSNSTKKLLTSSAKLTKICFYPMLRI

SEQ ID NO: 13711 - protein, 399 aa, Candida albicans SC5314
MKFTKPTPIQSEAIPHALEGKDIIGLAQTGSGKTAAFAIPILQSLWHAQQPYFALVLAPTRELAFQIKDTFDALGSSMGLRSSCIVGGMDMMDQARDLMRKPHVIVATPGRIMDHLEHTKGFSLKNLKYLVMDEADRLLDMDFGPALDKILKVIPIKRTTYLFSATMTNKIEKLQRASLHNPVRVAVSSKYQTADNLVQSMMLVNDGYKNTILIHLLNEFMGKSIIVFTRTVAHAQRTALLARILGFNAVPLHGQLSQSQRLGSLNKFKSNQANILVATDVAARGLDIPSVDVVINYDIPTDSKAYIHRVGRTARAGRSGKSISLITQYDLEMYLRIESVLGKKLPKEDKPPKEVLDALHVHVDKATAEAIRQTKEIHDKRNGGGGRRRNRDDADREER

SEQ ID NO: 13712 - protein, 394 aa, Diarrhena obovata
EPARTEDPALSIAGAVQSQKLAVRAISRLQALPGGDVKLLCDTVVEHVRELTGYDRVMVYKFHDDEHGEVLAESRRADLEPYLGLHYPATDIPQASRFLFWQNRVRVIADCHAAPVRVIQDPAMPQPLCLVGSTLRSPHGCHAQYMANMGSIASLVMAVIISSGGEDEHNMARGAIPSAMKLWGLVVCHHTSPRCIPFPLRYACEFLMQAFGLQLNMELQLAHQLSEKHILRTQTLLCDMLLRDSPAGIVMQSPSIMDLVKCDGAALYYHGKYYPLGVTPTEAQIKDIIEWLTVCHGDSTGLSTDSLADAGYSGATALGDEVCGMAVAYITPSDYLFWFRSHTAKEIKWGGAKHHPEDKDDGQRMHPRSSFKAFLEVVKSRSLPWENAEMDAIH

SEQ ID NO: 13713 - protein, 576 aa, Debaryomyces hansenii CBS767
MTNTEPNTESLTVEAGVNDNVSTSNSTTNYGTEPQGTHEKLENYGDIEKHEIPDNEGQIPTADEILNKLPVMPERSTKDQLSSIVLCFFIAFGGFIFGFDTGTISGFTNMPDYIDRFGLQDANGDSKTYKIGLIVAIFNVGCAFGCIFLSKIADVYGRRIGLMFAMIVYIVGIIIQISAQSSWIQIVFGRLIAGFAVGTVSVLSPLFISETSPKAYRGTLVCCFQLCVTFGIFIGYCINYGTYHNFNDSRQWRISLGLSFAWAIFLFIGMVFLPESPRYLIEKGKIEEAKKSISFSNGVSPEEPGVYTEIQLIQSGIDREKLAGNASWGQLVVGKPRILMRVITGVMLQSLQQLTGNNYFFYYGTYIFDAVGLSDSFQTSIVLGVVNFASTFVGIYAIEKLGRRLCLLSGGVAMAICFLIYSVLGTVGDVHIKPQGNAQIFITTLFIFFFASTWAGGVYSIVSEIYPLRIRSKAMAVATAGNWTWGFLISFFTTAITNEIQFAYGFVFFGCICFGTVFTYFFVYETKGLSLEEVDQLYASGIPAWKSSSWKVPSQEDMAFSAGYAAKDKPEDKRQE

SEQ ID NO: 13714 - protein, 394 aa, Ehrharta erecta
EPARTEDPALSIAGAVQSQKLAVRAISRLQALPGGDVKLLCDTVVEHVRELTGYDRVMVYRFHEDEHGEVVAESRRNDLEPYLGLHYPATDIPQASRFLFRQNRVRMIADCHAAPVRVIQDPGLPQQLCLVGSTLRSPHGCHAQYMANMGSIASLVMAVIISSAGDDENNMARGGIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYPGSAALGDAVSGMAVAYITPSDYLFWFRSHTAKEIKWGGAKHHPEDKDDGQRMHPRSSFKAFLEVVKSRSLPWENAEMDAIH

SEQ ID NO: 13715 - protein, 394 aa, Elymus sp. Kellogg s.n.
EPARTEDPALSIAGAVQSQKLAVRAISRLQALPGGDVKLLCDTVVEHVRELTGYDRVMVYKFHDDEHGEVLSESRRGDLEPYLGLHYPATDIPQASRFLFLQNRVRMIADCHAAAVRVIQDPAMPQPLCLVGSTLRSPHGCHAQYMANMGSIASLVMAVIISSGGEDEHNMTRGVIPSAMKLWGLVVCHHTSPRCIPFPLRYACEFLMQAFGLQLNMELQLAHQLSEKHILRTQTLLCDMLLRDSPTGIVTQTPSIMDLVKCDGAALFYHGKYYPLGVTPTESQIKDIIEWLTVCHGDSTGLSTDSLADAGYPGATALGDAVCGMAVAYITPSDYLFWFRSHTAKEIKWGGAKHHPEDKDDGQRMHPRSSFKAFLEVVKSRSLPWENAEMDAIT

SEQ ID NO: 13716 - protein, 283 aa, Pseudomonas syringae pv. phaseolicola 1448A
MSGCSPLKLLNTLNPTGPVDHVYGVAYGQDPRNTLDVYTPQTKPANAPVVVFFYGGSWNTGSKANYAFVGEALAARGMVVVIADYRLYPQVRYPSFLEDSAKALAWAHKHAKTYGGDPDRLYVMGHSAGAYNAAMLALDPRWLAREGLSPSILSGWIGLAGPYDFLPIENADVKPVFFFPDSPPDSQPINHVSSSAPPALLMASNTDSLVNPKRNTGGLARALREAGVPVRDLYFSRTNHGTLVGAFAKLLSGLAPVVDEVDMFVNHTPPRLAEKNRAALKTQ

SEQ ID NO: 13717 - protein, 728 aa, Arabidopsis thaliana
MHSSSKSQAFSLTFLLFLFLLPSVSESQLISSESRTLLEIQKHLQYPPTLRSWSNWTNFCYLPSSPSFKILCFNGHVTELTVTGNRTVKLPGRFSSDSLFTVLTKLSNLKTLSLVSLGISGPLPSQIIRLSSSLQSLNLSSNFISGNIPKEISSLKNLRSLVLANNLFNGSVPDLRGLSNLQELNLGGNKLGPEVVPSLASNLITISLKNNSFGSKIPEQIKKLNKLQSLDLSSNKFTGSIPRFLLSLPSLQNLSLAQNLLSGSLPNSSLCNSKLRILDVSRNLLTGKLPSCFSSKKQTVLLFTFNCLSINGSPSAKYQRPVTFCENEAKQAVAAVKSDTKDKERKEEDTGIELGLVIGIIIGVILVSAVLAGLVLVRMRKSRSKEEPLEANNVDQVTVCSNTTRSTTSKTVPDLRRVPQTMRSAVIGLSPYRVFSLEELEEATNNFDAENLCGEQLYKGCLREGIAVTVRCIKLKQKNSTQNLAQQMEVLSKLRHMHLVSVLGHCIGTYQDHHPYAGSTIFIVQEYISNGSLRDYLTDWRKKEVLKWPQRMSIAIGVARGIQFLHTGVAPGIFGNNLEIENVLLDETLTVKLSGYSIPLPSKVGAESPSNEDGEKEDVYQFGVILIQIITGKVIAAASSELGSLKLQLENSLRDEPSVLRSLADPCVRGTYAYESLRTTVEFAINCLCEDQRKRPSIEDVVWNLQYTIQVQQGWTSSENLGLGGSEL

SEQ ID NO: 13718 - protein, 294 aa, Rickettsia prowazekii str. Madrid E
MYNIFKGLITALITPFKDNKLDLYALENILNQQIKHKIDAVLIAGSTGEANSLSFEEYKLLLKTSVDIVNNRMPIISGCSSNNTAYAIELAIESKKIGVDCFMASPPSYVKPTQHGIYKHFEALHEACNLPIMLYSAPTRSGVDFSDETILRLSKLPRILALKDCGVDLERPMRIRAIVKGDFNILTGNDEVVLAFHAQGVVGWISVTSNIAPKLCKELLEKWYNNDTQGALEIHQKLLPLYKALFLESNPIPVKYAAYYLGLCENEIRLPLTEASDSAKKQIKKIITSLSIKI

SEQ ID NO: 13719 - protein, 741 aa, Arabidopsis thaliana
MASTSSLALSQALLARAISHHGSDQRGSLPAFSGLKSTGSRASASSRRRIAQSMTKNRSLRPLVRAAAVETVEPTTDSSIVDKSVNSIRFLAIDAVEKAKSGHPGLPMGCAPMAHILYDEVMRYNPKNPYWFNRDRFVLSAGHGCMLLYALLHLAGYDSVQEEDLKQFRQWGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPDDVKSHWSRHTPEGATLESDWSAKFAAYEKKYPEEASELKSIITGELPAGWEKALPTYTPESPGDATRNLSQQCLNALAKVVPGFLGGSADLASSNMTLLKAFGDFQKATPEERNLRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPHLPGTSIEGVEKGGYTISDDSSGNKPDVILIGTGSELEIAAQAAEVLRKDGKTVRVVSFVCWELFDEQSDEYKESVLPSDVSARVSIEAASTFGWGKIVGGKGKSIGINSFGASAPAPLLYKEFGITVEAVVDAAKSFF

SEQ ID NO: 13720 - protein, 467 aa, Oryza sativa (japonica cultivar-group)
MEEPPGKKGPAMDPAQDSGRDWLSGLPEGVLHRIMSFLDSRQAVRTCVLSRRWRDLWRSVPRVHADICDLIPDRIIDVEGEKAKMVVFNSFVNRLLERRDPTASIETFFCRCCIPDEDGHGSADANRWISYGLQKNAWFLEVVMLLKPLELDPSVFSSIYLRRIAFDNVFMDQGFFKQLQMGCPALERFDLDGCIVADDEISSNTLKVLTFDTTKFCYEYRISISTPTVTTLGLRNTIGGKPVLKDVASLVSASVVLYCVETSDFDANDLRHYLWSFSHVKDLIFSYQGKKPHNHSSLVQLTIENNLQWCPKFFNLVGLTLGKWCLNANFYALIVFLQNSPRLEKLTLILAEDNWKTTEVFIGDLEERSFTCEHLTSVEVKCWEDDPLVNVVDFFVGSGMSSAQIHIEYEDNDEDQFHIESDNMVGFELEDEDEDEDEDEDEDEDEDDEDEDGDEDEQRSLFQSKDV

SEQ ID NO: 13721 - protein, 978 aa, Bacillus anthracis str. Ames
MAEQTVRVTVDGKEFSASGEKTILQLFNESNLEHPQICHVPEVDPIQTCDTCIVEVDGKLMRACSTQIENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDHGVSINDSSCVSCGQCVTVCPCNALMEKSMLGEAGFMTGLKPDVLDPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDMFVEASWEEALEVVASNMQHIKSAYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHEQKLIVADLRKHEMAERADLFIHPRQGTDYVWLAGITKYIIDQDWHDKKFIAENVKNFDEYSKMVEKYTLDYTEKITGISKENLKEMARMVYEADGTCVLWGMGVTQNTGGSTTSAAISNLLLVTGNYRRPGAGAYPLRGHNNVQGACDMATLPNWLPGYQAVSDDTLRAKFEKAYGTTIPKAPGLNNIAMLLAAEEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYESPSEIMDEIASLAPLYSQATYDRLEGWNSLCWGSHDGSDTPLLYVDGFNFPDKLARLSLDEWIPPVVAPDEYDLLLNNGRMLEHFHEGNMTNKSAGILSKVSEVFVEISPELAIERNVKDGGLVELASPFGKIKVQALITDRVTGKELYLPMHATINEEAINILTGTATDLYTCTPAYKQTMVKMRVLREKGNRPLPPSNPRDKNRNPQNGVEIEQKWQRKQYVSLVD

SEQ ID NO: 13722 - protein, 146 aa, Hordeum vulgare
MAARLMLVAALLCAATAMATAQQANNVRATYHYYRPAQNNWDLGAPAVSAYCATWDASKPLSWRSKYGWTAFCGPAGPLGQAACGKCLRVTNPATGAQITARIVDKCANGGLDLDWDTVFAKIDTNGIGFQQGHLNVNYQFVDCRD

SEQ ID NO: 13723 - protein, 988 aa, Oryza sativa (japonica cultivar-group)
MGTRRRRHQHHGRWVVPAVAPAAAAFTAAGLLLVVVAFHCFLSPPLGGGGGGGGGHRVVRRPNPPFLSGGSKLGEELWASKLASNFFGCSNATKAFADAKAVTEPNRYLMIATSGGLNQQRTGIIDAVVAARILNATLVIPNLDQKSFWKDASDFADIFDVESFISSLSNDVKIIRQVPDRNGKTPYPYKMRIPRKCTAKCYENRVLPALLKKHVVQLTKFDYRVSNRLETNLQKLRCRVNYHALQFTDPILKMGEMLVQRMRAKSGRFIALHLRFEPDMLAFSGCYFGGGEIERRELGAIRKRWKTLHASNPDRERRHGKCPLTPEEVGLMLRALGFGKDVHIYVASGEVYGGEETLAPLKALFPNFHSKETLASKEELAPFLSFSSRMAALDYIVCDKSDVFVTNNNGNMARMLAGRRRYFGHKRTIRPNAKKLYSLFLNRTSMSWETFSSKVQTLQKGFMGEPNEIKPGRGEFHEHPMDCICAKTKGRSGHSKPHPSNRIGEAMEKRANDGEFDWRDLDYGENTPLGRDSSNETDSDMHELEDMTCRNQCGLLTENTETDLRVFYMHFYDDDDDDDDLITDWWDQEELSDDDDYYIAAALLTDIEHKRTKRKRRGSVPGREIIHRDRFAGNLRIVADYFADPPVYSAKLFRRRFRMSRELFLRIVASVEAHDDYFRQRPNAVGLLGATALQKVYGAICMLAYDIPADSLDEVVRISESTMIEAFKHFVKAMVDVFADQYLRAPTAEDTTRLMAINTPRGFPGMLGCIDCMHWRWKNCPTGWKGQYSGHVDGPTMILEAVASKDLWIWHSFFGLPGSLNDINVLQRSPLFQRLTSGTAPELEFMVNGNKYTMGYYLADGIYPSWATFVKTISNPQGNKRIHYAKVQEGVRKDVERAFGVLQARFAMVRGPARFWDTETLWYIMTACVIMHNMIIDNERDEDVDFDYDQEDSEVLRKEEYQRRNKPVLEKFLKIHKEIEDRRVHEQL

SEQ ID NO: 13724 - protein, 513 aa, Arabidopsis thaliana
MSILSFPHTFFNISPSLFYTILISSLVLLILTRRSAKSKIVKLPPGPPGWPVVGNLFQFARSGKQFYEYVDDVRKKYGPIYTLRMGSRTMIIISDSALVHDVLIQRGPMFATRPTENPTRTIFSSNTFTVNASAYGPVWRSLRKNMVQNMLSSIRFREFGSLRQSAMDKLVERIKSEAKDNDGLVWVLRNARFAAFCILLEMCFGIEMDEESILNMDQVMKKVLITLNPRLDDYLPILAPFYSKERARALEVRCGQVDFIVKLIERRRRAIQKPGTDKTASSFSYLDTLFDLKTEGRITTPSNEELVSLCSEFLNGGTDTTGTAIEWGIAQLIVNPEIQSRLYDEIKSTVGDREVEEKDVDKMVFLQAVVKEILRKHPPTYFTLTHSVTEPTTVAGYDVPVGINVEFYLPGINEDPKLWSDPKKFNPDRFISGKEEADITGVTGVKMMPFGIGRRICPGLAMATVHVHLMLAKMVQEFEWSAYPPESEIDFAGKLEFTVVMKKPLRAMVKPRV

SEQ ID NO: 13725 - protein, 335 aa, Nepenthes khasiana
MLIALLLGILFATINTRASQIGTCFGMMANNLPPLPDVVAQYNQYSIERMRIYGPVSSLSQALSGSGIELVLGVPNQDLQAIASSQSNANSWVQDNIGAYPNVNFRYLAVGNEIRPNLNNGAAQYAQCVLPAMQNLQNAINQMGYGGRVKVSTAVEMGVAINTYPPSAGQFDPSISYFINPIVRFMRDNGSPLLLNCYPYFAYAYSSNIDLSYALFTSPGTVVQDGQYAYQNLFDAMVDSIYSALEKADCGSVVIVVSESGWPTMGGKGTSIDNAKTYNNNLIQNVKKGTPKRPGAYLETYILDMYDEDLKSSELEQHWGLFTANGDLKYPVNFN

SEQ ID NO: 13726 - protein, 471 aa, Bacillus anthracis str. Ames
MANLFKKKSVTQLLGESKSKTLTKTLGAFDLTMLGIGAIIGTGVLVLTGLVAARDAGPAVIFSFMIAAIVCGFAALCYAEVASTLPVSGSVYTYSYATIGEFIAHLMGWTLLSVYVVTTAAVAGGWTGYFNNLVSGFGLEIPTELLKIPSQGGIVNLPAVVITLVLTWLLSRGTKESKRVNNIMVLIKIGIVILFIAVGAFYVQPENWTPFAPYGISGIFAGGAAVFFAFLGFDALATSAEEVKNPQRDLPIGIIASLVICTIIYVVVCLVMTGMVSYKELDVPEAMAYVLEVVGQDKVAGVIAVGAVIGIMAVIFAYIYATTRVFFAMSRDGLLPKSFAKINKKTEAPVFSTWLTGIGSALIAGFIDLKELSNLANIGALLTFAMVGVSVIILRKTHPNLKRGFMVPLVPTLPLISIACCLFLMFNLPLTTWIYFGIWLAIGVVVYFVYSKKHSHLKDDGSSQDNLEQAN

SEQ ID NO: 13727 - protein, 358 aa, Zea mays
MATTATNRRVILKEYVEGYPREEHMELLQGAEVPLRLTGAEPAGSVLVRNLYLSCDPYMRPKMSRPLRESYTAAFVPGDTITGYGVARVVDSSDPRLAPGDLVWGITGWEDYSVVTPPATRLLSKISHHGVGEGAGVPLSYYTGILGMPGLTAYVGFHEICAPKKGETVFVSAASGAVGQLVGQFARLAGCHVVGSAGSREKVELLKTRFGFHDAFNYKEEPDLGAALKRCFPDGIDIYFENVGGAMLDAVLLNMRVHGRIAVCGLISQYNLADGEKDAVRNLAAVISKRLRLQGFIEPDHKHLYPQYEAWVLPYIRDGTLAYVEDVAEGLESAPKALIGLFHGRNVGKQLVRVADDE

SEQ ID NO: 13728 - protein, 230 aa, Oryza sativa (japonica cultivar-group)
MEIQVEVEEEVQPKATLAILLAEYEVKAKKTWMEVTYASAVEQEICTAFLFVSQVHGVEYAFGAHDYPSSGVFEVEPRQCPGFRFRKSIFLGTTCLDPIQVRQFMELQSVNYNGDTYHLITKNCNHFCKDMCYKLTGNKIPKWVNRLARIGAICNCLLPESLKISPVGHDPNSRPEDCEKRRLRNPLSCFSSISSQRQLPPSSPFPTSPVKEPLAYSSSRKSSAPSLRNR

SEQ ID NO: 13729 - protein, 223 aa, Zea mays
MEKAGQHEHVIGIPVNNRAFGIEEPDFPSNGPAKNAAAGAGGRRRVTGDRVAQGLKEHVTLGPKLYETVKGKLSLGARILRAGGVGKVFRRWFSSPVGGGGERLLRASQCYLSTTAGPIAGMLFVSTERVAFRSDRSLALPLTSPAGGGSGSGTTTVLRVPYKVSIPLRRVAAARPGQNRDRPEHKYVQVVTRDGFDFWFMGFVRYQASLQELEKAVAQSQSQ

SEQ ID NO: 13730 - protein, 420 aa, Oryza sativa (japonica cultivar-group)
MDRASENRRLAAVGKPVPGIGEMGNRRPLRDINNLVGAPPHPSAIAKKPMLEKSGKEEQKPALVVSHRPMTRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLAAAAVYTAQCALTRCQQWTKTCELHSRYTGEQLLECSRMMVDFHQKAGAGKLTGVHRKYSTFKFGCAAKTEPALFLLESGAGGYNLQKQPC

SEQ ID NO: 13731 - protein, 394 aa, Eremitis sp. Clark and Zhang 1343
EPARTEDPALSIAGSVQSQKLAVRAISRLQALPGGDVKLLCDTVVENIRELTGYDRVMGYRFHDDEHGEVVAESRRADLEPYLGLHYPATDIPQASRFLFRQNRVRMIADCHTAPVRVIQDPVLPQPLCLVGSTLRAPHGCHAQYMANMGSIASLVMAVIISSGGDDSHNSSRGGIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEAQIKDIIEWLTLCHGDSTGLSTDSLADAGYPGAAALGDAVCGMAVAYITPSDYLFWFRSHTAKEIKWGGAKHHPEDKDDGQRMHPRSSFKAFLEVVKSRSLPWESAEMDAIH

SEQ ID NO: 13732 - protein, 394 aa, Glyceria grandis
EPARTEDPALSIAGAVQSQKLAVRAISRLQALPGGDVKLLCETVVEHVRELTGYDRVMVYKFHDDEHGEVLAESRRPDLEPYLGLHYPATDIPQASRFLFRQNRVRMIADCHAAPVRVIQDPAMPQPLCLVGSTLRSPHGCHAQYMANMGSIASLVMAVIISSGGDDEHHMARGNIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEAQIKDIIEWLTACHGDSTGLSTDSLADAGYSGATVLGDAVCGMAVACITPSDYLFWFRSHTAKEIKWGGAKHHPEDKDDGQRMHPRSSFKAFLEVVKSRSLPWENAEMDAIH

SEQ ID NO: 13733 - protein, 393 aa, Hakonechloa macra
EPARTEDPALSIAGAVQSQKLAVRAISRLQALPGGDVKLLCDTVVEHVRELTGYDRVMVYRFHEDEHGEVVAESRRADLETYLGLHYPATDIPQASRFLFRQNRVRMIADCHATPVRVIQDPGLPQPLCLVGSTLRAPHGCHAQYMANMGSIASLVMAVIISSGGDDEQTARGGISSTMKLWGLVVCHHTSPRFIPFPLRYACEFLMQAFGLQLNMELQLAHQLSEKHILRTQTLLCDMLLRESPTGIVTQSPSIMDLVKCDGAALYYHGKYYPLCVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIH

SEQ ID NO: 13734 - protein, 392 aa, Lithachne pauciflora
EPARTEDPALSIAGAVHSQKLAVRAISRLQALPGGDVKLLCDTVVEHVRELTGYDRVMVYRFHEDEHGEVVAESRRADLEPYLGLHYPATDIPQASRFLFRQNRVRMIADCHAAPVRVIQDPALQQPLCLVGSTLRAPHGCHAQYMANMGSIASLVMAVIISSGGDDEHNITRGGIPSAMKLWGLVVCHHTSPRCIPFPLRYACEFLMQAFGLQLSMELQLAHQLSEKHILRTQTLLCDMLLRDSPTGIVTQSPSIMDLVKCDGAALYYHGKYYPLGVTPTEAQIKDIIEWLTLCHGDSTGLSTDNFADAGYPGAAALGDAVCGMAVAYITPSDYLFWFRSHTAKEIKWGGAKHHPEDKDDGQRMHPRSSFKAFLEVVKSRSLPWENAEMDA

SEQ ID NO: 13735 - protein, 392 aa, Lolium perenne
TGYDRVMVYKFHDDEHGEVLAESRRADLEPYLGLHYPATDIPQASRFLFRQNRVRMIADCHAAPVRVIQDPAMPQPLCLVGSTLRSPHGCHAQYMANMGSIASLVMAVIISSGGEDEHNMGRGAVPSAMKLWGLVVCHHTSPRCIPFPLRYACEFLMQAFGLQLNMELQLAHQMSEKHILRTQTLLCDMLLRDSPTGIVTQSPSTMDLVKCDGAALYYHGKYYPLGITPTEAQIKDIIKWLTVCHGDSTGLSTDSLADAGYPGATELGDAVCGMAVAYITPSDYLFWFRSHTAKEIKWGGAKHHPEDKDDGQRMHPRSSFKAFLEVVKSRSLPWENAEMDAIHSLQLILRDSFRDAGEGTSNSKAIVNGHVQLGELELRGIDELSSVAREMV

SEQ ID NO: 13736 - protein, 983 aa, Arabidopsis thaliana
MAQSSTEPKFSLRLIIDEEKNKVVLAEAGKDFVQILFSFLTLPIGTIVRLLAKHRKSDPVTIGCLRNLYTSVVDMELDDFETDACKQMLLYPKNIREAQYRNFKLNIDTNESLKCFGCRFFSICRMCSNFNTSLCKCGKLMNEEISFLEYEENDVEGVFMRDKSSFIITDDLRLTDDSTSSLLQTLKDLGCADVSKLREQVLDIGLKEVMTLMQCVFTSNTPLTDAFLKNQSSNTVRKIYRKLSDDKGDEAEPDKVITIDAIVRKQDMKILYVECGEDFVDLLFTFLAIPLESIWEISGNSITIGRIGNLCQKQLLKIRTPTPRVYLGHCYSKTLSYSQSFYLTTKRTTKRMTFVDPKSDCCGRSKDGKGFVKRGTKFIVSDDLIVTPKISSSTFSVLKKFQILTDDLEVQAITISNADALNLLGASLVTSSALSSAFGNLIVKKPKEENVSWNPVSKKPKKSFLIYLAFVFLSSITLMAKSSEEPKFSLRLIVDEEKNKVVLAEACRDFVDVLFSLLTLPMGTIVRLLENHRKSEPVTLGCFNNLYRSVVDMGSDCFETEACKQMLVYPKSVKDLQCKRLKLNINPTEDIKCFKCSSYCGLYSNFSTSKCRCGKFMNEEIQLENEEQDLGRFQDDDNGVFVSGRCSFVLTDDLEVSVKSTELVLNKLKSLGCADVGKLGERLLDIGVKEVLTLLGCIFSSNAPLKDIFLNKKITQGATKFYKSQSPCLEKKEDEAEPEKVVTLKAFVRKQDMKILFVECGEEFVELLFSFIAVPLESAWEISGSSISLGCIGNMCRTFRDLNEETQMSTSTCALPSFYNFQMQLPGIITQQPPVYYRYRLYDYRQMNYGLTTNGNRTTYYRKDRIVRVDLKDPKSRGSDKSAQGFLKKATKCTVLDDLTITSMNSCSTVCLLKKLQSHADDLEVQVISISNAEALDLLRASLVTSSALSTTLWNLIAKKLKEETDLWDTVSKKAKEETCTSF

SEQ ID NO: 13737 - protein, 199 aa, Desulfovibrio desulfuricans G20
MRHHKGGMMTVSRRTFIKAAAGAATATAFAGLGVSLSPGVARAQLLKLEWARQSTSVCCYCAVGCGLIVHTSKDGQGRAINVEGDPDHPINEGALCAKGASIWQLAENDRRPASPMYRAPYSDHWQPVSWEWALENIAARIKKTRDESFITRNEKGEQVNRTDVIASAGSAALDNEECWVYQSFLRSLGLVYIEHQARI

SEQ ID NO: 13738 - protein, 394 aa, Lygeum spartum
EPARTEDPALSIAGAVQSQKLAVRAISRLQALPGGDVKLLCDTVVEHVRELTGYDRVMVYKFHDDEHGEVLAESRRTDLEPYLGLHYPATDIPQASRFLFRQNRVRMIADCHAAPVKVFQDPAMPQPLCLVGSTLRSPHGCHAQYMANMGSIASLVMAVIISSGGDDEHNMSRGVIPSAMKLWGLVVCHHTSPRCIPFPLRYACEFFMQAFGLQLNMELQLAHQLSEKHILRTQTILCDMLLRDSPTGIVTQSPSIMDLVKCDGAALYYHGKYYPLGVTPTESQIKDIIDWLTVCHGDSTGLSTDSLADAGYPGAAALGDAVCGMAVAYITPSDYLFWFRSHTAKEIKWGGAKHHPEDKDDGQRMHPRSSFKAFLEVVRSRSLPWENAEMDAIH

SEQ ID NO: 13739 - protein, 798 aa, Desulfovibrio desulfuricans G20
MTNHWIDLKNSDCILIMGSNAAENHPISFKWVLKARDAGATLIHVDPRYTRTSARCDMYAPIRSGADIPFLGGLIKYILDNNLYFREYVAEYTNASYIVSEKYSFENGFFSGFNPEKRNYDKSQWAFETDADGVPLRDKTLQHPRCVLNLLKEHYERYTVDKVVDITGTPREDLLAVYKAFAATGKKDKAGTIMYAMGWTQHTVGVQNIRAMAIIQLLLGNIGVAGGGVNALRGESNVQGSTDQCLLAHIIPGYLGVPKSGWPTLADYNKANTPVSKDPMSANWWQNKPKYVASLLKAMYPAASLDSAYEWLPKVDAHKPMTDYFWLSMFEKMHKEQFKGFFAWGMNPACGGANANKNREALGKLDWLVNVNIFENETSSFWKGPGMNPSDIKTEVFFLPCAVSIEKEGSVTNSGRWMQWRYAGPKPYAGNKPDGDIVYELMEKVRHLYGKEGGVFPDPIMHLNLDDWHTDHVFDPHKVAKLINGYFLRDVTIKGKTYKKGQQVPSFAFLQDDGSTCSGNWLYCNSYTDKGNMAARRDKTQTPEQANIGLYPNWAWCWPVNRRILYNRASVDTKGTPWAPGKAVIAWNGKGWTGDVPDGGWEPGTKHPFIMRKHGAGQIFGPGREEGPFPEHYEPLECPVKDNPFSPQLHNPTAYTIAGEAAAVCDPRYPFVGTTYRVTEHWQTGLMTRYQPWLIEAEPQLFVEISEELARLRGIEGGEKVRVSSLRGQLECVAIVTKRIKPFVVQGNDIHLVGLPWHYGWITPKNGGDAANLLTPSVGDPNTGIPETKAFMVDVRKL

SEQ ID NO: 13740 - protein, 394 aa, Melica cupanii
EPARTEDPALSIAGAVQSQKLAVRAISRLQALPGGDVKLLCDTVVEHVRELTGYDRVMVYKFHDDEHGEVLAESRRADLEPYLGLHYPATDIPQASRFLFRQNRVRMIADCGAAPVTVIQDPAMPQPLCLVGSTLRSPHGCHAQYMANMGSIASLVMAVIISSGGDDDHNMVRGSIPSAMKLWGLVVCHHTSPRCIPFPLRYACEFLMQAFGLELNMELQLAHQMSEKHILRTQTLLCDMLLRDSPTGIVTQSPSIMDLVKCDGAALFYHGKYYPLGVTPTEAQIKDIIEWLTVCHGDSTGLSTDSLADAGYSGATALGDAVCGMAVAYITPSDYLFWFRSHTAKEIKWGGAKHHPEDKDDGQRMHPRPSFKAFLEVVKSRSIPWENAEMDAIH

SEQ ID NO: 13741 - protein, 1508 aa, Debaryomyces hansenii CBS767
MSAGGDNSHVKDYRLDGHVLSDSYSIHEFNPVDESNDRYQGFEDSKDGIKELARTVSRTNQIGIANASDSEDLIRYLSHMSQVPGISPYEGNIDPSLDPESDEFNAKYWVKNLRKLHDSDPNYYKPSSLGIAYKDLRAYGVAADSDYQPTVSNAILKLVMETYHHFRKKDPSRYFDILKSMDAIMRPGEVTVVLGRPGSGCSTLLKTISSHTYGFQVGEESKISYDGMTPKDIERLHRGDVVYSAETDVHFPQLSVGDTLEFAARLRTPQNRGNVDRETYAKHMASVYMATYGLSHTRNTKVGNDFVRGVSGGERKRVSIAEVSLSGANIQCWDNATRGLDAATALEFIRALKTSASILEATPLIAIYQCSQDAYDLFDNVIVLYEGYQIFFGNAKRAKDFFIDMGYECPQRQTTADFLTSLTNPAERVVRPGHENRVPKNAKEFEIYWRNSSDYLSLVDDINKYMNVTDSKNQKESYHESHVARQSKHLSARSPYTVSFWMQTKYIIGRNILRTKGDPSISIFSVFGQLVMGLILSSVFFNLNQTTSSFYYRGAAIFFSVLFNAFASLLEIMALFEARPIVEKHKKYALYRPSADALASIITELPVKLLMSMVFNFSIYFMVNLRRNPGRFFFYWLMCFLCTLVMSHLFRSLGAVSTSLAGAMTPATVLLLAMVIFTGFVIPTPKMLGWSRWINYINPVGYVFESLMANEFSGRQFPCAEFVPRGLGYQSVESSQHICLTVGAKAGSTFVNGSDYIAISYSYYNSHKWRNFGIAVAFVIFFLVVYISLTEFNKGAMQKGEIVLFLRSALKKHRKESGNLRTINDVESKTLNEKVSRMDEIDALYADKPKKALETDKVPSSEDVFLWKDLTYQVKIKSEDRTILDHVDGWVKPGQLTALMGSSGAGKTTLLNCLSERVTTGIISDGVRMVNGHSLDGSFQRSIGYAQQQDLHLSTSTVREAFKFSAYLRQPNSISKKEKDRYVEYIIDLLEMNNYADALVGVAGEGLNVEQRKRLTIGVELVAKPKLLLFLDEPTSGLDSQTAWSVCRLMRKLADNGQAILCTIHQPSAILLKEFDRLLFLQKGGQTVYFGDLGEECSTLISYFENHGSHTCPKEANPAEWMLEVVGAAPGSHANQNYYDVWKNSHEYETVRNEIEFMARELTIKPRDESLEAHKKYAAPIWKQYLIVTRRVFQQNWRSPTYIYSKLFLVVSSSLFNGFSFFKADQSMQGLQNQMFSIFMFMIPFNTLVQQMLPYFIRQRDLYEVREAPSKTYSWFAFIAAQITSEIPIQIVVGTLAFFSWYYPVGLYENAVSTDSVDSRGVLMWMLLTSFFVYTSTMGQLCVSFSELADNAANLATMLFTLCLLFCGVLATSDAMPGFWIFMYRISPFTYLVQGTLGTGLANNKVTCSQSELLTFNTPEGQTCGEYTKNFMNHFGGYLTDQSSTNICEYCQMASTNDFLRSINVYFDERWRDLGIFIAFIAINIIGTIFFYWLARVPKGNREKRRKD

SEQ ID NO: 13742 - protein, 393 aa, Miscanthus sinensis
EPARTEDPALSMAGAVQSQKLAVRAISCLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRASHGCHAQYMANMGSIASLVMAVIISSGGDDEQTGRGGISSAMKLWGLVVCHHTSPRCIPLPLRYACEFLMQAFGLQLNMELQLAHQVSEKHILRTQTLLCDMLLRDSPTGIVTQSPSIMDLVKCDGAALYYHGKYYPLGVTPTESQIKDIIEWLTVCHGDSTGLSTDSLADAGYLGAAALWDAVCGMAVAYITPSDYLFWFRSHTAKEIKWGGAKHHPKDKDDGQRMHPRSSFKAFLEVVKSRSLPWENAEMDAIH

SEQ ID NO: 13743 - protein, 388 aa, Molinia caerulea
EDPALSIAGAVQSQKLAVRAISRLQALPGGDVKLLCDTVVENVRELTGYDRVMVYRFHEDEHGEVVAESRRADLEPYLGLHYPATDIPQASRFLFRQNRVRMIADCHATPVRVIQDPGLSQPLCLVGSTLRAPHGCHAQYMANMGSIASLVMAVIIIIGGDDEQTARGSISSAMKLWGLVVCHHTSPRFIHFPLRYACEFLMQAFGLQLNMELQLAHQLSEKHILRTQTLLCDMLLRDSPSGIVMQSPSIMDLVKCDGAALYYHGKYYPLGVTPTESQIMDIIEWLTMCHGGSTGLSTDSLADAGYLGAAALGDAVCGMAVAYITSSDYLFWFRSHTAKEIKWGGAKHHPEDKDDGQRMHPRSSFKAFLEVIKSRSLPWENAEMDAIH

SEQ ID NO: 13744 - protein, 545 aa, Fragaria vesca
MGVYTCPRVFTSSSSSSTYCCRHHPDLATRAAVNPRPGFAAGRVDSPAPFHGLSSLILRFPPNFVRQLSTKARRNCSNIGVAQIVAASWSNKDSDLSAVPAASAVDAAATAADLVVPAQIGTEDDLAAVDAEYAVFGNGVQLGGLPDLKDASFLSSDGSIAIHAGERLGRGIVTDAITTPVVNTSAYFFKKTADLLDFKEKRATSFEYGRYGNPTTVVLEEKISALEGAESTLLLASGMCASTVLLMALVPAGGHIVTTTDCYRKTRIFIETILPKMGITATIIDPADVGALETALNENKVSLFFTESPTNPFLRCVDINLVSDLCHSKGAVVCINGTFATPINQKALALGADLVVHSATKYLAGHNDVLAGCISGSMKLVSEIRILHHILGGALNPNAAYLIIRGMKTLHIRIQQQNSTALRMAKILEAHPKVAHVYYPGLPSHPEHELAKRQMTGFGGVVSFEIDGDLKRTIKFIDALKIPYIAPSFGGCESIVDQPAIMSYWDLSQSDRLKYGIKDNLVRFSFGIEDFNDLKADILQALEKI

SEQ ID NO: 13745 - protein, 387 aa, Nardus stricta
PALSIAGAVQSQKLAVRAISRLQALPGGDVKLLCDTVVEHVRELTGYDRVIVYKFHDDEHGEVLAESRRTDLEPYLGLHYPATDIPQASRFLFRQNFVRMIADCHAAPVRVIQDPAMPQPLCLVGSTLRSPHGCHAQYMANMGSIASLVMAVIISSGGDDEHNMARGVVPSAMKLWGLVVCHHTSPRCIPFPLRYACEFLMQAFGLQPNMELQLAHQMSEKHILRTQTLLCDMLLRDSPTGIVTQSPSIMDLVKCDGAALYYHGKYYPLGVTPTESQIKDIIEWLTVCHGDSTGLSTDSLADAGYPGAAALGDAVCGMAVAYITQSDYLFRFRSHTAKEIKWGGAKHHPEDKDDGQRMHPRSSFKAFLAVVKSRSLPWENAEMDAIH

SEQ ID NO: 13746 - protein, 554 aa, Pseudomonas fluorescens
  misc_feature (446)..(446): Xaa can be any naturally occurring amino acid
MAYYRTPHDVTALPAWQALNDHRKAMQDFSMREAFNADPQRFTQFTLSSCGLFLDYSKNLINAQTRDLLVGLANEVDLKGAIKSLFEGEIVNASENRPALHTALRRPVGDKLLVNGVNVMPDVHKVLNQITDLVGRIHDGLWRGYTEKPITDVVNIGIGGSFLGPELVSEALLSYAQKGVRCHYLANIDGSEFHELTMKLRAETTLFIVSSKSFNTLETLKNAQAARAWYLAQGGSEAELYRHFIAVSSNNAAAVAFGIREENIFPMWDWVGGRYSLWSAIGLPIALAIGMSNFKELLSGAYSMDQHFQSAPFEQNMPVLLALLGVWYGNFWGAQSHAILPYDHYLRNITKHLQQLDMESNGKSVRQDGTPVSTDTGPVIWGGVGCNGQHAYHQLLHQGTQLIPADFIVPIVSFNPVSDHHQWLYANCLSQSQALMLGKTRAEAEXELRDKGASEEEVQKLASHKVIPGNRPSNTLVVERISPRRLGALVALYEHKVFVQSVVWGINAFDQWGVELGKELGKGVYNRLVGSEESLAEDASTQGLINYFRGRHRG

SEQ ID NO: 13747 - protein, 681 aa, Leifsonia xyli subsp. xyli str. CTCB07
MTDPVSSPYPLGVTLLSGGANVAVYSERADRVTVCVFGEDGAETRTELTDRTGHVFHGVVPGMATGARYGLRVDGPWDPTGGQRFSPAKVLLDPHARAVVGAWDLSQADFGHQLRHPHRRDDTDGSGHVALGVATGPGFDWGDDRPPRIPLGETVIYEMHVKGFTQRMPGVPEELRGTYAGLANEAAIDYLKGLGVTAVELLPVHQFVQDLHLLEKGLRNYWGYNSIGFFAPHNEYAATGAIGQQVDEFKGMVKALHAAGIEVILDVVYNHTAEGNHLGPTLSFKGIDNPSYYRLVEGDERHYFDTTGTGNSVNVSHPAALQLILDSLRYWVEEVHIDGFRFDLATALTRQGGDASLHSAFLTLVQQDPTLKPVKLIAEPWDVAGYQLGGFPADWSEWNGRFRDDVRDFWRGTEGMLATLSQRVLGSPDIYEDSRRTPLSSVNFVTAHDGFTLADLTSYEQKRNEDNGEDNQDGESDNRSANYGAEGPTDAPGILAVRLRQRKNFLATVLLSAGVPMILGGDEIGRTQRGNNNAYCQDGEISWFDWAAADEELRAFTERLIRLRRAEPALRPEWYRRAPEAGGRDVVRILRADGEPFAAEDWEEPDARSIAFELRHEGADTFLLLLNAAANGVEFTLPATVDGPWSLELSSDPGLELGDGESVIAGEISFALLRSALREGL

SEQ ID NO: 13748 - protein, 430 aa, Prosthecochloris aestuarii DSM 271
MKHVVIVGGGFTGITAARELGNKPDIRVTLIDRKNYHLFQPLLYQVAMSALGAGDIAEPLRNMLSRYQNITVFKGVVESIDPEQKTVHTDFGELTYDYLILACGVKHHYFGHEEWEEFAPGLKTIAQATEIRRRVMEAYEAAERTSDPVIRKKLLTFVIVGGGPTGVELAGSIGEMSRHTLSKFYRNIDPKLTRIFIVEAAPRILGAFAPELASRASRALENLGVQIWSSSMVNNVDKNGVQIGNERIEASTVLWAAGVRAVSLGSKMGAEVDRSGRIIVEEDLSVPGYPEIFCGGDQAHFAHHTEYPLPGMAPVAMQQGRSIGKNILNDIKGKTRKMFRYKDKGQMATIGRNKAIVEVGRLKFDGAPAWLTWLLVHIYYLTTFKHRILVLMQWGWSYFTFGHGARLIVNKEWRFYPDKKPCTTQNEKPD

SEQ ID NO: 13749 - protein, 86 aa, Zea mays
  misc_feature (26)..(26): Xaa can be any naturally occurring amino acid
  misc_feature (40)..(40): Xaa can be any naturally occurring amino acid
TPIQFIVYDKFHRTTAGDTIRRKTIXNYSSLFIPQKISQXKGYSDRLYFYAVHNTYLEEPSSCNAFVVKDNVISTAAIQGTISPGI

SEQ ID NO: 13750 - protein, 474 aa, delta proteobacterium MLMS-1
MVKRVRTAIIVMGFSGLVAEILLLRELLIVFAGNELSIGIILANWLILEAFGCYFAGGRAAESPRRVEVFTVITILFSLFLVAAVVATRLLKEMLGVSIGENVGFLPMFYSSFLILLPVSVLHGALFTSGCRIYADCAPAAGPDASPAGRVYVYETVGTIIGGIACTYLLIPYLDAMHTTAWLALLNFVVCLALLAPHRRRRRLTGMVAAALGGLILLTGTLLATGQVERLHWYTVAGQWQNLNVVEYRNSPYGNICVIENEGQYIYFLDGIATILTPIPDIPFVEEFVNVPLLTHRQPEKILILSGGAGGIINEALKHPSLAAVEYAEQDPLLFELLRKFPTELTESELDDPRVKIHHTDGRLLLQTTPRQYDLIFIGILEPSSLQTNRYFTREFFTLARERLNPGGILVFGLPGSMTYLNDELKNLNSSVFHTVKSVFPHVRVIPGDGHNLFLSSDAPDVAAVDAHQIMARL

SEQ ID NO: 13751 - protein, 214 aa, Bradyrhizobium sp. BTAi1
MSRLALTRADEPMTAARVGIGGPVGSGKTALVERLIPALQTRGIDIAVITNDLVTAEDAERVRRSGLIDPERVSAVEAGACPHTVIREDPTLNIEAADELERRFPGVELILLESGGDNLASTFSRDLTDFWMFVIDVAGGDDIPRKRGPGVIRADLLVINKVDLAPHVGVDLGRMQREATEVRGGRPVLLTNCRRGEGIEAIVDLLEREVLFRK

SEQ ID NO: 13752 - protein, 480 aa, Medicago truncatula
MSLPPPIPPPSLATPPKARPTELPIRQIPGSHGWPLLGPLSDRLDYFWFQKPENFFRTRMDKYKSTVFRTNVPPTFPFFTNVNPNIIAVLDCKSFSHLFDMDLVDKKDVLVGDFVPSVEFTGNIRVGVYQDVSEPQHAKAKSFSMNILKQSSSIWVPELISNLDIFLDQIEATLSNSSSVSYFSPLQQFLFTFLSKVLARADPSLDPKIAESGSSMLNKWLAVQLLPTVSVGTIQPLEEIFLHSFSYPYALVSGDYNKLYNFIKQHGKEVIKSGTEFGLSEDEAIHNLLFVLGFNSYGGFSIFLPKLIDSIANGPTGLQEKLRKEAREKGGSTLGFDSLKELELINSVVYETLRMNPPVPLQFGRARKDFQLSSYDSAFNVKKGELLCGFQKLIMRDPVVFDEPEQFKPERFTKEKGAELLNYLYWSNGPQTGSPSGSNKQCAGKDIVTFTAALIVAHLLRRYDLIKGDGSSITALRKAK

SEQ ID NO: 13753 - protein, 166 aa, Oryza sativa (japonica cultivar-group)
MAAKAAFPAPAGDEPAIGIPYHPAAAGAQGGYYYAPDPYAAGMPPPNAIYAGAPKGVPLQQTMFRDTPAPFHCQACGAAAVSSLRSEDTIFFPVHGRSKPSLASVVACMMPFMMGVCFLCPSMDCLWHKYHYCPSCGEKVAEFKKSDPCLVVDPTRWSEPSFAVPA

SEQ ID NO: 13754 - protein, 228 aa, Gossypium marchantii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHBKPVQEVLAEMTNGGVDRSVE

SEQ ID NO: 13755 - protein, 183 aa, Coprinopsis cinerea okayama7#130
MTSSWFPFLSQFDLSPSSIATYSLAIGLPILYVLAKSFLAPSSPSHSQETEAQDTAKETLKKPLKPIMQPPSENLAPPKDDPYTPEELTKYDGKDGRPIYVAIKGTIFDVTRKADVYGPGKSYSIFAGKDGSKGLGMSSLKAEHAIADYSDLGETERKVLDDWYAFFSKRYNIIGRVVPSSSS

SEQ ID NO: 13756 - protein, 254 aa, Zymomonas mobilis subsp. mobilis ZM4
MSVSFDYSGKVALVTGAGTGIGRETALAFAKAKAYVAIIGRSENNIQETLRLVTEMGGQAIAIQADVSQEDSIKAAIEKTVETFGKLDFAFNNAGIEHKAIPAADIPSEEWDRIISTNLNGVFFSMKHEIPAMLKSGSGSIVNTASGAGVKGFPGNGAYCASKFGLIGLSKAAALDYAKQHLRINVVAPGIIETPMMQRFTGGTEEGRETAIAQEPVGRAGHPKEIAGTVLWLCSDLAAFTTGSVFVVDGGQTA

SEQ ID NO: 13757 - protein, 314 aa, Oryza sativa (japonica cultivar-group)
MCIAAWAWQSQPAHRLLLLFNRDEYHSRCAPCSVPSIPTPYNSHLLTRARRDFLSRPTQPAGWWAAGKAEVKLILGGRDELGGGTWLGCTRDGKLAFLTNVREPGTLVGPNVRGELPVRFLQGNQCPLEYAEEIAKEADQYNGFNLVLADVQSGNMAYISNRPEGDPVVQKVLPGFHVLSNAAIDCPWPKMLRLGQSFNRFLATQDGAEVSLQQMVEELMMDPVKADKSAVPDTGVDPDWEYQLSSIFIDTEKGQARYGTRSMTALAVKFNGEVTFYERYLESNLWKENLMQFELEMSQWEDLRGTSNISPKSC

SEQ ID NO: 13758 - protein, 394 aa, Nassella viridula
EPARTEIPALSIAGAVQSQKLAVRAISRLQALPGGDVKLLCDTVVEHVRELTGYDRVMVYKFHDDEHGEVLAESRRADLEPYLGLHYPATDIPQASRFLFRQNRVRMIADCHAAPVRVIQDPAMQQPLCLVGSTLRSPHGCHAQYMANMGSIASLVMAVIISSGGDDEHNMGRGTIPSAMKLWGLVVCHHTSPRCIPFPLRYACEFLMQAFGLQLNMELQLAHQLSEKHILRTQTLLCDMLLRDSPTGIVMQSPSIMDLVKCDGAALYYHGKYYPLGVTPIEAQIKDIIEWLTVCHGDSTGLSTDSLADAGYSGATALGDAVCGMAVAYITPSDYLFWFRSHTAKEIKWGGAKHHPEDKDDGQRMHPRSSFKAFLEVVKSRSLPWENAEMDAIH

SEQ ID NO: 13759 - protein, 143 aa, Saccharomyces cerevisiae
METNFSFDSNLIVIIIITLFATRIIAKRFLSTPKMVSQETVAHVKDLIGQKEVFVAAKTYCPYCKATLSTLFQELNVPKSKALVLELDEMSNGSEIQDALEEISGQKTVPNVYINGKHIGGNSDLETLKKNGKLAEILKPVFQ

SEQ ID NO: 13760 - protein, 232 aa, Oryza sativa (japonica cultivar-group)
MASSSDPWVREYSEASRLADDVTSMIADRGSLPQSGPEIMRHTSAIRRKITILGTRLDSLEALLSRIPPKSITDKELHKRQDMLSNLKSRAKQMATSFNMSNFANREDLLGQSKKAADDMSRVAGLDNQGIVSLQRQVMKEQDEGLEKLEETVLSTKHIALAVNEELTLHTRLIDDLDDYVDVTNSRLQRVQKRLAILNKRVKGGCSCMALLISVVAIVFLAVIAWLLIKHL

SEQ ID NO: 13761 - protein, 394 aa, Olyra latifolia
EPARTEDPALSIAGAVQSQKLAVRAISRLQALPGGDVKLLCDTVVEHVRELTGYDRVMVYRFHEDEHGEVVAESRRADLEPYLGLHYPATDIPQASRFLFRQNRVRMIADCHAAPVKVIQDSALQQPLCLVGSMLRAPHGCHAQYMANMGSIASLVMAVIISSGGDDEHNITRGGIPSAMKLWGLVVCHHTSPRCIPFPLRYACEFLMQAFGLRLNMELQLAHQLSEKHILRTQTLLCDMLLRDSPTGIVTQSPSIMDLVKCDGDALYYHGKYYPLGVTPTEVQIKDIIEWLTVCHGDSTGLSTDSLADAGYPGAAALGDAVCGMAVAYITPSDYMFWFRSHTAKEIKWGGAKHHPEDKDDGQRMHPRSSFKAFLEVVKSRSLPWENAEMDAIH

SEQ ID NO: 13762 - protein, 393 aa, Panicum capillare
EPARTEAPALSIAGAVQSQKLAVRAISRLQALPGGDVKLLCDTVVEHVRELTGYDRVMVYRFHEDEHGEVVAECRRDNLEPYLGLHYPATDIPQASRFLFRQNRVRMIADCHATPVRVIQDPGLSQPLCLVGSTLRAPHGCHAQYMANMGSIASLVMAVIISSGGDDEQTARGGISSAMKLWGLVVCHHTSPRFIPFSLRYACEFLMQAFGLQLNMELQLAHQLSEKHILRTQSLLCDMLVRDSPTGIVTQSRSIMDLVKCDGAALYYHGKYYPLGVTPTESQIKDIIEWLTVCHGDSTGLSTDSLADAGYHGAAALGDAVCGMAVAYITPSDYLFWFRSHTAKEIKWGGAKHHPEDKDDGQRMHPRSSFKAFLEVVKSRSLPWENAEMDAIH

SEQ ID NO: 13763 - protein, 355 aa, Halobacterium sp. NRC-1
MTRGEARRPPQEFDRVLSSMCTTPHPAAREAAQAFLATNPGDPETYPAVAERERDAVALLGEIVGLSSPHGYIAAGGTEANLQAVRAARNRADADAVNVVAPASAHFSFQKAADVLGVELRLAPTDGDHRADVAAVADLVDGDTAVVVGVAGTTEYGRVDPIPALADIAAGVDANLHVDAAWGGFVLPFTDHDWSFADAPVNTMAIDPHKMGQAPVPAGGFLARDPETLDALAIETPYLESDTQPTLGGTRSGAGVAGALASLRALWPDGYREQYERTQGNAEYLAAELAARGYDVVDPELPLVAADMPDAEFQALREEGWRISRTASDALRVVCMPHVTREMLAAFLDDVDALA

SEQ ID NO: 13764 - protein, 394 aa, Pariana radiciflora
EPARTEDPAISIAGSVQSQKLAVRAISRLQALPGGDVKLLCDTVVEDIRELTGYDRVMVYRFHEDEHGEVVAESRRADLEPYLGLHYPATDIPQASRFLFRQNRVRMIADCHTAPVRVIQDPALPQPLCLVGSTLRAPHGCHAQYMANMGSIASLVMAVIISSGGDDSHNSSRGGIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEAQIKDIIEWLTLCHGDSTGLSTDSLADAGYPGAAALGDAVCGMAVAYITPSDYLFWFRSHTGKEIKWGGAKHHPEDKDDGQRMHPRSSFKAFLEVVKSRSLPWENAEMDAIH

SEQ ID NO: 13765 - protein, 752 aa, Halobacterium sp. NRC-1
MAVRWLEDVRADDIDSVGGKGASLGELTDAGLPVPPGFVVTAGTYRTFIEEAGIDQELFDAVGVDAEDSDALADAAARASDLILNTDFPASLREDILSSYDALDDGAAFVAVRSSATAEDLPDASFAGQQETFLNITREALLDHVKRCWASLFTERAIYYRQEQGFDHDRVNIAVVVQRMVDAEKSGVLFTSHPSTGAHEAIVEAAWGLGEAVVSGAVSPDNYVVDRDTDTVEEATVADKKVMHVKDDDTGETVSRDVPDRKRTQRVLDDGEISDLVTIGERVEAHYDAPQDVEWAIVDGDVYMLQSRPITTIEDDTDGAVANTDGGGGDAVVTGLGASPGVASGPARVVTSLDELDKIGEGDIIATEMTTPDMVPAMKRAAGIVTDEGGMTSHAAIVSRELGCPAVVGATDATTTLCDDQAVTLDGDRGVVRDGREETTTEHDPIEDARPTTPVKPMTATEVKVNVSIPEAAERAAATGADGVGLLRMEHMILSTNKTPKRYIDDHGEDAYVQELVDGIRGVAEEFYPRPVRVRTLDAPTDEFRQLEGGNDEPHEHNPMLGYRGVRRSLDRPDVFKHELSAFRRLYEMGYDNVEVMFPLVNDAQDVARARDLMADAGIDVEKRSWGVMIETPAAALAIEEIAQEGVDFASFGTNDLTQYTLAVDRNNGSVADRFDELHPSVLTLIERTIDACREHDVATSICGQAGSKPEMVDFLVETGVSSISANIDAVRDVQHEVKRVEQRLLLESARE

SEQ ID NO: 13766 - protein, 431 aa, Yersinia pseudotuberculosis IP 32953
MSKIVKVIGREIIDSRGNPTVEAEVHLEGGFVGLAAAPSGASTGSREALELRDGDKSRFLGKGVLKAVAAVNGPIAQAVIGKDAKDQANIDKIMIDLDGTENKSQFGANAILAVSLAAAKAAAASKGMPLYEHIAELNGTPGKFSMPLPMMNIINGGEHADNNVDIQEFMIQPVGAKTLKEAVRIGSEVFHHLAKVLKAKGLNTAVGDEGGYAPNLGSNAEALAVIAEAVKAAGYELGKDVTLAMDCAASEFYKDGKYVLAGEGNKAFTSEEFTHFLEDLTKQYPIVSIEDGLDESDWAGFKYQTEVLGDKIQLVGDDLFVTNTKILKEGIEKGVANSILIKFNQIGSLTETLAAIKMAKDAGYTAVISHRSGETEDATIADLAVGTAAGQIKTGSMSRSDRVAKYNQLIRIEEALGDRAPFNGLKEVKGQ

SEQ ID NO: 13767 - protein, 388 aa, Medicago truncatula
MELSIMLCFFTSILFIVLFRIFIKSFVSKRHDLPLPPGSMGWPYIGETFQLYSQDPNVFFASKIKRYGSMFKSHILGCPCVMISSPEAAKFVLNKAQLFKPTFPASKERMLGKQAIFFHQGEYHANLRRLVLRTFMPVAIRNIVPDIESIAEDSLKSMEGRLITTFLEMKTFTFNVALLSIFGKDEIHYREQLKQCYYTLEKGYNSMPINLPGTLFHKAMKARKELAQILAQIISSRREKKEEYKDLLGSFMDEKSGLSDEQIANNVIGVIFATRDTTASVLTWIVKYLGENISALESVIEEQESILKSKEENGEEKGLNWEDTKKMVITSRVIQETLRVASILSFTFREAVEDVEYQGYLIPKGWKVLPLFRNIHHSPNNFKDPEKV

SEQ ID NO: 13768 - protein, 395 aa, Peridictyon sanctum
EPARTEDPALSIAGAVQSQKLAVRAISRLQALPGGDVKLLCDTVVEHVRELTGYDRVMVYKFHDDEHGEVLAESRRVDLEPYLGLHYPATDIPQASRFLFRQNRVRMIADCHAAPVRVIQDPAMPQPLCLVGSTLRSPHGCHAQYMANMGSIASLVMAVIISSGGEDEHNMTRGVIPSAMKLWGLVVCHHTSPRCIPFPLRYACEFLMQAFGLQLSMELQLAHQLSEKHILRTQTLLCDMLLRDSPTGIVTQSPSIMDLVKCDGAALFYHGKYYPLGVVTPTEAQIKDIIEWLTVCHGDSTGLSTDSLADAGYPGATALGDAVCGMAVAYITPSDYLFWFRSHTAKEIKWGGAKHHPEDKDDGQRMHPRSSFKAFLEVVKSRSLPWENAEMDAIE

SEQ ID NO: 13769 - protein, 394 aa, Phalaris arundinacea
EPASTEDPALSIAGAVHSQKLAVRAISRLQALPGGDVKLLCGTVVEHVRELTSYDRVMVYKFHDDEHGEVLAESRRADLEPYLGLHYPATDIPQASRFLFRQNRVRMIADCHAAPVRVIQDPAMPQPLCLVGSTLRSPHGCHAQYMANMGSIASLVMAVIISSGGEDEHSMGRGAVPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKCYPLGITPTEAQIKDIIEWLTVCHGETTGLSTDSLADAGYPGATALGDAVCGMTVAYITPSDYLFWFRSHTAKEIKWGGAKHHPEDRDDGQRMHPRSSFKAFLEVVKSRSLPWENAEMDAIH

SEQ ID NO: 13770 - protein, 135 aa, Saccharomyces cerevisiae
MMFNIYLFVTFFSTILAGSLSDLEIGIIKRIPVEDCLIKAMPGDKVKVHYTGSLLESGTVFDSSYSRGSPIAFELGVGRVIKGWDQGVAGMCVGEKRKLQIPSSLAYGERGVPGVIPPSADLVFDVELVDVKSAA

SEQ ID NO: 13771 - protein, 572 aa, Bacillus licheniformis ATCC 14580
MGNEILKAPEGPPSDVERIKKESDYLRGTLKESMLEPLSAGISDDDNRLMKHHGSYLQDDRDLRNERQKQKLEPAYQFMLRVRMPGGVATPEQWLVMDELARKYGNGTLKLTTRETFQMHGILKWNMKKTIQSIHSAMLDTIAACGDVNRNVMCTSNPYQSEIHREVYEWSKKLSDDLLPRTRAYHEIWLDEEKVAGTPDADEVEPMYGPLYLPRKFKIGIAVPPSNDIDVFSQDLGFIAIVEDDKLIGFNVAIGGGMGMTHGDKATYPQLAKVIGFCKPEQLYDVAEKTITIQRDYGNRSVRKNARFKYTVDRLGLETVKNELENRLGWSLAEAKPYHFEHNGDRYGWVKGVKGRWHFTMFVEGGRVTDYDDYKLMTGLREIAKVHTGDIRLTANQNLIIANVTSQKKKKISELIEQFGLTDGKHYTALRRSSIACVALPTCGLAMAEAERYLPKLIDKIDEIVEENGLKNEEITIRMTGCPNGCARHALGEIGFIGKAPGKYNMYLGAAFDGSRLSKMYRENIGEEEILKELRNILPRYAKERNEGERFGDFVIRAGIVKETTDGTNFHD

SEQ ID NO: 13772 - protein, 394 aa, Pharus lappulaceus
EPARTEDPALSIAGAVQSQKLAVRAISRLQALPGGDVKLLCDTAVEHVRELTGYDRVMVYRFHDDKHGEVVAESRRDDLEPYLGLHYPETDIPQASRFLFRQNRVRMIADCHAAPVRVIQDPALPQPLCLVGSTLRAPHGCHAQYMANMGSIASLVMAVIISSGGDDEHNVARGAISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEAQIKDIIEWLTLCHGDSTGLSTDSLADAGYPGAAALGDAVCGMAVAYITPSDYLFWFRSHTAKEIKWGGAKHHPEDKDDGQRMHPRSSFKAFLEVVKSRSLPWENAEMDAIH

SEQ ID NO: 13773 - protein, 179 aa, Mortierella sp. M10
HRLWSHRSYNAGPAMSFVLALLGAGAVEGSIKWWSRGHRAHHRWTDTEKDPYSAHRGLFFSHLGWMLIKRPGWKIGHADVDDLNKNKLVQWQHKNYLALIFLMGVVFPTAVAGLGWGDWRGGYFYAAILRLVFVHHATFCVNSLAHWLGEGPFDDRHSPRDHFITAFMTLGEVYHNFHH

SEQ ID NO: 13774 - protein, 394 aa, Pseudosasa japonica
EPARTEDPALSIAGAVQSQKLAVRAISRLQALPGGDVKLLCDTVVEHVRELTGYDRVMVYRFHDDEHGEVVAESRRADLEPYLGLHYPATDIPQASRFLFGQNRVRMIADCRAAPVGVIQDPVLPQPLCLVGSTLRAPHGCHAQYMANMGSIASLVMAVIISSGGDDENNITRGGIPSAMKLWGLVVCHHTSPRCIPFPLRYACEFLMQAFGLQLNMELQLAHQLSEKHILRTQTLLCDMLLRDSPTGMVTQSPSIMDLVKCDGAALYYHGKYFLLDVTPTEAQIKDIIEWLTMCHGDSTGLSTDSLADAGYPGAAALGDAVYGMAVAYITPTDYLFWFRSHTAKEIKWGGAKHHPDDKDDGQRMHPRSSFKAFLEVVKSRSLPWENAEMDAIH

SEQ ID NO: 13775 - protein, 496 aa, Pseudomonas syringae pv. phaseolicola 1448A
MFDTKPHLPDALYSAAQVRDLDARLIAAGTPGLELMLRAAQALWRTILRRWPQANELTVLAGRGNNAGDGYLVAALAHKAGWQVRVLAVGDPAALSGDAASAHAAASGIDTQVWAGQPLTGVVLDALLGTGLNGEVREPYVSAIKAINASGLPVAAVDIPSGLSADTGQALGVAVRADVTVTFIGLKLGLLTGDAADLVGELVFDDLRADPALVAQVPVSAKRLSASSLPTLASRPRTAHKGMFGRVLVIGGDHGFGGAALLSAESALRSGAGMLTLATRAEHIPAALTRMPEIMSAAIRSANQLMALIEPASVLVVGPGLGQAAWGRSLLSAAANAERPQVWDADALNMLAAGAVSLPKGCVITPHPGEAARLLGVGIKDIQADRAAAVRALARKFDTVCVLKGSGSLIADASGQLALCDRGHPAMATAGLGDVLAGLIGALLAQHLTPFDAACLAVWLHASAGQKVGEYGRGLAASDIILAIRQLLEELQPCLI

SEQ ID NO: 13776 - protein, 219 aa, Streptococcus agalactiae NEM316
MPVKDFMTKKLVYVSPDTTVAEAADLLREHHLRRLPVVENDQLLGLVTEGTMAEAQPSKATSLSIYEMNYLLNKTKIRDIMIKDIVTVSQYASLEDAIYLMMSRKIGVLPVVDNGQLYGIITDRDVFKAFLEIAGYGQEGYRLVILADEGIGVLSKVLNRLSSANLSVKRLVIIERKAGKKAVEIQLEGYADKDVLKQELVFDDVIVETLEKTVKKPLS

SEQ ID NO: 13777 - protein, 130 aa, Triticum aestivum
CDVLVPCALGGVLNKDNAPDVKAKFIIEAANHPTDPEADEILAKKGVVVLPDIYANSGGVVVSYFEWVQNIQGFMWAEEKVNDELEKYMSSAFQHMKAMCKSLDCDLRMGAFTLGVNRVARATLLRGWEA

SEQ ID NO: 13778 - protein, 235 aa, Brassica napus
  misc_feature (208)..(208): Xaa can be any naturally occurring amino acid
MASLMQSEPEMEKKPVGIRFLERIKGSKLSYNAYQAIVLIVTFLAYASYHAARKTTSIVKSALDPQSPDTGVNSLLLRFTSFRSFRQEQENGGWAPFNGPNGTVLLGEIDVAFLAVYAFGMYFAGHLGDRMNLRIFLTVGMVGTGLFTSLFGVGYWANVHSFYYFLIMQMLAGLFQSSGWPSVVAVVGNWFNKKKRGLIMGIWNAHTXSVGNITGSLIAAAMLRYGWGWSFVVPG

SEQ ID NO: 13779 - protein, 372 aa, Corynebacterium efficiens YS-314
MSSSEKNGSLDASAGASVDVDAVILVGGKGTRLRPLTNNTPKPMLPTAGHPFLKHLLARIKAAGITHVVLGTSFKAEVFEDYFGDGSDLGLEIEYVVEDQPLGTGGGIRNVYDKLRHDTAVVFNGDVLSGADLGDILATHREKEADLTMHLVRVANPRAFGCVPTDADGRVLEFLEKTEDPPTDQINAGCYVFQRELIASIPADRVVSVERETFPQLLQEGRRVYGHVDTSYWRDMGTPQDFVRGSSDLVRGIAFSPLLEGQTGEELVDPSAGVRDGVILLGGTVVGRGTEIGAGCRLDGTVVFDGVTIEPGAFIENSIISSGVRIGANAHISGCVIGEGAQIGARCELSSGMRVFPGVVIPDGGIRFSSDQ

SEQ ID NO: 13780 - protein, 434 aa, Picea abies
IHSQCSGVLHRAGYGGSQGARSAACCQAQIQIGCEIYQTRPRLDLGGLWSSLCQGYEGVYSGALLSQEIGGPQACQGRRGCSHGGIHIQCLYQTRRNRKALGGEEISVSCGIQQYHQDCFWEKICERRREDGSTRCGVQGNCCNQGCSWGLPSSMAEPPFPIFFRWMFSHYKRVRSPSMGARRDNVTKAIMEEHTLARQTSGAKQHFVDALLTLQEKYDLSEDTIIGLLWDMITAGMDTTAITVEWAMAELVRNPRIQQKAQEEIDRVVGRDRVLNETDFPHLPYLQCITKEALRLHPPTPLMLPHKATQNVKIGGYDIPKGSNVHVNVWAVARDPAVWKDPVTFRPERFIEEDVDIKGHDYRLLPFGAGRRICPGAQLGINLVQSMLGHLLHHFEWAPPEGMKAEDIDLTENPGLVTFMAKPVQAIAIPRCRS

SEQ ID NO: 13781 - protein, 219 aa, Lilium longiflorum
VEQFSPVPYLATLLNCMLWVVYGLPLVHPHSTLVLTINGLGLIIELTYVLLFLLYSNGRARIRVLAMLLTEIVFVGLITVIVLSTAHTLVTRSLIIGVLCVFFGTMMYAAPLSVMKLVIQTKSVEYMPLFLSVASFLNGICWTTYALIRFDLFITIPNALGTMFAVAQLILHAMYYKSTKIQMEAQKRKLEMGFEEVMAPVENTEKIRGASQTGKYPPV

SEQ ID NO: 13782 - protein, 576 aa, Yersinia pseudotuberculosis IP 32953
MNEKHPGPLVVSGKLSDGERMKSESNFLRGTIAEDLNNGLTGGFSGDNFLLIRFHGMYQQDDRDIRAERAEQKLEPRHAMMLRCRLPGGIITPQQWLGIDKFAADNTLYGSIRITNRQTFQFHGILKGNVKPAHQLLNELGLDALATANDVNRNVLCTSNPVESALHQEAYEWAKKISEHLLPRTRAYAEIWLDAEKVATTDEEPILGATYLPRKFKTTVVIPPQNDVDLHANDLNFVAVADKGKLIGFNVLVGGGLSIAHGDKNTYPRKASEFGYIPLKHTLAIAEAVVTTQRDWGNRTDRKNAKTKYTLERVGVETFKAEVEKRAGVSFSAIKPYQFTGRGDRIGWVKGVDKKWHLTLFIENGRLLDYPGRSLKTGVAEIAKIHQGDFRLTANQNLIVAGVPEKDKARIEALAREHGLMDDHVTSQRENSMACVSFPTCPLAMAEAERFLPEFVTRVEGILQQHGLADEHIVLRVTGCPNGCGRALLAEVGLVGKAVGRYNLHLGGNREGTRIPRMYRENITADEILLITDQLVGRWAKERHVDEGFGDFVIRAGVIAPVIDSARDFYDVQEAM

SEQ ID NO: 13783 - protein, 662 aa, Candida albicans
MSARKLQQEFDKLNKKISEGLQAFDEIKDKINATESASQREKLENDLKKELKKLQRSRDQLKQWLGDSSIKLDKNVLQENRTKIEHAMDQFKELEKSSKIKQFSNEGLELQSQQKRSRFGDDAKYQEACTYINEVIEQLNGQNEELEQELDSLSGQSKRKGGSSIQSSIDDVKYKIERNNSHISKLEEVLENLDNDKLDPARIDDIKDDLDYYVENNQDEDYVEYDEFYDQLEVDEEDDVEVQGSLAQMAAETEDERRREEERKREEKEKEKQQQNPPRTSSSVSSSSSSNQNNIGNNTPPATQIKPSVVTVAAIGDQNNNSASSASSTSTPVKKLKPTLAPAPAPPPITSATSYSNAIKAAQTASTSSTSNSSIAHTANDNNNTNKGNRSVSPLASTDNHTHAPAAVSTPVKVLPPGLNHDTSMNSTLRSESSSPLVGHAKVNNNHELQISRSQSPMVSNENKVFSDTISRIVNVAHSRLNDPLPLQSITGLLETSLLNCPDSYDAEKPRQYNPVNVHPSSIDYPQEPMYELNSSHYMKKFDNDTLFFCFYYGDGIDSISKYNAAKELSRRGWVFNTEFSQWFSKDSKNGGKNRSMSVIQREEENGNIIGDNSNGNEELREKIDDNGGIPSNYKYFDYEKTWLTRRRENYQFATENRQIFQ

SEQ ID NO: 13784 - protein, 981 aa, Candida albicans
MVKSYNRYDQEKCFGVITSQANIVWLPPSETQSSTSMGRALTSGLEEILIWDIKTGEIMNRMSDGLTPGSSNASTTVPPSPVSYLTYHQETNIIAAGYTDGSIKIWDISSNSVIINFEGHNSSITQLKFDKNGTRLVSGSSDSSIIMWDLIGEVGMFKLKGHKGPITGLELLSEQQNTQQDGDNVDDVDDMDDYLVSVSKDGLIKLWELKSQQCIETHLAHSNECWAMGINPTKDMLITSGNKDQVKVWSLDLSLEDGLKIGERGSFEKTSKSRSNEIAFKSLKSSSSSASLIQLFSIQNADRTMEIFRIRSEDEIKRGITKRTKRLKDKGLDEQEILESLQSSEISMLITPFTTVRTMAKIKSACWTNNIKKLDILMSLTNNSIEYHTIPVPETPKKAQPADLYSVKQHTIDLLGHRFDIRAMDISPQDNKLLATASNGELKIWNTRSYNVIRTFVLEGGYALCCKFLPGGTLIVVGFKNGDLELYDLATSSLVDRVEKAHSAITVGGAAPSNDDSAAIWSLDITPDGKTLVTGGNDKCVKFWNFKVEQDIIPGTNTTVSHLKFVHTQTLELNEDVLCVRISPDAKYLAISLLNNNVQVVFLDTLKLFLTLYGHRLPVLSIDISHDSKLIITSSADKNIKIWGLDFGDCHKSIFAHQDSIMNVRFIGDTHNFFSSGKDGLIKYWDGDKFECIQRLPAHQSEVWCMAISDDGLFMCSTSHDHSIRLWSATDDQVFLEEEKEKELDEIYENKLLDQIDGVDGEDHTNMKDDNDEEIDEATKVSKQTMETLKAGEKLMEALDIGVEDIEANKEYLSLVKQGKQAIKPTPNSILLAFNMTASQYVLNVLSKIRPAQLDDALLVLPFSYSLKLLQFIEIWTNKENITQNVVSISLICKVLFFVISSNSKELISQKDPHLKNQLIKVKEQLRQELSKTSNQLGVNTQGLKFVKKQWKLQHASEFIDEEEQRQYEEKRAIKRTYTTI

SEQ ID NO: 13785 - protein, 129 aa, Zea mays
VALANVVPGFIGGSADLASSNMTLLKMFGDFQKDTAEERNVRFGVREHGMGAICNGIALHSPGFVPYCATFFVFTDYMTHDSIGLGEDGPTHQPIEHLVSFRAMPNILMLRPADGNETAGAYKVAVVNR

SEQ ID NO: 13786 - protein, 490 aa, Saccharomyces cerevisiae
MESKEISIRSRTPPSKLYSIQSCIGRGNFGDVYKAVDRVTQEIVAIKVVNLEHSDEDIELLAQEIFFLAELKSPLITNYIATMLEDVSMWIVMEYCGGGSCSDLLKRSYVNGLPEEKVSFIIHEVTLGLKYLHEQRKIHRDIKAANILLNEEGMVKLGDFGVSGHIRSTLKRDTFVGTPYWMAPEVVCCEVDGYNEKADIWSLGITTYELLKGLPPLSKYDPMKVMTNLPKRKPPKLQGPFSDAAKDFVAGCLVKTPADRPSAYNLLSFEFVKNITITNLKSDVDLIKQKKVQERYTKVPKYPLQNRLYKNSNTVRGKEFWNFESTRLSTTQISKEELSPITQDSPTSSLNMESPYLLHGQTVTPITNPSSSSFRKCTQPVFELDSGMDIDSGCPNAQAETEIVPLSNHNKKHKKNDIQALKIEKFDYLKNIVSHILNRMYDRARDDETRKYVNEMLKQFIKTEANVPGFNEVFIEEISLRIEAIKKGFV

SEQ ID NO: 13787 - protein, 306 aa, Streptomyces coelicolor A3(2)
MYDYDLLVVGSANADLVIGVERRPAAGETVLGSDLAVHPGGKGGNQAVAAARLGARTALLARVGDDDYGRLLLDSQRAAGVDTVGVLVGGAPTGVALITVDPSGDNSIVVSPGANGRLAPGDVRAAASLFHASRVVSTQLEIPLETVVEVVRSLAPDSRFVLNPSPPRPLPQEVLTACDPLIVNEHEAKVILGDSLVGERPEDWARVLLAKGPRSVVVTLGAEGALVASAAGGVVRVPSVKVDAVDTTGAGDAFTAALAWRLGTGESLADAAAYAARVGAAAVTKAGAQESYPTAAEAEDLGAGAL

SEQ ID NO: 13788 - protein, 327 aa, Escherichia coli
MSERHLPDDQSSTIDPYLITSVRQTLAEQSAALQNLSKQLDSGQYQRVLNLIMNCKGHVILSGMGKSGHVGRKMSATLASTGTPSFFIHPAEAFHGDLGMITPYDLLILISASGETDEILKLVPSLKNFGNRIIAITNNGNSTLAKNADAVLELHMANETCPNNLAPTTSTTLTMAIGDALAIAMIHQRKFMPNDFARYHPGGSLGRRLLTRVADVMQHDVPAVQLDASFKTVIQRITSGCQGMVMVEDAEGGLAGIITDGDLRRFMEKEDSLTSATAAQMMTREPLTLPEDTMIIEAEEKMQKHRVSTLLVTNKANKVTGLVRIFD

SEQ ID NO: 13789 - protein, 195 aa, Glycine max
PTRPPTRPPTRPTAARRRQKGKFFSDQDQIDFIDSFQKCLFENTHGVEATEANKLKIYGKDFAAWAKPETADDSMWEDAEEAFTKSPTLVRSNQDLKEEFEEASNGGIQSLALGALDNSFLVSDNGIQVVKNFAHGIHGKGAFVNFSDGYQKGGGGSFYCTPKKTLLMRAETNMLLMSPMGGGKLHSTGFISLIL

SEQ ID NO: 13790 - protein, 473 aa, Bradyrhizobium sp. BTAi1
MADTSFDVIIIGSGPGGYVTAIRAAQLGFKTAIIEKSYLGGICLNWGCIPTKALLRSAEIYHYMQHAKDYGLSAEKISYDPKAVVARSRGVSKRLNDGVGFLMKKNKVQVIWGKAAIDAPGKITVTKSDVESPKGALGEGTYQAKHIIVATGARPRVLPGLEPDKKLVWTYFEAMVPEKMPKSLLVVGSGAIGIEFASFFRTMGSEVTVVEVLPQILPVEDAEIAGIARKQLEKQGLKIMTGAKVTKLDKKTDSVVATIDDGKGKIEAVEFERVISAVGVVGNIENLGLEKLGVKTDRGCIVIDGYGKTNVPGIYAIGDVAGPPMLAHKAEHEGVVCIEAIKGLHPHAMDKNLIPGCTYCHPQIASVGLTEAKAKEQGRDIRVGRFPFVGNGKAIALGEDQGLVKVIFDKKTGQLIGAHMVGAEVTELIQGYVVAMNLETTEEELMHTVFPHPTLSEMMKEAVLDAYGRVLNM

SEQ ID NO: 13791 - protein, 452 aa, Bradyrhizobium sp. BTAi1
MPINILMPALSPTMEKGNLARWLKKEGDQVKSGEVIAEIETDKATMEVEAVDEGTLAKILVPEGTQDVPVNDVIAVLAGEGEDVKAAGSAPAAAAPKAETKAAAAAPAAAAAPAAAPAPKPAAAPAVPAPAAAAAPQLNGHARVFSSPLARRLAKDAGIDLARITGTGPHGRVVARDVEEAKSGKGLKAAPSAAPAAAGAPALAPSMSDKQILALFEPGSYEVIPHDGMRRTIAQRLTASVQNVPHFYLTIDCDIGKLLTAREEINAAAPKDKEKKPLYKLSVNDFVIKAMAVALQKIPNCNVSWTEGGMVKHKHSDVGVAVAMPGGLITPIIRKAETKTLSAISGEMKDFAARARSRKLKPEEYQGGTTAVSNLGMYGINHFTAVINPPHATILAVGTSEERPVVRNGKIEIANMMSVTLSCDHRAIDGALGAELIGAFKQLIENPVMMMV

SEQ ID NO: 13792 - protein, 290 aa, Oryza sativa
MQMSTNPNHYPVFPHSFCNQHVVSFQTSTIANGSGAIPVCPASSGGMNSDMTLLNTTPSTIVSTSSPNMLADSNQSLKYAAPMAVDWSYPELQLLNDGLLKYANEPGIMKYIKIAAMLPEKTVRDVAMRCQWMAAKKENTRRRKTDEHYLGKKTRDRKDKMVESSWATNRQVQTTDIRSPSTLACNTVRDNQFQSGASEIDRAMLNILEENARVLKQIGENIMTSQVQNNIDLFHHARRNISDLLQSMSQMPGIMSKMPPLPVSIDDRLASYILPGVNLAQVFGSSHLRS

SEQ ID NO: 13793 - protein, 465 aa, Bradyrhizobium sp. BTAi1
MPIQVLMPALSPTMEKGNLAKWLKKEGEAIKSGDVIAEIETDKATMEVEATDEGTLGKILIPEGTADVAVNTPIATILADGETAADLGKVAAPAAEMKAAQSAPPAEPAASVQASPAPTGVAAPHSVAEPDPEVPAGTEMVTQTIREALRDAMAEEMRRDGDVFIMGEEVAEYQGAYKVTQGLLQEFGARRVMDTPITEHGFAGIGVGAAMAGLKPIVEFMTFNFAMQAIDQIINSAAKTLYMSGGQMGCSIVFRGPNGAAARVAAQHSQDYSSWYSHIPGLKVVAPYSAADAKGLLKAAIRDPNPVIFLENEVLYGHSGEVPKLDDYVIPIGKARIARSGKDVTIISWSNGMTYALKAADELAKEGIEAEVIDLRTLRPMDTDTIIASVKKTGRAVTVEEGWAQSGVGAEIAARIMEHAFDYLDAPVTRVSGKDVPMPYAANLEKLALPSAAEVVQAAKSVCYR

SEQ ID NO: 13794 - protein, 565 aa, Sorghum bicolor
MALLLASAINHTAHPAGLRSHPNNESFSRHHLCSSPQNISKRRSNLSFRPRAQTISSESAGIHRLSPWEIPRRDWFPPSFLFGAATSAYQIEGAWNEDGKGPSTWDHFCHNFPEWIVDRSNGDVAADSYHMYAEDVRLLKEMGMDAYRFSISWPRILPKGTLAGGINEKGVEYYNKLIDLLLENGIEPYITIFHWDTPQALVDAYGGFLDEEDYKDYTDFAKVCFEKFGKTVKNWLTFNEPETFCSVSYGTGVLAPGRCSPGVSCAVPTGNSLSEPYIVAHNLLRAHAETVDIYNKYHKGADGRIGLALNVFGRVPYTNTFLDQQAQERSMDKCLGWFLEPVVRGDYPFSMRVSARDRVPYFKEKEQEKLVGSYDMIGINYYTSTFSKHIDLSPNNSPVLNTDDAYASQETKGPDGNAIGPPTGNAWINMYPKGLHDILMTMKNKYGNPPMYITENGMGDIDKGDLPKPVALEDHTRLDYIQRHLSVLKQSIDLGADVRGYFAWSLLDNFEWSSGYTERFGIVYVDRENGCERTMKRSARWLQEFNGAAKKVENNKILTPAGQLN

SEQ ID NO: 13795 - protein, 501 aa, Arabidopsis thaliana
MHSVSRLARRFCATLATATAEISGEAAASVPTKAKKHRSIYKKLSSLGTRGGGKMEETLNQFVMEGVPVKKHDLIRYAKDLRKFRQPQRALEIFEWMERKEIAFTGSDHAIRLNLIAKSKGLEAAETYFNSLDDSIKNQSTYGSLLNCYCVEKEEVKAKAHFENMVDLNHVSNSLPFNNLMAMYMGLGQPEKVPALVVAMKEKSITPCDITYSMWIQSCGSLKDLDGVEKVLDEMKAEGEGIFSWNTFANLAAIYIKVGLYGKAEEALKSLENNMNPDVRDCYHFLINLYTGIANASEVYRVWDLLKKRYPNVNNSSYLTMLRALSKLDDIDGVKKVFAEWESTCWTYDMRMANVAISSYLKQNMYEEAEAVFNGAMKKCKGQFSKARQLLMMHLLKNDQADLALKHFEAAVLDQDKNWTWSSELISSFFLHFEEAKDVDGAEEFCKTLTKWSPLSSETYTLLMKTYLAAGKACPDMKKRLEEQGILVDEEQECLLSKICP

SEQ ID NO: 13796 - protein, 541 aa, Coxiella burnetii RSA 493
MRRLFQLIRLIQINFILLRHGFNRPVIGELSPSLRLLSYLNPWSFIQKDKSRGESFRIVLEELGPIFVKFGQLLSTRRDLLPDDIAEELEKLQDRVPPFPGKIAKAMIEKSCGKTIEDCFATFDETPLASASIAQVHAATLHDSSEVIIKVLRPNIAKTIQRDIALMYLGAKLARRFWRHGKRLKPVEVVAEFEHTIYHELDLMREAANASQLRRNFADSEKMYVPKIYWDYVHRDVMVMERIYGIRISNIAELKAANTNLKKLAEYGVEIFFTQVLRDSFFHADMHPGNLFVDVTDPENPKYLGVDFGIMGALSPQDQRYIAENLLAFFKRDYRQVAILHIESGWISADSRIDQFEAAIRTVCEPIFERPLKDISFGKLLLRLFQTADQFNMEIQPQLLLLQKTLLNIEGLGRQLYPDLDLWRTAKPFIEDWMRKQHGPRYLLNTAIKEFPLAVKTTLKLPRLLHDVLHEIHFRQNLERNEPRPPRKKQKRGFILGAGLAFLISALVSFLIAPTSPSPWQWTALGGGILLIIIGWLTPKD

SEQ ID NO: 13797 - protein, 474 aa, Lilium longiflorum
RHGQRAPPQISARSAVDQVRNRFERPLSFWVMPSVVMDQGKNNNTPDSGQDKPDEFDFSKLLHIKPRVLNIDRQTSCDERSLLEHSTGIGIIYPPLVFKNPESNSSRLLDHPEIVSTPGKRSAVNTPKAFNYFEPHGQHPMMDEGWDALKRSLVYFRGQPVGTIAALDHSEEALNYNQVFVRDFFPSGLAFLMKGEPEIVKNFLLKTLRLQSWEKKIDRFKLGEGAMPASFKVNHDPVRNQETLNADFGESAIGRVAPVDSGFWWIILLRAYTKSTGDTSLAENPDCQKGMKLILTLCLSEGFDTFPTLLCADACCMIDRRMGIYGYPIEIQALFFMALRCALLMLNKQDDEGRELAERIAQRLQALSFHLRSYFWLDFRRLNDIYRFKTEQYSDTAINKFNVMPDSLPDWVFDFMPTRGGYFIGNVSPARMDFRWFCLGNCIAIISNLATAEQSEAIMDLLEERWPELVGEMP

SEQ ID NO: 13798 - protein, 130 aa, Yarrowia lipolytica CLIB122
MTRTSVLADALKSITNAEKAGKRQVLIRPASKVIIKFLQVMQKHGYINEFTYVDDHRSGKIVVELNGRLNKCGVISPRFNVKIDDMEKWVQNLLPSRQFGYIILTTSAGIMDHEEARRRHVAGKILGFFY

SEQ ID NO: 13799 - protein, 565 aa, Candida albicans SC5314
MEKSNNQIVTSEKAQDNISCSAVTTNSKQHLGFVDSFIDSFRRAPESNTSAENKRQTISKNELRLMAISTGLGTGLLVATGGRLRAAGPAGMVIAYAITGLVMLAPTVNSVAELAIAYPGLPGGFQSYYGKFIDESLGFALGWNYGFQWMCILALEFVTVSMTFKFWTTSVHADVFVAIFFIIVTLVNLGGAKVYAVTEAALNSIKIVFLVGFIIFGIIIDVGGGPNGFIGGKYYHSPGAFTSFKGLASVFVSGAFSLGGSEFISLSASETKHPKTAIRAASKLVYFRVIVLFLGSLTLVGLLVPRDSDNLMHGSGSSVSPYVLAAKLNGVKVIPHIINTVILLSVTSVACAAMYSSPRLIQSLAEQGLGPKWLDYIDKKGRPTRAWFITILAGAFGFIAAFKDHETVFMWLLSISGISFVMCWLFICVCHLRFRSALKLNGIDVKTLEYVSPTGIWGSYISIIINSLILVAQFWISLWPLGGDGKPNALSFFENFLGGPVFLICYIGHKLWTKNWKLYKKVEDIDVNKDRVVKDTEILHLENLEDKERYEKAPLWKKILIICFD

SEQ ID NO: 13800 - protein, 571 aa, Candida albicans SC5314
MSSSSTASEVHKAPVVKNIEKQDMDMYSASSSSAPKTTWNNFIDSFHRADGKTSAESKDQRISKTELRIMSLSTGLGTGLLVASGSKLRAAGPAGVLVAYFITGICMLAPTINSVSELAIAYPGLPGGFQSYYAKFIDESLGFALGWNYAFQWMCVLALELVTSSMIIKFWTTTVNPDVFVAIFFVFVTLINMGGAKVYAVFEASFNCCKILLLVGFVIFGLIIDVGGGPQGFIGGRYYHDPGAFTSFKGLASVFVTGAFSLGGSEFISLSASETRHPRASIRAASKLVYFKVIVLFLGSLTFVGLLVAYNNDRLMGSGDAASHASPYVLAAEMNGIRVLPHIINAVILISVVSVATAAMYSSPRLVQSLAEQGLGPKWLDYIDKKGRPTRAWFITVLAGLFGFIAAYEKQETVFVWLLSISGISFIMCWLFICVSHIRFRAALKYRGITLDQLAYVSPTGVWGSYLSVLINSLILIAQFWISLWPLGGDGKPNANSFFENYLGAPVFLVCYIGHKLWTRNWKLFKKVEDIDIDTHRMICDPELLALEDLEDKERYQKAPIWKKILIKCFD

SEQ ID NO: 13801 - protein, 303 aa, Burkholderia thailandensis E264
MRRSARRRSTGVRSRASTRRCSATYRSASVERRARRMEAGRRRAARMPISSAPIRLPMRPIFRQLRGFRATSRIARPFDVERSNPERVGFGDSNPSRRAACQPYTARRAKPRGRHAMRGAIVSVSSRHQRIRSMSSRRIVVRRSGVHGKGVFAAVPIKAGERVVEYKGERISWKEALRRHPHDPNDPNHTFYFALEEGGVIDGKIDGNSARWINHSCAPNCEAEEVDGRVYIHALRDIGEQEELFYDYGLVIDARLTKKLKREYACHCGAATCRGTLLATSEDDEGKKKKKAKKGGKDKKKKK

SEQ ID NO: 13802 - protein, 337 aa, Oryza sativa
MVPKVGINGFGRIGRIVFRNAINHGGVDVVAVNDPFIEVHYAAYMLKYDSTHGQFKGTIEIDGTSGLIVNGKKIRFYAERDPASIPWSETGAAYVVESTGVFTTTEKASAHLKGGAKKVIISAPSADAPMFVMGVNNDSYKSDVNVLSNASCTTNCLAPLAKVINDKYGLVEGLMTTIHSYTATQKTVDGPSAKDWRGGRTAAQNIIPSSTGAAKAVGKVIPSLNGKLTGMAMRVPTANVSVVDLTCRIEKAATYEDIKATIKAASEGELKGILGYTEDDIVSSDLNGDDNSSIFDAKAGIALNPNFIKLVSWYDNEWGYSHRVVDLIAYIAKVDGQ

SEQ ID NO: 13803 - protein, 547 aa, Idiomarina baltica OS145
MLTTELSGNMMQRPLQIIDILRYAATRYPHQEIVTRRLEGDRHRYDYQACYQRTCQLAHGLNQLGIQPGERVASLAWNTYRHMELYYAVSGIGAVMHTVNPRLFEEQIAWILNHAESTWVFVDISFLAILEQIAPELKHVKGFIVMVDEDQMPDPKLNNLYNYETLLASNAPAYEWPDIDEQSAALLCYTSGTTGHPKGVLASHRAMVLHAQATMGKDMLALDEDTVLMPMVTMYHVAAWGAPYAAPLAGSKLVFSGDGTSGEVMSELIRQEQVSVGLGVPTIWLTLHNHLSESKQSIPTLKRVCVGGAASPLGLVKTYDQVYNVYWQPIWGMTETGPLVYSAPPTRDILTRTKEEQYRIQTTAGRPVFGSEARIVDLDNNPLPHDGETRGELQVRGHWIASQYFRNDDLTSFPGGWLATGDIAVIDPEGFMKVVDRKKDVIKSGGEWISSLDIENIASQHPAVNEACVIGVKHPKWDERPLLLIVPNAGKTIDETEIKDFLTGKIARWWMPDAILLVEQLPHTGTGKLLKTDLRTQYQNFLLENAS

SEQ ID NO: 13804 - protein, 410 aa, Thermoproteus tenax
MSEQTVSIRTTGKIIQSPCGPIIHGLEDVLVKITTISDIDGHTGRLWYRGYRIEDLAENTTYEEVVYLLLYGKLPSARELADIKSRLSANRELNPATIEILRALAKAHPMFALEAAVASEGAFDEDNLKLADALRAGRYKQEEKDLALRIAEKLIAKLPTIVAYHYRLSRGLELVRPRGDLAHSANFLYMFFGKEPDPLATKAIDLYLILHADHEIPASTFTALVIGATLSDLYSVIAGAIGALKGPLHGGANEAAVKSYLEIADPSKAKEIVEAATKPGGPRLMGVGHRVYKAYDPRAKIFKKLVEDYTAKFGDPQRLYAIASNIEQAVMAHPYFQQRKLYPNVDFWSGIVFYYMGIPYDYFTPLFAMSRVAGWTAHVLEYWENNRLFRPRACYVGPHDQQFIPLENRS

SEQ ID NO: 13805 - protein, 427 aa, Bradyrhizobium sp. BTAi1
MTAIVDIIGREILDSRGNPTVEVDVVLEDGSVGRAAVPSGASTGAHEAVELRDGDKHRYLGKGVLKAVEAINDEIYEALSDMSVQDQVQIDQILIELDGTPNKSRIGANAILGVSLACAKAAAISYDMPLYRYVGGTSARTLPVPMMNIVNGGVHADNPIDFQEFMIMPVGAPSFAEALRCGSEIFHTLKGELKKAGHNTNVGDEGGFAPNLPSADAALDFVMSAIGKAGYNAGEDVMLALDCAATEFFRDGKYVYEGENKSRSRSEQARYLADLVARYPIVSIEDGMSEDDMDGWKELTDLIGSKCQLVGDDLFVTNVNRLADGIRNGRANSILIKVNQIGTLTETLAAVEMAYKAGYTAVMSHRSGETEDSTIADLAVATNCGQIKTGSLARADRTAKYNQLLRIEQELDAQARYAGRSALKALA

SEQ ID NO: 13806 - protein, 368 aa, Xylella fastidiosa 9a5c
MSKRDYYQVLGVPRTASEDDLKKAYRRCAMKYHPDRNPGDAAAEAAFKECKEAYEVLADTKKRKLYDTHGHAAFEHGVGGGNAPDMNDIFGDIFGNIFGGARASRRGADVGYMVELDLEEAVAGVERQIQIPTLVECTHCHGSGSEDGHVETCGTCRGSGQVRIQRGIFAMQQTCPHCGGRGVIIRNPCKVCNGAGRVEDHKTLSVKIPAGVDNGDRIRLSGEGEQGPEGVPPGDLYVEVRVREHPIFQRDGDDLHCEVPVRISQAALGDIVRVATLDGEAEIRIPAETQSGKLFRLRGKGVRSVRSRTEGDLYCRIVVETPVNLTAEQRKLLEQFEMTFAGEDARKHSPKSATFLDGVKSFWDRMTS

SEQ ID NO: 13807 - protein, 318 aa, Mortierella sp. M10
HRAHHRWTDTEKDPYSAHRGLFFSHIGWMLIKRPGWKIGHADVDDLNKNKLVQWQHKHYLPLVLFMGVIFPTIVAGLGWGDWRGGYFYAAILRLVFVHHATFCVNSLAHWLGEGPFDDRHSPRDHLITAFMTLGEVYHNFHHQFPQDYRNAISLLPVRPHQSGSSPSAPFFGLASHLKTFPENEVRKGQLQMIEKKVLEKKTKLQWGTPIADLPVLSFEDYQHACKNDGKKWILLEGVVYDVAEFMNEHPGGEKYIKMGVGKDMTAAFNGGMYDHSNAARNLLSLMRVAIVEFGGEVEAQKKNPSVPVYGDDHHSKSE

SEQ ID NO: 13808 - protein, 816 aa, Burkholderia sp. 383
MLSPDTSRTAESAAPLAAIIIGAGFAGIGMAIALQRAGIHDFAIVERSHDVGGVWRDNSYPGAACDVPSHLYSFSFEPNPAWSRVFAPQPEIHAYLQHCARKYGLARYLRFGAEVAHARYDEAAALWRVTLADGTTLSAAVLVSSTGQLSRPAMPDLPGIDTFRGRAFHSAHWDHDYSLTAKRVAVVGTGASAIQFVPAIAGDVKRLVVFQRSPAYVMPRPDRAYHPWEKALFRRLPWAMKLHRASIYLRYESRAIAFTRLHKLMKVAVGRPFHKLLARDVPDPALRAQLTPDYPIGCKRILLSSEYLAAMSRDNVELVTQRIRRVTEDGIETVDGVHHPVDAIVYGTGFAATEFLSPMRITGRDGLDLNDAWRRGAQAYLGLTVPGFPNFFMLYGPNTNLGHNSIVYMLESQIAHVMRCLRTMRRDGAREIDVDARRYRRFNVHVQQRLEGSVWNSCKSWYVDASGHNSTNWPGFTLTYRWITRFTGMSAYRFTHPLPESVAPARDVVVAPPAGRLEALTAASLRGFLRVAFRPLIGPPFGARMQRRVVALLSPLMPGTSGTLRYRTSAHRVPVEVVAPKRGDAGGAILYLHGGAFCLGGPHTHRGVTTRLANEAGLPVWVPDYRLAPEHPSPAALDDALAVYDAMRAQGHAPHRIVIAGDSAGGALALALAIALRERGEPAAAALLLISPVTDPALGGATLASRRHDDPMIRRGWLEQGLRWYHGAGSVAARGPLDTDLRGLPPMLVQAGDQEVLLSDALRLARHAQACGVPCRLEVHAARWHVFHLQAFYLRSARDALRTLARFAAERVAVTA

SEQ ID NO: 13809 - protein, 171 aa, Sporobolus stapfianus
MASASKEEVIGKLNVRVVRGSNLAICDPLTHTSDPYVVLHYGAQKVKTSVQKKNPNPVWNEVLQLSVTNPTKPVHLEVFDEDKFTADDSMGVAEINLTDIYDAAKLDLKHAADGTRIKTIYPVGVNYLGGESHVMWKDGKVVQDLILKLTKTDSGLITLQLEWVHVPGVKL

SEQ ID NO: 13810 - protein, 207 aa, Legionella pneumophila subsp. pneumophila str. Philadelphia 1
MSDLDINSLDWQKMNGLLPAIIQNAENGKVLMLGYMNQEALIATLTTGQLTLYSRSRKRLWRKGESSGNSMALQHISADCDNDSLLIQVIPKGPACHLGYSTCYQPHNNYTLGFLDGLIELINERAEEKNPNSYTAQLLDSGVNRCAQKLGEESVETVIAAVSNNKEELINEASDLIYHLLVLLKACELSFYDVLLCLQARDRSVHT

SEQ ID NO: 13811 - protein, 403 aa, Propionibacterium freudenreichii subsp. shermanii
MRTLSDLGDLRGKRVVIRCDFNVPLKGEEITDDGRIRAALPTLEALLGQGARVTAMAHLGRPKGKRDPKLSLAPVAKRLADLLGQHVEFATDTVGLSALKASANLNDGEIALVENVRFEPAETSKDDAERMELAKKYAELGNYFVSDGFGVVHRKQASVYDIAKLLPSAAGELVGKEVSVLSKITHDPERPYVVVLGGAKVADKLAVIDNLLKVADTLIIVGGMAYTFLRAQGKQVGGSILDASKVDACRGYLADAKAAGKSILLPVDVRVAKGMDLDARTVDGPVSVVSVDDIPADQEGLDIGPATEKLFAEQIAGARTVFWNGPAGVSEIDELANGTRAIARALATGDAFSVIGGGDSAAAVRKFGYTDDQFSWISTGGGASLEYLEGKELPGLAVLDKEN

SEQ ID NO: 13812 - protein, 262 aa, Propionibacterium freudenreichii subsp. shermanii
MARKPIMAGNWKMNLNHIDAVGLVQKLAFTLADKGYDPEQSECVVIPPFTALRTVQTLVEGDKLPIVYGAQDLSPHDDGAYTGDISSSMLTKLGCSYVVVGHSERREYHAETDEVVNAKARKALDAGLTPIICVGESLEVRKAGKHVEHVLAQVTGALAGITAEQAASLVIAYEPIWAIGTGEVATPEDAQEVCGAIRAAVADLYDAPTGDAVRIQYGGSVKPGTVAAIMAKPDIDGALVGRASLKADDFAAIVRFYAMAQA

SEQ ID NO: 13813 - protein, 250 aa, Propionibacterium freudenreichii subsp. shermanii
MLWVGTSWKMNGTRASSRTYVEALKQADHSAWDGVQAFIIPPATVLAEVSELLGPDSDVLLGAQNAHWADAGAWTGEVSVPQVADAGAQLVEVGHSERRANFGDTDEVVNKKVRAIIGHGLRPVLCVGESQEVFDAGDSVKFITDQADSALQGVDPSSVVLAYEPIWAIGEHGREPQRDDLLRAFDALQSRYGDAVTAVIYGGSANPGNARELLGIPGVEGLFIGRAAWTGPGYVQMLGIAGEVARAHQG

SEQ ID NO: 13814 - protein, 468 aa, Zea mays
SPAPQRPPALPLLARLHPRPPPPCGPRRLLASTAPRVTPFMHRLVLEHGRTSMSWFGPSPKVTIVDPDLAKDVLSNKFGHFEKLKVPALSKMLGSGVASHEGEKWVKHRRILNHAFHLEKLKRMLPAFSTCCEELVSRWAAESLGSDGSCELDVWPELQNLTGDIISRTVFSSSYSEGRRIFQLQVEQASLVMTNIRKIMIPGYMYLPTANNRKMRRNNREVESILREIIGKRIQAMEQGEGTKDDLVGLLLETNMRDDMGMTIEDVIEECKVFYFVGMETTLVLLMWTMVVLSMHPEWQDRAREEVTALFGRDDKPEYDGLSRLKVVTMVLYEVLRLYPPATSVVRQTYKEMEVGGVTYPAGVILELPVLLIHHDPDIWGGDAREFRPDRFSEGVSRASKDPGAFLPFGWSPRICIGQNFALLEAKMALCMILQRFEFGLAPSYAHAPHTMITLHPMHGAQLKLRAI

SEQ ID NO: 13815 - protein, 474 aa, Propionibacterium freudenreichii subsp. shermanii
MALLQNFINNRFVASTSTESFNLVDPATAEVTGQSPASNQADVDAAYAAAKDATRTWGKMIPGERQRAMLKLADAIEAHSDELVAAQSRNTGQPKHLIASEEVTVGADQIRFFAGAARIMEGLASGEYMENMNSVIRREPIGVVGQVTPWNYPLMMAIWKIGPALAAGNTIVLKPSDTTPESTLLLAQLAAEFLPEGTFNVVLGRAATGAMVVGSKVPGLVSITGSVRAGIEVAKAAAENLTRCHLELGGKAPCIVFDDADVDAAAEALTTAGFFNAGQDCTSSTRLLVQAGVHDEFVAALAKYARSTRFGSPDDADALYGPLNNANQLARVQQAVDSLPAHAEVVTGGKQADRPGFYFEPTVLDGLNQDDALVQNEIFGPVLTVQTFDTEDQAVAMGNGVPYGLASSVWTRDHARALRMSAALDFGCVWINCHIPLVAEMPHGGFKSSGYGKDLSKYSVEEYTRVKHVMSSME

SEQ ID NO: 13816 - protein, 321 aa, Pseudomonas syringae pv. phaseolicola 1448A
MDQLPVIDIAPLYGTDLEAWQDVARQIDSACRQWGFFYIKGHPISAQRIEQVQSAAKDFFARPAAEKLIIDITQSTHHRGYGAIATEQLDPSLPSDLKETFDMGLHLDASHPDVLAGKPLRGPNRHPDIPGWEGLMEQHYLDMQALAQTLLRAMTLALGIERDFFDQRFKDPVSVLRMIHYPPRDTATSAEQQGAGAHTDYGCITLLYQDTAGGLQVRDVRGEWIDAPPIDGTFVVNLGDMMARWSNDRYLSTPHRVISPLGVDRYSMPFFAEPHPDTRIECLPGCQSESQPARYPVTTCAEFLLSRFADTYAYRRDQEAS

SEQ ID NO: 13817 - protein, 266 aa, Halobacterium sp. NRC-1
MDVYGLIGNPVGHSLSPPLHAAAYDECGLDARYVTFEPAPDDAAAAIRGAGALGVAGLNVTAPFKQSAASAVATDSMAARVGAVNTIDFSGAAPRGYNTDVAGVKRAFAHHDVSLSGAQAVVVGAGGAGRAAAFALADAGATVRIANRTRAAADELAADVGGTAVGLGDLPRSLADATVLVHATTVGMDDPDTSPVSADALHDDLAVLDAVYSPVETRLLRDAAAAGATTIDGAWMLLYQGAEAFERWTGLDAPVAAMRAALRARL

SEQ ID NO: 13818 - protein, 488 aa, Pseudomonas syringae pv. phaseolicola 1448A
MANRHASGHSTSVLRVAQMSVATRLIDDQLTRVAPAAAETLYQFEESPLLARQNRQESNARSYPRRIPLALKRAKGIHVEDVEGRRFIDCLAGAGTLALGHNHPVIIEAIQQVISDELPLHTLDLTTPVKDQFVQDLFGLLPQQLANDAKIQFCGPTGTDAVEAALKLVRTATGRSTVLSFQGGYHGMSQGALSLMGSLGPKKPLGALLGTGVQFLPYPYDYRCPFGLGGEQGVRANLHYLENLLNDPEAGVQLPAAVILEVVQGEGGVIPADLDWLRGVRRITEKAGVALIVDEIQSGFARTGKMFAFEHAGIIPDVVVMSKAIGGSLPLAVVVYRSWLDTWLPGAHAGTFRGNQMAMATGSAVMRYLQEHNICEHATAMGARLSRHLHALQRDFPQLGDIRGRGLMLGVELVDPAGVRDAQGHPPVFARLAPLVQRECLKRGLILELGGRHGSVVRFLPPLVITAEQVDEVAEIFGRALNAAVAQL

SEQ ID NO: 13819 - protein, 587 aa, Nocardia farcinica IFM 10152
MSRWCAFLTEDDPAAHVRAVGAEPITAGPITAGSITAAGPHGFGLLDGPGVAAGPFTAGALTAVGEVTLFNADRLRARLGADAPPPGRPDGEVLLHSYARFGLDGIAAAEGMFALAVADGPDLVLLRDQLGARTLFHARARAGWAASTSLRALRRWPALRTGLHLPAVRSFLTFAYLPGRETLLRDVHEVLPGRCLRLHPDGTSTEHTYWEPREHIDERPASEHALRLRALLEDAVTRRLPAGEPVGVLLSGGIDSSLVTALAAKLHDQAVHTYSISFGADAPDELGYSGLVATHCHTRHRVLTVPGQTVAARLADTVGLLDSPVGDPLTVPNLMLAEAVAADGIRVALNGEGGDPVFGGPKNLPMLIFELTRDDPAEDARAHAYLDSYRKCYADLPALLTRDALAALADAPGPVEHVAPYLRPGAMTSLLNQLLHTNLRTKGAHHILTKVERLTAASGIEGRAPLFDRAVVDHAFAVPPTMKLAGTSEKWILKQAVRDLLPKTIVDRPKSGMRVPVQQWLDGPLRELAHDLLLGRTARERGLFRADTIRAWLRGEGALLPRQGGKLWLVLSLQLWLRSFDLEESVR

SEQ ID NO: 13820 - protein, 293 aa, Streptomyces ambofaciens
MPQEEAEITPPYRFQRQQRPGLEAEMEVRPRYLAPNYRGSGKLQNKVALITGGDSGIGRSVAVLYAREGADVAIVYLPEEEQDAAETREAVEKEGRTCLMLPGDLCDPSFCADVVQRTVAELGGLNVLVSNAAYLNSQNDITDLTAEDFDRVFKTNVYAYFHLLMAALPHLSHGDAVIATASEEALKGSDMMMDYAASKAAMVVFTKSIASHLAARGVRANVVSPGPTWTVLNVAGQRFPDDYLTHLGSSAPMGRVAQPEEVAPAYVYLASDADSSFTVGEVIAVTGGLTDTR

SEQ ID NO: 13821 - protein, 251 aa, Bradyrhizobium sp. BTAi1
MTDHIRPLIAGNWKMNGLKASTAEFEAMLAGAAEVTGKADLLVCPPATLLAGFADKARGTRAVAVGAQDCHAKASGAHTGDLSAEMLADAGASAIIVGHSERRADHGESDVVVHQKTEAVWRAGLVAIVCVGETQQQRDAGQTLDILRGQLNLSLPQGSTAANLTVAYEPVWAIGTGLTPTAKDVEQIHAFIRTLLIERFNGEGARMRILYGGSVKPSNAAELMAVANVNGALVGGASLKAADFLAIAKGC

SEQ ID NO: 13822 - protein, 519 aa, Oryza sativa
VKRRELRPLARRRRRPVLRGGRGKLSTVVRARRPEATARQDLARRARVREISPQNPGRKKKGGTPEASDAAAAAPARTLGCGVGSATAALPFSRGGRGVGLAPPPRSLGRGGGPAVAAIPPGGFPSYSASMDGFPFPPPFDGSYRGGFPSSSAWLDASGGDESSPGSWDKDVHPRGGFMSYFGNHAQNSHLVGAPIYIADASSPPEVEILQGNDDGNGNGNVRTEKRILWTEEEDIILMSAWIEHSTDSTCGADKGGGQYWGEVVESYNKTTPPLRKRNLKQCKDRWHKINRWTDLFECAYVKARRIFTSGYSNQMWIDAAHKFYVDDNKEAKLGPFVLMEVWKICREVSKWKTYNDNLRNARKRKSFHLEGDSEEADDTFDEMPKRPMGQKAAKKAALDAKIKSNGLGSSDDGHSKESPIQLDKFDRYSKFQEENNDKRMKLLDRQEKISSEKLEATKIAHLTAQEYKEGRKLEKESKMMETYNSLISQDTSSMSAEEKAQRVSMMKCLMKTLFPESD

SEQ ID NO: 13823 - protein, 505 aa, Mesorhizobium sp. BNC1
MTISYDKVREVASTLRFPAQAFINGELCWAEDGDKFDTVNPATGEVLCSVAHCKKEDVDKAVIAARRSFNDGEWSRAEPEHRKEVLTRLSHLIRENAFELAVLESLDSGKTITDCLKEIGTEVANFFQWYGELIDKSFGKVAPTGESALALIVKEPAGVVGIIVPWNFPLLMTAWKVAPALAAGCSCIVKPAEQTPLSAIRMAELAQQAGLPDGVLNILPGLGETAGQAIGRHNDVDIISFTGSTEVGGFFLRYSGESNLKVVGLEMGGKSPFIVLDDADLNDDLVEHAVSSAFWNGGQNCSANMRQLVDTRVADEFVERVVARAEKYKVGDPLDPSTDIGAMVTEEHMKRVVGYIERGESEGARRLTGGARQGRGYFIEPTVFSGLRPEMTIAREEIFGPVLGVMPVKGLDDALRIASDTIYGLHATVFTRDLDRALHLARRLPCGTVSVNGFSEGDIKTPFGGYKQSGSLSRDNGTEAMDQYLQTKTIWITLRGPSNRGSIAG

SEQ ID NO: 13824 - protein, 147 aa, Brassica napus
  misc_feature (16)..(16): Xaa can be any naturally occurring amino acid
  misc_feature (21)..(23): Xaa can be any naturally occurring amino acid
  misc_feature (26)..(26): Xaa can be any naturally occurring amino acid
  misc_feature (29)..(30): Xaa can be any naturally occurring amino acid
  misc_feature (33)..(33): Xaa can be any naturally occurring amino acid
  misc_feature (41)..(41): Xaa can be any naturally occurring amino acid
  misc_feature (43)..(44): Xaa can be any naturally occurring amino acid
  misc_feature (47)..(47): Xaa can be any naturally occurring amino acid
  misc_feature (52)..(52): Xaa can be any naturally occurring amino acid
  misc_feature (57)..(58): Xaa can be any naturally occurring amino acid
  misc_feature (60)..(60): Xaa can be any naturally occurring amino acid
  misc_feature (62)..(62): Xaa can be any naturally occurring amino acid
  misc_feature (73)..(73): Xaa can be any naturally occurring amino acid
  misc_feature (89)..(90): Xaa can be any naturally occurring amino acid
  misc_feature (92)..(92): Xaa can be any naturally occurring amino acid
  misc_feature (105)..(105): Xaa can be any naturally occurring amino acid
  misc_feature (114)..(116): Xaa can be any naturally occurring amino acid
  misc_feature (118)..(119): Xaa can be any naturally occurring amino acid
  misc_feature (121)..(122): Xaa can be any naturally occurring amino acid
  misc_feature (124)..(124): Xaa can be any naturally occurring amino acid
  misc_feature (126)..(128): Xaa can be any naturally occurring amino acid
  misc_feature (130)..(130): Xaa can be any naturally occurring amino acid
  misc_feature (132)..(135): Xaa can be any naturally occurring amino acid
  misc_feature (137)..(142): Xaa can be any naturally occurring amino acid
MISLLSLGFSRCNRWXVSLPXXXSEXIPXXSLXISASSENXGXXEEXATEKXPAALXXYXQXIRANNLVFLSXVLGLILETGKFVSHSXXDXTEQVLKNMGGDIXKLGGVDYSXXXEXXNXXLXTXXXFXKXXXXYXXXXXXPFSCQ

SEQ ID NO: 13825 - protein, 475 aa, Bacillus anthracis str. Ames
MQQTTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVEMEKANETNNQTR

SEQ ID NO: 13826 - protein, 352 aa, Legionella pneumophila subsp. pneumophila str. Philadelphia 1
MKKILFIDRDGTLVEEPFDFQVDSLDKIKLTSGVIPALLQLQKAGFTFIMVSNQNGIGTVAFPEEDFAVCHEFILDLFSSQGILFDEIFICPHTPENNCICRKPKTGLLEPYLKETVFAKQYSWVIGDRDTDKEFADNLGVNFLPISKTHTWEMVASAIINDARKASVQRKTKETTIDLSVQLDSDQTSVIDTPIPFFTHMLEQVAKHGGFDLRLQASGDLEVDEHHLIEDTAIALGEAIRTALGDKWGINRYGYTLPMDESLATIAIDISGRSFCDFKGQFTREFIGGMATEMIPHFFQSLSSALGATIHIEVTGTNHHHMIEACFKVLGRALRQACSRTNNYLPSTKGVL

SEQ ID NO: 13827 - protein, 516 aa, Vicia faba
MPAAGIPIGAGNKEYPGNLTPFVTITCVVAAMGGLIFGYDIGISGGVTSMNPFLEKFFPAVYRKKNAQHSKNQYCQYDSETLTLFTSSLYLAALLSSVVASTITRRFGRKLSMLFGGLLFLVGALINGLAQNVAMLIVGRILLGFGIGFANQSVPLYLSEMAPYKYRGALNIGFQLSITIGILVANILNYFFAKIKGGWGWRLSLGGAMVPALIITIGSLILPDTPNSMIERGDRDGAKAQLKRIRGVEDVDEEFNDLVAASETSMQVENPWRNLLQRKYRPQLTMAVLIPFFQQFTGINVIMFYAPVLFNSIGFKDDASLMSAVITGVVNVVATCVSIYGVDKWGRRALFLEGGVQMLICQVAVAVSIAAKFGTSGEPGDLPKWYAIVVVLFICIYVAGFAWSWGPLGWLVPSEIFPLEIRSAAQSVNVSVNMLFTFLVAQIFLTMLCHMKFGLFLFFAFFVVVMTIYIYTMLPETKGIPIEEMDRVWKSHPYWSRFVEHDDNGVEMAKGGVKNV

SEQ ID NO: 13828 - protein, 429 aa, Propionibacterium freudenreichii subsp. shermanii
MASIEFIEAREILDSRGNPTVEVEVVLDDGSSARAGVPSGASTGQFEAVELRDGDENRYGGKGVQKAVGNVVETIGEEVLGMEASRQRELDEAMIELDGTDNKAKLGANAILGVSLAAAKASAESAELQLYQYIGGPTANELPVPMMNILNGGAHADSNVDIQEFMIAPIGAKSFAEAMRIGAEVYHTLKGVLKERGLGTGLGDEGGFAPNLDNNREALDLIEDAIKAAGYKPGKDVALALDLAASEFYTDGRYEFEGKSRSTAEMIEYLEKLVNDYPLVSIEDPLDEEDWDGWSTLTERIGDKVQIVGDDLFVTNVERLQKGITEKAANALLVKVNQIGTLTETIDAVTLAHRNGFHTMMSHRSGETEDTTIADLAVALGCGQIKSGAPARGERVAKYNQLIRIEEDLDEAATYAGAGAFPKFDSTKW

SEQ ID NO: 13829 - protein, 102 aa, Glycine max
MIQVADIKRMNGLATDLQMFALKTLKIPLPGRHPPSPSPGPHEEPTKSGDASSERKPLRIGQSAMKEPLQSLRLKPPQPNISPAMSILQKFYGLKSSNQEIR

SEQ ID NO: 13830 - protein, 423 aa, Propionibacterium freudenreichii subsp. shermanii
MPRQTITTLDAMEILDSRSRPTLMVRLSLSDGTRARAMVPSGASTGTHEAVELRDHDPHRFGGLGVLAAVDHVTHEIADAIVGRRFESVGELDESLLALDGTPNKSRLGANAILGVSMAFTRALAASGGNELFEYLPGIGGQPPRLPVPCFNVLNGGVHAANPLDFQEFMICPTGMDSMTDAVRAGSEIYSALRARLKDSGQPVGLGDEGGFAPDFAEPEQALDTIVAAIGDAGYTPGLEGVAIAIDPASSEFRQADGRYLVNGRSFTSAQMIERYQAIVHGYPVWLLEDGLAEDDWDGWQQLTRELGSRVELVGDDIFCTNPELIRKGIERHVANASLIKLNQIGTVTETLDAMNICAAAGYRQFMSHRSGETPDAFIADLAVATGCGHIKSGAPARGERVAKYNRLLEIAADHPELAYGLG

SEQ ID NO: 13831 - protein, 470 aa, Bacillus cereus ATCC 10987
MVVGDFPIELDTVVVGAGPGGYVAAIRAAQLGQKVAIIEKANLGGVCLNVGCIPSKALINAGHRYENAMHSDDMGITAENVKVDFTKVQEWKNGVVKKLTGGVEGLLKGNKVEIIRGEAYFVDANTLRVMTEDAAQTYTFKNAVLATGSTPIEIPGFKYSKRVINSTGALSLPEIPKKLVVIGGGYIGMELGTAYANFGTEVTVVEAGDEILAGFEKAMSSVVKRALQKKGNVTIHTKAMAKGVEETETGVKVSFEVKGEIQTVEADYVLVTVGRRPNTQEIGLEQVGVKMTDRGIIEIDEQCRTNVPNIYAIGDIVPGPPLAHKASYEGKVAVEAISGHASAIDYIGIPAVCFTDPELASVGYTKKQAEEAGMTVTVSKFPFAANGRALSLNSTDGFLQLVTRKEDGLLVGAQVAGAGASDIISEIGLAIEAGMTAEDIAQTIHAHPTLGEITMEAAEVALGMPIHIVK

SEQ ID NO: 13832 - protein, 429 aa, Bacillus cereus ATCC 10987
MAFEFKLPDIGEGIHEGEIVKWFIKPGDEVNEDDVLLEVQNDKAVVEIPSPVKGKVLEVLVEEGTVAVVGDTLIKFDAPGYENLKFKGDDHDEAPKAEEAKEEAPKAEATPAATAEVVNERVIAMPSVRKYARENGVDIHKVAGSGKNGRIVKADIDAFANGGQAVAATEAPAAVEATPAAAKEEAPKAQPIPAGEYPETREKMSGIRKAIAKAMVNSKHTAPHVTLMDEVDVTELVAHRKKFKAVAADKGIKLTYLPYVVKALTSALREYPMLNTSLDDASQEVVHKHYFNIGIAADTDKGLLVPVVKDTDRKSIFTISNEINDLAGKAREGRLAPAEMKGASCTITNIGSAGGQWFTPVINHPEVAILGIGRIAEKPVVKNGEIVAAPVLALSLSFDHRLIDGATAQKALNQIKRLLNDPQLLVMEA

SEQ ID NO: 13833 - protein, 333 aa, Oryza sativa (japonica cultivar-group)
MPAVAGSLYMASQHKGVPPPLPPPPRPLPVINLGRLTMDSASRALAVRDIVLACRERGCFEVVNHGISRSCMNGALEAASEFFQLSTERKEEFASDDIRQPIRYDTSSRDGISMSRSFLKHYANPLDDWIKFWPTQPPTYREKMGEYAVETQRVSMQLMEAILQGLGLGPSYLQEKLEGGVQFVALNNYPQSSAKKADKIGLAPHSDYGFLTILLQSSPGLEVMHHEDDAWTSVPAIPGALHVHVGDHLEVLSNGQLKSLVHRAVLNPNESRISIASIHGLSMDEEVHCAEELVDEHHPKMYRGSSFQDFLDFLPANMNRYKRYVESLRIDKP

SEQ ID NO: 13834 - protein, 564 aa, Saccharomyces cerevisiae
MSSAQSSIDSDGDVRDADIHVAPPVEKEWSDGFDDNEVINGDNVEPPKRGLIGYLVIYLLCYPISFGGFLPGWDSGITAGFINMDNFKMNFGSYKHSTGEYYLSNVRMGLLVAMFSIGCAIGGLIFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYDNTAQWRVPLGLCFLWALIIIIGMLLVPESPRYLIECERHEEARASIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAAGMMACMVIFASIGVKCLYPHGQDGPSSKGAGNAMIVFTCFYIFCFATTWAPVAYIVVAESFPSKVKSRAMSISTACNWLWQFLIGFFTPFITGSIHFYYGYVFVGCLVAMFLYVFFFLPETIGLSLEEIQLLYEEGIKPWKSASWVPPSRRGISSEESKTEKKDWKKFLKFSKNSD

SEQ ID NO: 13835 - protein, 251 aa, Propionibacterium freudenreichii subsp. shermanii
MHMTSKLILLRHGESEWNAKNLFTGWVDVDLNEKGVREASHGGELLAQEGLLPDIVHTSLLRRAIHTSYLALDKADRLWIPVKRSWRLNERHYGALQGLNKSEIRDQYGEEQFMAWRRSYDVPPPAIEPDSKFSQFNDPRYADIPADERPLHECLKDVVERMLPYWESSIVPDLKAGKTVLVAAHGNSLRALVKHLDNIDDQTISGLNIPTGIPLFYELDDDMKPLVPGGRYLDPEAAAAGQKAVASQGKK

SEQ ID NO: 13836 - protein, 576 aa, Zea mays
  misc_feature (546)..(546): Xaa can be any naturally occurring amino acid
  misc_feature (559)..(559): Xaa can be any naturally occurring amino acid
LAEDLPDDPRAVRRLKHRGPDWSGLYQHEGNFLAQQRLAVVSPLSGDQPLFNEDRTVVVVANGEIYNHKNVRKQFTGTHNFSTGSDCEVIMPLYEKYGENFVDMLDGVFAFVLYDTRDRTYVAARDAIGVNPLYIGWGSDGSVWIASEMKALNEDCVRFEIFPPGHLYSSAGGGFRRWYTPHWFQEQVPRTPYQPLVLREAFEKAVIKRLMTDVPFGVLLSGGLDSSLVASVTKRHLVETEAAEKFGTELHSFVVGLEGSPDLKAAREVADYLGTIHHEFHFTVQDGIDAIEEVIYHDETYDVTTIRASTPMFLMARKIKSLGVKMVLSGEGSDELLGGYLYFHFAPNKEEFHRETCRKVKALHQYDCLRANKATSAWGLEVRVPFLDKEFINVAMGMDPEWKMYDKNLGRIEKWVMRKAFDDDEHPYLPKHILYRQKEQFSDGVGYNWIDGLKSFTEQQVTDEMMNNAAQMFPYNTPVNKEAYYYRMIFERLFPQDSARETVPWGPSIACSTPAAIEWVEQWKASNDPSGRFISSHDSAATDHTXAVSRRWPTAAATXAANGTVNGKDVAVAIAV

SEQ ID NO: 13837 - protein, 413 aa, Ralstonia solanacearum
MNRELIERYLQDAPAPVCAYLYDLDHLRERAGRLSAMLPPGCELFYAIKANSDAPVLAALDGAVAGYEVASLGEVVRAREVGAHARIVFGGPGKTDAELQGALERGVELIHVESELQLRRLDAVARRMGRRARVLLRVNPNPLSADSAGKRPQGTLTMGGQPTQFGIEEDAVPDLIRLARGLAGVEVVGLHLHALSNNLDADSHLALMRHYLALALRLRREHGLTLDTLNVGGGIGVDYVQPSHAFDWRRFCDGLGALLAEAGAGCRIVFECGRFIAADCGYYVTEVVDIKRNHGKWFAVLRGGTHHFRLTASWQHNHPFAIVPNAQWTYPFARPSVQAQAVTLCGELCTPKDVLARDVVVDRLSVGDRIVFQLAGAYGWHISHHDFLSHPHPERRFVGTLNAAREVPLEVAA

SEQ ID NO: 13838 - protein, 188 aa, Yersinia enterocolitica
GERKADLKNMDPDGKGRVRLDYLIPARGLIGFRTEFMAMTSGTGLLYSTFSHYDDVRPGDIGQRQNGVLISNGQGKAVAFALFILQDRGKLFIGHGTEVYEGQIIGIHSRSNDLTVNCLTGKQLTNMRASGTDEATTLVPFLKKTLEQALEFIDDDELVEVTPLSIRIRKRHLTENDRKRAGRGPKED

SEQ ID NO: 13839 - protein, 547 aa, Prosthecochloris aestuarii DSM 271
MSVSPHAGKLPDDCMLVNVAHLVTAYFAMKPDPSVSNQRVSFGTSGHRGSSFSCSFNEAHVLAIAQAICDYRSMKGIDGPLFLGMDTHALSEPAMTSALEVLAANGVDVMISADEPWTPTPVVSHAILGWNRSRSRGLSDGILITPSHNPPEDGGFKYNPPHGGPAGADETSWIEKRANLILETKLADVRRVSYASALGAATTHRYDYMEPYIGSLGEIIDLEAVSRSGLRLGVDPLGGAGVHYWKAIQERYSIDLTVLNETVDPTFRFMSVDRDGKIRMDPSSSWAMQPLVNRKDEFDIAFACDTDYDRHGIVTRGRGLMQPNHFLSAAVSYLFEHRELWGGGVGIGKTVVTSSMINRVAEKLGRDVYEVPVGFKWFVDGLLAGTLGFAGEESAGASFLRRDGSVWSTDKDGFIAALLSAEMTAITGRDPSELYRDLTNDLGEPHYARIDAPASAEEKVRLKQLSASDIGQKELAGETILHMMTDAPGNGQPIGGLKIETRNGWFAARPSGTEDVYKIYAESFLGPQHLARLQEEARDIVAAALCR

SEQ ID NO: 13840 - protein, 294 aa, Shewanella sp. ANA-3
MINGSIVALITPMNSDGSVDFASLERLVEFHIDQGTDAIVAVGTTGESATLPMNEHVTVVAQTVKFAAGRIPVIGGNGANATSEAIELTKSLSKVGVAAMLGVTPYYNKPTPKGLVAHYKAVAASTDIPQILYNVPGRTAVDMKPETVAELVAVSNIIGVKEATGDVSRVQRLRELCGNDFMLYSGDDATAREFLLLGGNGVISVANNIVPKAFKAMCDAALAGNAELAASIDEPLRGLYSTLFCEANPIPVKWAAHRMGLIECGHIRLPLTELSEQCHGLLLDAMTRAQIEVK

SEQ ID NO: 13841 - protein, 892 aa, Mesorhizobium loti MAFF303099
MTKWVFTFGDGAAEGRAGDKNLLGGKGANLAEMCSLGLPVPPGFTITTEVCNAYYANGRAYPAGLEADVAVALDHIGRLTDRRFGDPSKLLLVSVRSGARASMPGMMDTVLNLGLNDETVEALATDSGDARFAYDSYRRFIQMYSDVVMGLDHEVFEEILEDQKASLGHELDTELTAIEWQGVIALYKAKVEEELGRPFPQDPQEQLWGAIGAVFSSWMNNRAITYRRLHDIPESWGTAVNVQAMVFGNMGETSATGVAFTRNPSTGEKQLYGEFLVNAQGEDVVAGIRTPQNITEAARIAAGSDKPSLQKLMPDAFQSFVSISDSLEKHYRDMQDLEFTIERGKLWMLQTRSGKRTAKAALKIAVEMARDGLITKEEAVARIDPASLDQLLHPTIDPKAARDVIGVGLPASPGAATGEIVFSSGDAEDLKAQGRKAILVRIETSPEDIHGMHAAEGILTTRGGMTSHAAVVARGMGKPCVSGAGSLRVDYKAGTLLSMGQTFRKGDIITIDGGNGQVLKGAVAMLQPELSGDFAAIMEWADAVRRMKVRTNAETPLDARMARSFGAEGIGLCRTEHMFFDGARIVAMREMILADTEKDRRIALAKLLPMQRSDFLELFEIMAGLPVTIRLLDPPLHEFLPKTEAEIAEVAAVMDVSPDKLRQRTEALHEFNPMLGHRGCRLAVSYPEIAEMQARAIFEAAVEAGQKAGALVVPEIMVPLVGLVKELDYVKARIDAVAKSVMEESGVKIDYLTGTMIELPRAAIRAHVIAATAEFFSFGTNDLTQTTFGISRDDAASFLETYRQKGIIEQDPFVSLDVDGVGELVRMAAQKGRATRPDIKLGICGEHGGDPASIRFCEEVGLDYVSCSPYRVPIARLAAAQAAVQVSKAGRG

SEQ ID NO: 13842 - protein, 502 aa, Mycoplasma penetrans
MKKGPVLLAVLDGYGFSKDTKGNAILNAKTPFMDNLVKEYDHCYIEASGEYVGLPDGQIGNSEVGHLTIGAGRIVYTGLSLINQDIKTKKFDSNKTLLEAINHAKKNNSNIHIMGLLSPGGVHSNEQHIFEMIRIVSENGLKPVIHVFGDGRDVAPQSIISSLERLNDVLKKYPGTIATISGRFYSMDRDKRWERTKQAYDNLLGISNNYFDNPIDYVNKQYSENIFDEFLVPARINDSNVVIKDNDAVIHANFRPDRARQISHLFCGSTVYEEKNDHPLKNLYYAIMMTYEGITPTSILFPTVVVKNTFGEVVANSGLTQLRIAETEKYAHVTFFFDGGVEVDLKNESKILVDSKKVKTYDEVPAMSAVEITDKLIENLDKFDVIVLNFANADMVGHTGKYNEAVLAIEALDSQLARIDQKIKELNGTMFITADHGNAEVMLDDDNNPVTKHTTNPVIFISNNKDVKFNKPGSLGNVAPTILDFMGLEIPADMDKKSLLKK

SEQ ID NO: 13843 - protein, 268 aa, Brassica napus
MCSLSASLLLPTKLKPAYSDNRSNSNSSLFLANRRRPKRKNQSIVPMARLFGPAIFESSKLKVLFLGVDEKKQPLTLPRTYTLTHSDITAKLTLAISNSINNSQLQGWANRLYRDEVVAEWKKVKGNMSLHVHCHISGGHFLLDLFAKFRYYIFCKELPVVLKAFVHGDVNLLNHHPELQEALVYVYFHSNVNEFNRVECWGPLWEATSPDGHRTQTLPEKQCVDECSCCFPPVSSIPWSHSLSNEGVDSYSGTQGEGMSTPSPEKLY

SEQ ID NO: 13844 - protein, 249 aa, Azoarcus sp. BH72
MYKIVLLRHGESTWNKENRFTGWTDVDLTELGVGEARAAGQLLKREGYSFDLAFTSVLKRANKTLNIVLEELDALWLPVEHSWRLNERHYGALQGLNKAETAAKFGDDQVLVWRRSYDIPPPALEEGDERLNYDDPRYGSLPRARFPRTECLADTVARVVPYWETVIVPQILSGRRILIAAHGNSLRALIKYLDGISDGDIVGLNIPTAQPLVYELDVNLKPVKSYYLADEDTIRAAQAAVAGQGKAKG

SEQ ID NO: 13845 - protein, 322 aa, Zea mays
MAKKRKRTDAPAEATGAEKPDDSAPARPERTLFGFKDPVPDAEPASAGAEAAVAPFRNREKVLITCSRRITYRYRHLMQDVLSLLPHAKKDSKVESKQSKGNALNELLELRSCSSCLFFECRKQKDLYLWMVKSPGGPSVKFLVNAVHTMEELKLTGNHLKGSRPLLTFSTNFDEQPHWKLVKEMITQIFASPKDHRKAKPFHDHVFVFSIVDGHVWFRNYQISVPHNEIDKVDKGGLDKMTLIEVGPRFCLNPIKIFGGSFGGPTWYENPYYISPNQIRALEKRQKAGKYAKKVKAKVRRKMHEMENTLEPDEFAELWKGE

SEQ ID NO: 13846 - protein, 742 aa, Synechococcus sp. CC9311
MAEQTTSIRSQCPYCGVGCGLDLQPPAKKGEAVRRDADGTPMWTARGDRQHPSSLGQVCIKGATVGETLSRGRLDQPLGRTSLDDDFQPISWDEALERISSQIKTSLEYKGPDSIAMYGSGQFHTEDYYLAQKLLKGALGTNNFDANSRLCMSSAVAGYTRSLGSDGPPCSYEDLDHCTVAFLIGTNTAECHPVLFQRLLKRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPEHRAEVEQTWGFPKGKISPNPGLTAWQQVEAMERGELDLWWVAATNPLVSMPDLERVKTAMKRCPLVVVSEAYTDSETSHYAHLLLPAAQWSEKSGTMTNSERRVTYCPAFRNPNRESRADWEVFAEIGKRLGFEKQFTYDSAAEVYAEFTALTKKRLCDVSGLSHDVLAKEGPQQWPFPQDSSPSQETKRLYTNQKFSTANGRARFCTDQPLGLAEPPCDTYPLVLTIGRYLGQWHTMTRTAKVKRLTTMHPEPLLEIHPKDADQFAVQHGELAAISSRRGQLTARVLVTDKIRKGTVFLPMHWGFTQTHACEVNALMHDHACPISKQPELKASAVIVAPAVSVIKPIEQHGNRLDILRRMIIPALR

SEQ ID NO: 13847 - protein, 265 aa, Triticum aestivum
  misc_feature (106)..(106): Xaa can be any naturally occurring amino acid
  misc_feature (114)..(114): Xaa can be any naturally occurring amino acid
  misc_feature (186)..(186): Xaa can be any naturally occurring amino acid
NKFVQKSRLVPVRNSRDIVDPRVRLKEFKGTVVHTSAYKTGCAFAGKRVLVVGCGNSGMEVCLDLCDHNAQPHIVVRDTVHILPREILGHLPLGGPMWLLKWFPVXHVVDRILXLLVARTLLGDTARLGLKRPTVGPLELKSLSGKTPVLDVGTFAKIRSGDIKVYPGIKKISGRQVEFLDTRSEXFDAIVLATGYKSNVPLWLKDRELFSDKDGLPRKAFPNGWKGERGLYSVGLTRRGLMGTSIDARRIAHDIEQQLSAEGKL

SEQ ID NO: 13848 - protein, 131 aa, Brassica napus
  misc_feature (10)..(10): Xaa can be any naturally occurring amino acid
MALVVICGQXCSGKSIAAITLAESLKKSDTKQSVRIIDEASFHLNRNQNYANMPSEKNLRGKLRSDVDRSVSRGDIVIVDSLNSVKGYRYELWCIARAAGIRYCVVYCDVDEAGCREWNKERSDRGEASYV

SEQ ID NO: 13849 - protein, 881 aa, Phaeosphaeria nodorum
MAPTLLAAIDLGSQSNASQGLDEQALSFVGSVFVRVTDETVDQALAHLQQSVGRYSNYLGVATLTSTDDILSLLDAGAAKVFVTRQQLDTLKSLNIDQDRIVLCLPGNSRSEVIDAISGTQVDVYSHQVHDIDLVEAWLKEYGPDRPNVFVSFSEPNLENSLKLAKLSAIPIIPAQSLTIDEKKDSSLISVAKLVMANATSDRPDGLYTTLVTDERGVALGLVYSSEESVAESLRTGRGVYQSRKRGLWYKGESSGDIQELVSMSFDCDSDCLQFVVRQKGRGFCHLATPTCFGDYRGLSKLQKTLQSRKESAPQGSYTARLFNDAQLLRAKILEEATELCDATTKEHIAFEAADLFYFALTKCVAAGVSLEDVERNLDAKSIKVKRRQGDAKPAFAAQAAAAVNGTSNAATNGASNGVSVETLKEAASVPKSKDDPAGTKDVRIAMKRYVTAQETSETIAAALQRPSQKSTGKIIGICRPIIDAVKTRGDAALLEYTHKFEKATSLTSPVLRAPFPPELMQLAPETAKAIDVSFENIRKFHAAQREEKPLVVETMPGVVCSRFARPIERVGLYVPGGTAVLPSTALMLGVPAMVAGCKKIVLATPPRSNGKVTPEVVYAAHKVGAEMIVLAGGAQAVAAMAYGTESVSKVDKILGPGNQFVTAAKMHVSNDTNAGVSIDMPAGPSELLVIADASANPAFVASDLLSQAEHGVDSQVILIAVGLNEAQLTAIEDELHKQANALPRVDIVRGAIEHSLTLAASTIEEALELSNQYAPEHLILQVANADKVVELVENAGSVFIGEWTPESVGDYSAGVNHSLPTYGYAKQYSGVNLASYVKHITSAHLTKEGLQNVGPAVMELARVEELEAHRRAVSLRLGVA

SEQ ID NO: 13850 - protein, 389 aa, Streptococcus thermophilus CNRZ1066
MSEVTTQSKPERRKRQKLEDMEGYKPSIYGLTRDELIDWAVEHGEKKFRATQIWDWLYKKRVQSFEEMTNISKDFIAKLNDNFCVNPLKQRIVQESKDGTVKYLFELPDGMLIETVLMRQHYGLSVCVTTQVGCNIGCTFCASGLIKKQRDLTAGEIVAQIMLVQKYFDDRGDGERVSHVVVMGIGEPFDNYDNVLRFLRTINNDNGLAIGARHITVSTSGLAPKIKEFANEGVQVNLAVSLHAPNNDLRSSIMRINRSFPLEKLFEAIEYYIQTTNRRVTFEYIMLNEVNDHPENAQELADLTKKIRKLSYINLIPYNPVSEHDHYSRSTKERVAAFYDVLKKNGVNCVVRQEHGTDIDAACGQLRSNTMKRDRQKAVAEASGKSEGK

SEQ ID NO: 13851 - protein, 615 aa, Salinibacter ruber DSM 13855
MPAIHAMEEPPPESTSDDELVIEGTGAAPGVVLGTAYRYEAAAPTARRDAIAPDAVDAELERLANAVQRAEQGLEADRVWAPDALVPDADAIFEAQALMLGDEDVLEAIRQRIRDANEPAGAAVQAVLSAHRERLEDSEDAHLRTGADDLLAFERRLLRALRRGAAAAHIDGHSVVVAQDLTASDLLRLRRHNLLGGVTARGGPTSHTAIVAQALGVPLLVGAGEALAAVSAGDRVVVDGDEGRLIARPDPSTEEEYRKRAADAPSPTAERERAPEGPLRTTDGHAVTLRANVGLEAELDPLRPAPPDGIGLLRTELFLRADGDPRSVDEERQVEAYRQAIEAAGEGGATIRLLDVGGDDRRSQGAAEAHEGHPVLGRRGLRVLLDRPDELLRPQLRALLRANREGPLRILLPMVTDGAEVRRVRRILDEESTRLTENGVPHDANVPLGAMVEVPAMALQAPAFTELVDFFSIGTNDLTQYVLAVDRANEQLAARHDALHPAVLGLILRVVEAGRMSGCPVEVCGEIAGDVQAVPVLLGLGVDTLSVAPPSLPAVRRIVRATGYDAAKDLARDVLQADDAQAVRRRARAWVDTHLSSSDTASSTTNSSTTNTPDR

SEQ ID NO: 13852 - protein, 194 aa, Glycine max
MQTSLLQVVGTPVISATYDQLQKSVNRYLPGPATQCQYSTTTSKQMRLRTNISETVKRKISLGARILRVGGVEKVFKQFFSMEEGERLLKVSQCYLSTTSGPLAGFLFISTDKVAFCSERSMKVFTRKGHMLRIRYKVAIPLKKVKCVNQSANAQKPTQKYIEIVTEDNFDFWFMGVLKYQKTFKYLEQAVSQA

SEQ ID NO: 13853 - protein, 373 aa, Alteromonadales bacterium TW-7
MSDFIKSKAAIAWGPNQPLSVEEVDVMMPKKGEVMVKITATGVCHTDAFTLSGEDPEGIFPAILGHEGAGVVYAVGEGVTSVEVGDHVIPLYTAECGECKMCTSGKTNLCSAVRETQGKGLMPDGTTRFFKDGQPIYHYMGTSTFSEYTVLPEISLAKVNKEASLEEICLLGCGVTTGMGAVTNTAKVKEGDTVAIFGLGGIGLSAIIGAKMAGASRIIGVDINTSKFDLATKLGATDLINPKDFDKPIQEVIVEMTDGGVDYSFECIGNVDVMRSALECCHKGWGESVIIGVAGAGQEISTRPFQLVTGRVWRGSAFGGVKGRSQLPEIVERYMAGEFALNDFITHTMSLEEINDAFDLMHEGKSIRTVIHY

SEQ ID NO: 13854 - protein, 284 aa, Streptococcus pneumoniae
MKLDGYTRLAAVVANPIKHSISPFIHNRAFEATATNGAYVAWEIEASDLAETVANIRRYQMFGINLSMPYKEQVIPYLDELSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQGNPAVNGLGMLLYQAAEAFQLWIGKEMPTEEIWQSLTEKYQ

SEQ ID NO: 13855 - protein, 103 aa, Ustilago maydis
MSGRGKGGKGLGKGGAKRHRKVLRDNIQGITKPAIRRLARRGGVKRISGLIYDETRGVLKLFLESVIRDSVTYTEHAKRKTVTSLDVVYALKRQGRTLYGFGA

SEQ ID NO: 13856 - protein, 338 aa, Bacillus licheniformis ATCC 14580
MKAAVMTKPYSIEFHDIPRPEPASGEVLVKIKAAGICGSDVHFYDGSNPYAQYPQIFGHELAGIIEKTGAGVRGRSAGERVVIEPAIPCGGCYPCRKGRTNACMNIDMIGSVRRGGFADFIIVPETHVHPIPEQMDFATAALCEPFSIGAQAVRRADIQTGETIVILGMGPIGLTILAQVKKRFDVRVIAVDPVRERLELAEAFGADAVIQPGEEDAEQMILKLTGGEGAGIVFEAAGIPATIEQSVRLAAAAGRIVIVGLTGRNVTIPGLLLTKKDIEIYGTKHSVNQFPGVIQFLNENPEIARAFVTEIMPFMEIEEALKKAKNCPHQVTKIILSY

SEQ ID NO: 13857 - protein, 304 aa, Magnaporthe grisea 70-15
MEHSRGQYGGGRKGMSLGNVIGDPFALATISIAGLAWLIAFIASIVAQIQTTQGFPTYTWWTVVFYFFLIPGVFVVVASDTIQTYHVALVGYMACGLVLTTSSVNGLVYSTNGAKEAAAAGFILLSMVTIVWIFYFGSAPSAMPRAYLDSFALSKESTSNNRQTMTGGGYGIGRPETSTSVQPPQMYTSAQLNGFENPSPVNGMRNSGAPPSGFPTTPGPASGLPKTTTPPAGGAADAEIVPPTEYPYRAKAIYTYEANPDDANEISFSKHEILEVSDVSGRWWQARKETGETGIAPSNYLILL

SEQ ID NO: 13858 - protein, 182 aa, Pseudomonas syringae pv. phaseolicola 1448A
MTFDQSNFKSLIRPVIDFPKPGVVFRDITPLFQSPKATRQVIDSFVQRYIEADFSHIGVMDARGFLIGSVVAYQLNKPLVLFRKQGKLPADVLSEAYQTEYGEAYLEVHADSLCEGDSVIMFDDLIATGGTLIAAANLIRRMGAEVHEAVAIIDLPELGGSKRLNDLKIPTFCLTEFALDEQ

SEQ ID NO: 13859 - protein, 542 aa, Mesorhizobium loti MAFF303099
MLGLMQEWPLLCHKLIDNAERQHGVREIVSRSIEGPIVRTTYADIHRRSLKVAQRLERDGYGLGDRIATLAWNTARHLEAWYGIMGVGAIYHTLNPRLFPEQIVWIMNHAEDKAVFVDLTFIPLLEKIAGAVKSLKKVIVLTDKAHMPQTTLPNAVAYEEWLDEVDGDFAWKTFDEGTAAGMCYTSGTTGDPKGVVYSHRSNVLHAMIAAMPDAMGLSSRDTVLPVVPMFHANAWGLGQSGPMVGANLVMPGCKMDGASIYELLDTEKVTFSAAVPTVWMMLLQYLEETGKKLPYLNKVVIGGSSCPRAIMTKFQDNYDVQVIHAWGMTEMSPLGTLCTLKPEYAGLQGEARLDVKQKQGYPPFGVEMKVTDDENNAQPWDGKTFGRLKVRGPAVARAYYGGAGAEQFDADGWFDTGDVAHIDAGGYMQITDRAKDVIKSGGEWISTIDLENLAVGHPDVAEAAAIGVHHSKWGERPLLVVVAKPGKEPTKADILGFMDGKVAKWWMPDDVAFVGEIPHTATGKIQKTTLRQQFRDYRLPTD

SEQ ID NO: 13860 - protein, 528 aa, Thermoproteus tenax
MGIRLSMSGKVTYVSVLADESIHPAYEKALSEVWELLGREWPIYIGGKEVYTSGKFEKRSPFDTSIKIGTFQRGTPEEFKAALSKAVEAFPEWSRLDWRERARILAKLADLIERDRFKLAAAITYEVGKNRFEALAEIHEAIDVLRYYVELIHKMDGYVLQMRSPIPNERPLSVLRPYGAWFVISPFNFPIALAKGMLTGVLLMGNTAVWKPTSEAPFTAALVYQLAVEAGVPPGVLNFVTGPGDAVEEVATGDPRVAGIAFTGSRDVGMRLYRLFTQRQPWPKPIVLEMGSKNPTVVTAKADLEKAAEGVVRAAFGFGGQKCSATSRLYVQREVYDRFVERLVEKTREIVKIGDPRRREVFLGPVINKSARENYRRYVADAVAAGGRLRYGGRVLEEGEFSKGFYVEPAIIEGVAPDSYLWKTELFLPILLVDKFDTLEEAVRKANDTEYGLTAGIFSEDPKEVEYFFEHIEFGVVYANRRGGATTGAWPGAQPFTGWKASGATGRGVNGVYYLLNFAREQARTVVY

SEQ ID NO: 13861 - protein, 2081 aa, Aspergillus nidulans FGSC A4
MKQSGRDEGWLRAWCTKLDVPVDDFKPLLPIISTYMVSTQKEDEAQADLLLAQASEVRRNGEFKTTTTVSKIKKDKWTYEDYCCVLSDLVNSRGSVGVAESVWESFRLQKPKKARTGRFARRQQAGNEETDDLLFLLLCSTMRYKQTDMFHFLAHSASQDVVNRMLPTAIQMRSQRYTQILLEENADPNTCAEEFITLVRAGDEEFVRILLQAQTPIDHDTLTSALPDAVQRGNSSIVHLLLAHGADANAHNASAVEKAIRAKRTDLALLMFMCPNHPLPETLAPIVAYVFFKMEILEDKKYGLIELLLNGGAAGECVSLALGGAVRQRWMEMVELFVDKGVSINDYNAGSYRHAVHEVDLEVVRILNSGKLSDDLATDLFGEIYKTKYGSSIPNEKWRALAELLLNQGATGQVVDEALIERVRARDLASVKLLLREGASVDYDNAAALDDAVASHNEEFIDALLQYQPAAESVNSVFWRVEDLPHSVQVRIARKLLDAGANGEQVDRVLKVAIAPLAGERNRELIKVLVDGGADVNQRNGELLHLAAQSADIETLQILLLGFPSPTILSTCVPLAMKHCEAQRYKIIHMLLHAGARGDEISQALVDSIDGTTSGLDLALLLLTTGEANTGFENGRSFKKAIESSNIGFLELVAQYNHLRDSDFCSCLLAAIDLHQRDRTRLEKIRILLLSGPDLSGNTGTAALRHEMEGLKRRSESTLGVLHMILEAGADVNYQQGRIFVDAIALDMFDCFKLFLGVHPSFQSLELAFDKALLYATPTNDRAADLRYLQELLATGVPQATLDKALLHSTDKQSEQLVLLLLRYGASVNYQDGAAVRKAIQKLDVELLAHLLRHEPTVETLNSGFGLCMAVHDIETKYQSYELLLKAGPISQRLRDEALVLTADAGWMQASICELLLKYKASPDYATGTPICRAIKSSNYKVDLTRIILLYNVSEDTVAAALTCAFDALHAEARITTMELLLTAHKPQQTLDQLLLRAVRAPYCDGKLVQSLLKAGASVFYQGGECILHSVMNNDVDTLRILEPYLHGHSGMTEIFMTVWGNGKRANSQQEKDVLSILLAAGASGEPVSMALLESVRTVSSTEVGFSFIVNLLRAGADVNYDEGASLVEASMQGNTRLLKEVLAYGPQRVYMTRAFPLVFQSGVDGQGLREIAVAFCSHKSAPDLTYEHPTYGPILWQMFKKYPNEDELLQYLIDEGCTVDPIVKATLPLSPAEEDVTLLCWALSKQTSSLKEEVIEVLVAGGANVNYQSLISQSTPLQLAILSARKNTITALLRFGADPSLESNGISPLSLAASIGDAKIVRQLVKAGAAPGDGALHEAARMVNVSVLQVLLIEGKQRDYPCSRFQGRTALAELCLRAANKPVSQIKAAVALLKNNGDVKRKSRGKSVLHFALDNPNAILVTQAVLDVFMSDYINDDFNLFEDGRYRYSPLVYVSRGLNKAPAEQRAGLVDLLLEFSCLERFWAVEGDQPADMVGAPEEIMRAIRSQRQRQLTIQEEQEDHQRRLLQRRAEQDQELAALRARHNLTLENNRELATDTARIEHETASRQATIASQRYDAELAYMRQVTELTNKRKDDANSREIEYRRNLAIMEKAQREEAYNYEKVRREEEASFIQRREKLLTSGYEDRAKIDRERHAAQMGLFEQQKNILEMNSRHQGVVQQQRQIGPQQIYTNNQPASKLHVSPSTLTSLRTNYFCPAHSFLQQKMSSLRAHQKKNPTPTQCQNQTTLDSICKDIQTGKITRIVALVGAGLSTSSGLADFRTPDTGLYAKLEPLQLPYPEALFHISYFKHTPEPFYAIARGRHPWNTKPGVGHAFLALLEKKGVLGFVFTQNIDGLELDAGVSRERVMNLHGDWSDQHCIKCRSSYPADRMRKAILTGEVPFCVQANCEGIVKPAIVMFGESLPEGFDSREEEMLSTADLLLVIGTSLKVAPCSEIPRRLPSHVPRVLVNRELVGNIGTRESDVCLLGDCDAWLREVARHLGWDEELESVWKDTLVRKEKSSRDKGWDDKAEQSPTLEECIVRAAEQMKVRMGVSEGHRRMLEGHLGEKMAEIMAKRGQ

SEQ ID NO: 13862 - protein, 479 aa, Streptomyces coelicolor A3(2)
MLESATPVTPVTFPPAFLWGAATSAYQIEGAVREDGRTPSIWDTFSHTPGKTAGGDTGDVAVDHYHRYRDDVALMKDLGLGAYRFSISWPRVQPTGRGPAVQRGLDFYRRLVDELLAAGIKPAVTLYHWDLPQELEDAGGWPERDTAYRFAEYAQIVGEALGDRVEQWITLNEPWCAAFLGYASGVHAPGRTDPAAALRAAHHLNLAHGLGTVALRSVMPARNSVAISLNTSVVRPLSQSPADLAAARKIDDLSGGIFHGPILHGAYPQTLLEATAPLTDWSFVQDGDLGQIRQPIDAICLNYYTPTVVSAADADSRAPRADGHGASDHSPWPAAEDVAFHQPPGERTEMGWTVDPTGLHELIMRYNREAPGMPLYISENGAAYDDKPGADGTVHDPDRVAYLNGHLTAVRQAIADGADVRGYYLWSLLDNFEWAYGYEKRFGAVYVDYASQQRTPKSSALWYGRAARTGTLPPVDAAE

SEQ ID NO: 13863 - protein, 438 aa, Thermoproteus tenax
MPSLTAPSSSSLYLSRIFSTKNLFMRPSSFTDTLGFRTSSSSYISAIPSSSPSFDFNTWTSNGFLATSLFSFSCAAVVKDLCPIASSIKESNRLYRRTSFSNCAIFSSRIFLSSSNSSTTIVILTSIKSIVALVASIGNLNYDIYIKTHELPGLDQSVDALDLYTGGGGSAANFSVAIARLGHRARFIGAVGDDVIGEIILKELESEGVEVRYVKKIGGLRSGVVVVIVQPDGGKRMIAYRGANMGLSPDDINEASLGGVDHVHVASGRVELILKAKEVAKRDGKSISVDGGTSLARKGLEVAAKALSGVDVVFMNQAEAKLLSSSSDHRAALDVIARNIDAREIVVTLGDRGAMALSGGEFLYVDAFRLQALDTTGAGDTFAAAYIAARLMGLSLYERLLFANAAASIKVTRPGARSSPRLSEVLEFLRSLGYRLAE

SEQ ID NO: 13864 - protein, 434 aa, Bradyrhizobium sp. BTAi1
MDAKSASKTATLTVGNKNFDLPILSGTVGPDVIDIGKLYAQTGMFTYDPGFTSTGSCQSKITYIDGDAGVLEYRGYPIEQLAEKGDFLETCYLLLYGELPTAAQKKDFDYRVTHHTMVHEQMSRFFHGFRRDAHPMAVMVASVGALAAFYHDSTDINDPKQRMIASMRMIAKIPTLAAMAYKYTIGQPFVYPKNALSFAENFLHMCFAVPCEDYKPNPVLADALDKIFILHADHEQNASTSTVRIAGSSGANPFACIAAGIACLWGPAHGGANEAALNMLAEIGTVDKIPEFIAKVKDKNSDVRLMGFGHRVYKNYDPRAKIMQKMCHAVLKETGHADDQMLKVALELEKIALSDQYFIDRKLYPNVDFYSGITLKAMGFPVSMFTVLFAVARTVGWISQWSEMIEDPQQKIGRPRQLYTGVATRNYVEIDKRG

SEQ ID NO: 13865 - protein, 394 aa, Synechococcus sp. CC9311
MTQLETRTEPMVVNFGPHHPSMHGVLRLVVTLDGEDVVDCEPVIGYLHRGMEKIAENRTNVMYVPYVSRMDYAAGMFYEAIVVNAPERLANIPVPKRASYIRVLMLELNRIANHLLWLGPFLADVGAQTPFFYIFREREMIYDLWEAATGQRLINNNYFRIGGVAADLPWGWLEKCKDFCDWFGPKIDEYEKLITNNPIFRRRIEGLGVIGREEAINWSLSGPMLRASGVPWDLRKVDHYECYDDFDWDVASEKEGDCFARYRVRIEEMRQSLKILRQACDMIPGGPTENLEAHRMAEGKDSAFAGFDYQYVAKKVAPTFKIPNGELYSRLESGKGEIGVFIQGNNDVTPWRFKIRAADSNNLQILPHILKGHKVADIMAILGSIDVIMGSVDR

SEQ ID NO: 13866 - protein, 190 aa, Arabidopsis thaliana
MVLVLALGDLHVPHRAADLPPKFKSMLVPGKIQHIICTGNLCIKEIHDYLKTICPDLHIVRGEFDEDARYPENTPLSAGPAKLGLCHGHQVIPWGDLDSLAMLQRQLGVDILVTGHTHQFTAYKHEGGVVINPGSATGAYSSINQDVNPSFVLMDIDGFRAVVYVYELIDGRVKVDKIEFKKPPTTSSGP

SEQ ID NO: 13867 - protein, 470 aa, Salinibacter ruber DSM 13855
MSPQSSPAADALLHRALQHVEDWEQSWGAFDRHDALGVDPDRLDAAFDEYLERLEGNYPFHHPRYAGQMLKPPHPVACAAYAAAQRINPNNHALDGGSPTSQMEKEVVADLAGMLGLPDASLGHLTGGGTVANLEALWVARELHPDQAVAVADNAHYTHGRMGDVLDVEVVPVPADAHGRIDLDALDRVLEQHAIGTVVLTAGTTGLGTVDPIHDAIPLCRAHDARVHVDGAYGGFFRLLTEPDAPDIPNFPAERFRAIEDADSVAIDPHKHGLQPYGCGCILFRDPAVGRFYQHDSPYTYFTSDDLHLGEISLECSRAGAAAGALWCTLKALPLKPDDGLGPILAACMRAARTWTDAVADTDALHVVAPPETDIVSYVPATSESSLSAVHEASQALFDAAMNDPDDPIFTSVYRLSADALTTLRPSLHADRDEAAVLRSVLMKPEHETYAPDLVDRLANKAQSLDSAAP

SEQ ID NO: 13868 - protein, 132 aa, Oryza sativa (japonica cultivar-group)
MKHAFPSKETRDPTKTDSDSDPAVLLPNVTAIVLAKVVEYFNKHAAVNPKASATDSSTKTSAPKASKEELKSFDAKFVNVDKTMLVGLILAANYLNVKDLLDLTCQHAVDLIKDMTLEQVREVFNIVNDFTL

SEQ ID NO: 13869 - protein, 451 aa, Triticum aestivum
  misc_feature (238)..(238): Xaa can be any naturally occurring amino acid
  misc_feature (350)..(350): Xaa can be any naturally occurring amino acid
MASPPTGPAAPAGLESMEGLALDIIIAKAGARPAAALACASTHLRAAVAEDAVWRSFCARDLGLDAPLDPEDRPLPSFKDAYKVWSESFGMYPLPLVKRVKLFWSSLKGWISENFPEALRTLSKGASEAQIRSAEDDLGFKLPMPTKLLYRFCNGQLPFSRNHFEDVRMAPLGIIGGYVFYDHSVNVHLSSLEQMVEETKEFNLDLEEQGLPIGPNLALVASSWYHPKTFLLNCSSGXLYVGTANLSAGEMMPCVPKSLIKPTDSDMPQDGLLLWLEEHLRRLQNGMIKIRPLKTSRYICLYPEASPLCSSAVTNGVKVRASAVFVPEHPRRGHLGTHLYSYSIRLSIPXEACMLGGVYFSSCQLHSRHWIIRCKDTVVSDMHGEGVIGEHPLLLPGQDEFVYESCTPLNASSGSVEGSFTFVPGRLTQPEGKPFDVTVAPFPLEVPDYIF

SEQ ID NO: 13870 - protein, 357 aa, Xylella fastidiosa 9a5c
MSKQILILPGDGIGHEIVAEAVKVLEHVNVRHTLNLRLSFDALGGAAYEKYGSPLADETLARARDADAVLLGAVGGPQWDTIDPALRPERGLLKIRAQLGLFANLRPALLYPQLADASTLKPEVVAGLDILIVRELTGGLYFGQPRGSRISKNGEREAFDTLPYCESEIRRILKVGFEMARLRGKKLCSVDKANVLASSQLWRTVAGEMAKDYPDVTLSHMYVDNAAMQLVRHPKQFDVIVTENMFGDILSDQASMLTGSIGMLPSASLDANNKGMYEPCHGSAPDIAGQGVANPLATILSVAMLLRYSMGHIKTADAIEHAVGVVLDSGLRTADIWSEGMTKVGTVAMGDAVVAAL

SEQ ID NO: 13871 - protein, 284 aa, Streptococcus pneumoniae
MKLDGYTRLAAVVANPIKHSISPFIHNRAFEATATNGAYVAWEIEASDLVETVANIRRYQMFGINLSMPYKEQVIPYLDKLSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQFSPVPENIVLPETLLVADIIYQPFETPFLKWARSQGNPAVNGLGMLLYQAAEAFQLWTGKEMPTEEIWQSLTEKYQ

SEQ ID NO: 13872 - protein, 353 aa, Bacteroides fragilis YCH46
MDFKIAVLAGDGIGPEISVQGVEVMSAVCEKFGHKVNYEYAICGADAIDKVGDPFPEETYRVCKNADAVLFSAVGDPKFDNDPTAKVRPEQGLLAMRKKLGLFANIRPVQTFKCLVHKSPLRAELVEGADFLCIRELTGGMYFGEKYQDNDKAYDTNMYTRPEIERILKVGFEYAMKRRKHLTVVDKANVLASSRLWRQIAQEMAPQYPEVTTDYMFVDNAAMKMIQEPKFFDVMVTENTFGDILTDEGSVISGSMGLLPSASTGESTPVFEPIHGSWPQAKGLNIANPLAQILSVAMLFEYFDCKAEGALIRKAVDASLDANVRTPEIQVEGGEKFGTKEVGAWIVDYIRKA

SEQ ID NO: 13873 - protein, 176 aa, Oryza sativa
  misc_feature (24)..(24): Xaa can be any naturally occurring amino acid
MAPTVMASSATSVAPFQGLKSTAXGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 13874 - protein, 520 aa, Burkholderia thailandensis E264
MSHKRNTFALFDCTAGRRDAAGGRNFIGLSARVHPEKRPAQAERITYPKFRRRPFVVSDRRTRAPPVRTPRPPPGRVRQTVRRTAIMNSRPLAVRRASRRPSASGGPGGGGRWAAFVGAGVLVAVGYMDPGNWATALAGGAGYGYALLGVVIAASLMAMLLQWLAARIGVVSGRDLAQLCRERFDPRATVPLWIAAEIAIVACDVAEVVGAAVALQMLLGVSLTAGVLISAIATLAMLALERHGRRTLEAAIASLILFVGLCFVIEVALARPDWHAALAGAAPSPRLLREPGMLWLAAGILGATVMPHNLYLHSMLVKHHASERDEQSIRRALFGVNLDTFVSLGFAFVINAALLIVAAAVFHASGHDEVTDLADAHRLIAPLVGNHWAGLLFAAALLACGLSATVTGTLAGQAIMEGFLKLSLPRWQRALLTRALAIGPALAAVGLFGQHGSNQLLVASQVVLSLQLPLAMVPLIVFASSRALMGNWRVRGLPLAAAWACAAVILLLNGALVWQIAAAQ

SEQ ID NO: 13875 - protein, 605 aa, Oryza sativa (japonica cultivar-group)
MSPNLESHIKSQVPALLLRRFFGGAGRRRVFVQTETGCVLGMDLDRSDNAHTVKRRLQLALNVPTGETSLTFGDRVLENDLSFIRPDSPLLLTRNSINRSCSTPCLCPVSKDFEHKDRSGLVEMLGCSISCARVKRLVDDVVTAIRSGVDPVPIGSGLGGSYYFRNISGDRVAIVKPTDEEPFAPNNPKGFVGRALGQPGLKKSVRVGETGFREVAAYLLDHDNFANVPPTALVKITHSIFHINCPVNGGSPAHDQKQQVSSKIASFQQFIAHDFDASDHGTSSFPVAAVHRIGILDIRIFNTDRHAGNVLVRKLDGGTGRFGCQTELFPIDHGLCLPENLEDPYFEWIHWAQSSIPFSEEELEYIKNLDPMRDVAMLRRELPIIREACLRVLVLCTIFLKEAAASGLCLAEIGEMMTREFRGLEEEPSKLEVVCMEARRKLAEWEPYSPVIEQGEDMDFQFSLDMLGEYNDVIRSPRFNGLGAKGNGFRNPLSKLVESIDEDNDDDDGRSESSKRSSERVHSGGLKFPSADKSSGSNGSVHALNRSADEQLPSSVYFVRLSDMNAEEWNIFLEKFQELLKEALQERAAAAGQRMKQRLGTSCKF

SEQ ID NO: 13876 - protein, 405 aa, Halobacterium sp. NRC-1
MGPMETYVVTEPALVERLLVSDAAEFRKPEFQADAIDDLLGDGLLLSEGESWREQRGRANPAFSMARVAGFDADIAAHAADRVDDWPVGDTVDVEAAMTHITLDVILDVMLGVSLPEARVDAIGDALEPVGARFEPDPVRFAVPEWLPMPDDREYAAAVATLDDLVDDIVAAREGTASGGDGDDPMDLLSVLLRARDRGEQSLDRLRDEVMTTLLAGHDTTALTLTYTWFLLSEHPDVEARLHAELDGALDDGAQPTVAQLQDLDYLEWVLQESMRLYPPVYNVFRTPIEPVELAGSEVPAGAPIMLPQWAIHRSPDHWDDPEAFDPERWRPERRADRPRFAYFPFGGGPRHCIGKQLALLEAKLIVATVASDYRLRYEGDTPLSFVPSLTIHPEQEMRMRVEPR

SEQ ID NO: 13877 - protein, 120 aa, Nostoc sp. PCC 7120
MSAQEIIRSIEAEQLKSNLPEIYIGDTVRVGVKIKEGEKYRVQPYEGVVIARRNGGINETITVRRVFQGVGVERVFLLHSPRIDNIKVLRRGKVRRAKLYYLRGRVGKATRIKQRFDRSL

SEQ ID NO: 13878 - protein, 247 aa, Oryza sativa
EGVPRRLTFDEIQSKTYMEVKGTGTANQCPTVEGGVDSFAFKPGKYNMKKFCLEPTSFTVKAEGVAKNAPPEFQKTKLMTRLTYTLDEIEGPLEVSSDGTVKFEEKDGIDYAAVTVQLPGGERVPFLFTIKNLVATGKPESFGGPFLVPSYRGSSFLDPKGRGGSTGYDNAVALPAGGRGDEEELAKENVKNASSSTGNITLSVTKSKPETGEVIGVFESVQPSDTDLGAKVPKDVKIQGVWYAQLE

SEQ ID NO: 13879 - protein, 139 aa, Wolbachia endosymbiont of Drosophila ananassae
MAIEKTLSILKPDAVKNNITGKINSYIESSGLKIIAQKMMLLTKKQAELFYEIHKDRPFFGELVEFMTSGSVIVQVLVGENAVSKYRQIMGATNPKQADKGTIRGDFADDISENRVHGSDSLENARKEIAFFFAECELV

SEQ ID NO: 13880 - protein, 496 aa, Arabidopsis thaliana
MDLGKLIQLSALLCPFLLSLHFRIAGASAHIYSSQPFHDVGNSLLLYGGSEGIFASSRSLIRFENITLWRTITGKGHRSNGLVQAVIFEASDRNNIGGSAYGGQRSICCTPDLAKLQGCKQGEIIRIPSPHDPQWPILLPVRFKGKRSSAKMADTEILITKTGIYNLLFISCDPQLKGLKMTGKTVWKNPDGYLPGRMAPLVNFYVYMSLAYLLLSAVWFFQYLRFRMDILPLQHCITAVILLGLLEMLFWYLDYANFNHTGMRPLALTTWVVTIGALRKTVSRILILCVSMGFGVVKSTLGGLTSKVLLVGVTYFIASEILDIAEHVGIIDDMSGRSKLFLVLPDAFLDAFLILWIFTSLSKTLEQLQMKRTSVKLEIYRKFSNALAVMVVASVAWIVYEVYFKATDPFNERWQTAWTITAFWDVIAFLLLCIICYLWTPSQNSQRYAYSGDVDEENEEAQSLTGGKQDGDISLVKQEKNAESDREEDVEEDKRE

SEQ ID NO: 13881 - protein, 297 aa, Pyrococcus furiosus DSM 3638
MPFQPSKYELTVNLVQGNYMLHVLSLKGEYKNISPKEILRYPSTNSLMLGEVSKILAKSSMAIAFTGAGISAESGIPTFRGKDGLWRKYRAEELATPEAFKRDPKLVWEFYKWRIKKILEAKPNPAHIALAELEKMGIIKAVITQNVDDLHREAGSKNVIELHGNIFRVKCTSCSYREYLKESDRIGWLLSQELPRCPKCGSLLRPDVVWFGEALPEKELTTAFSLAKKADVVLVVGTSGVVYPAAYIPYIVKESGGIVVEINIEPSAITPIADFFLRGKAGEVLPKLVEEIRRISK

SEQ ID NO: 13882 - protein, 438 aa, Oryza sativa
  misc_feature (377)..(377): Xaa can be any naturally occurring amino acid
MEDDDAGGGGGGGEASPPHAGSAAAMAGAGRDIAASPTSSRSVTQTVNGSHRFVIQGYSLAKGMGVGKHIASETFTVGGYQWAIYFYPDGKNPEDNSAYVSVFIALASEGTDVRALFELTLLDQSGKAKHKVHSHFDRSLESGPYTLKYRGSMWGYKRFFRRTALETSDFLKDDCLKINCTVGVVVSTMDYSKPHSIHVPESDIGYHFGTLLDNQEGVDVICNVAGEKFHAHQLVLAARSSFFRSELFEHESDEEKNEVDTSNEIKEIVIDDMEPKVFKAVLHFMYRDNLVGDDELSASSSDCSIFDTLAGKLLAAADRYELPRLRLLCESYLCKHISVNSVATTLALADRHHAMELKSVCLKFAAENLSDALMYLXAVIRTDGFDYLKDNCPALQSEILRTVAGCEEECSSGGKSQSVWGQLSDGGDTSGRRVRPRV

SEQ ID NO: 13883 - protein, 268 aa, Haemophilus influenzae R2866
MDLYAVWGNPIVQSKSPLIQSKLAAQTHQTMEYIAKLGDLDAFEQQLLAFFEGGAKGCNITSPFKERAYQLADEYSQRAKLAEACNTLKKLDDGKLYADNTDGIGLATDLQRLNWLHPNQRILILGAGGATKGVLLPLLQAQQNIVLANRTFSKAKELAERFKPYGNIQAASMDSIPLQTYDVVINATSAGLSGGTASVDAETLKLGSAFYDMQYAKGTDTPFIKLCKSLGLTNLSDGFGMLVAQAAHSFHLWRGVMPDFVAVYEQLK

SEQ ID NO: 13884 - protein, 233 aa, Coxiella burnetii RSA 493
MLNTPRICVVVIGKTLEEFLSQLEAAQTAVDFVELRIDYLEQINPNWVRIIKNHTHKKAILCCRARADGGKFLGTPEAQQEILQAGNDLGFDYLDIDLPVANKISIHEKKAKIIISYHNFLHTPPITELNFLLENMRLFNPDVFKFATKSEQYEDVKTLFKLLINKKNNENMIVLGMGEQGKIIRLLSPLLGGYLTFSSINGAISAPGQIDFKTMQDFYQRFYKISSPLKGED

SEQ ID NO: 13885 - protein, 343 aa, Triticum aestivum
  misc_feature (281)..(281): Xaa can be any naturally occurring amino acid
MGVYLSTPKTEKLSEDGENDQLKFGLSSMQGWRASMEDAHSALLDIDEGTSFFGVFDGHGGKVVAKFCAKYLHREVLKSEVYLAGDLGAAVHGAFFRMDEMMRGQRGWRELQALGDKINQFTGMIEGLIWSPRGSDSNDRHDDWAFEEGPHSDFSGPTCGSTACVAMIRNSQLVVANAGDSRCVISRNGQAYNLSRDHKPELEAERERILKAGGYIQMGRVNGTINLSRAIGDMEFKQNKFLSPDKQMLTANPDVNTVELCDDDDFLVLACDGIWDCMSSXQQLVDFIHEHLKTESSLSAVCEKVLDRCLAPSTLGGEGCDNMTMILVQFKKPIDHGKNAQCW

SEQ ID NO: 13886 - protein, 824 aa, Oryza sativa
MAFTETANRHASEEKAGRKEVGGGWDPTYTRRNFFPYWRSVLRTLCPVKVYPVYARADANSGRDLEQIRIFQSNSMANRSTRTQNRMLDSVGRIPPFANNHQSKRSFSTCATGAFRLLKLLKSSVTDLAWGLRYPCPLDLEAQQLGKYIVKILLNKKPLNFKTAPSRLLREISISSSRVQRVNNSSAEFVANLNDRNVEIVQHMEDNDHNIINATANVTSDWSIVKEEFTFPAGSAPFNSCHASTIVETEKDSFLVAYFGGSKEGAPDVKIWLQRYSPFLVEDGRLLCGSSVESWNSWGAWLEVTKDAGRTWRKYGPIYIEGETLGVIQPVPYMTANGTIRVLLRSFETIGRVCMADSADGGVTWSYVHETDLPNPNSGIDGVKMKDGRVLLAYNTFSRGTLKVAVSMDDGDSWNDVMTLEDTEGMEFSYPAVIQTMDDLIHITYTYNRTQIKFDLPTLSSQGSKDHGLILHIQEKCDKMTNKWSVLREEFTFSEGNVPFKTCHASTIVEVQKNMFLVAYFGGTQEGADDVKIWLQRYYNGSWHSPEVVDEVPNVPLWNPVLFQLPSGEILLFYKVGKTVESWSGCMKCSSDGGVIWSKREQLPPGILGPIKNKVTKDHGKTWKKYGPIYVRGKTMGVIQPVLYQTSSGTIRMLLRPSDEVGRICVAESKDSGVNWSYAQPTELPKPNSGIDGVKLKDGRVVLVYNSTSRGVLKVAVSQDDGDKWEDVLTLEETHGVEFSYPAVIQTSDGLVHVTYTYKRTQIKVVLPMLFGLLMVITSFIIFHVKNEFLLVTALCSMSFYNQARFDAVSNQTCGFVSGVKFEL

SEQ ID NO: 13887 - protein, 284 aa, Streptococcus pneumoniae
  misc_feature (166)..(166): Xaa can be any naturally occurring amino acid
MKLDGYTRLTAVVANPIKHSISPFIHNRAFEATATNGAYVAWEIEASDLAETVANIRRYQMFGINLSMPYKEQVIPYLDKLSDEARLIGAVNTVVNENGNLIGYNTDGKGFFKCLPSFTISGKKMTLLGAGGAAKSILAQAILDGVSQISVFVRSVSMEKTRPYLXKLQEQTGFKVDLCALEYVSELQARIAESDLLVNATSVGMDGQSSPVPENIVLPETLLVADIIYQPFETPFLKWARSQGNPAVNGLGMLLYQAAEAFQLWTGKEMPTEEIWQSLTEKYQ

SEQ ID NO: 13888 - protein, 399 aa, Oryza sativa
MALSISTPPTSSSLLPASLQVGRWSSSAAMSAGPVAFSLRRPVLAARVAAGGNAPSSSVDEVVTELDAVASFSEIVPDTVVFDDFEKFAPTAATVSSSLLLGIAGLPDTKFKSAIDTALADGECNTMEKPEDRMSCFLTKALANVGAEMAHLVPGRVSTEIDARLAYDTQGIIQRVHELLKLYSDHDVLSERLLFKIPATWQGIEASRLLESEGIQTHLTFVYSFAQAAAAAQAGASVVQIFVGRVRDWARTHSGDPEIDEALKKGEDAGLALVKKVYAYIHKNGYKTKLMAAAIRNKQDVFSLLGIDYIIAPLKILQSLEESVTDTDVKYGYVPRLTPALGKTYNFTEEELVKWDQLSLAAAMGPAAEELLASGLEGYVNQARRVEELFGKIWPPPNV

SEQ ID NO: 13889 - protein, 284 aa, Streptococcus pneumoniae
MKLDGYTRLAAVVANPIKHSISPFIHNRAFEATATNGAYVAWEIEASDLAETVANIRRYQMFGINLSMPYKEQVIPYLDKLSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLYALENVSELQARIVESDLLVNATSVGMDGQSSPVPESINLPETILVADIIYQPFETPFLKWARSQGKPAVNGLGMLLYQAAEAFQLWTGKEMPTEEIWQSLTEKYQ

SEQ ID NO: 13890 - protein, 139 aa, Yarrowia lipolytica CLIB122
MARTKSTVIARKVTGGKAPRKQIGSKAARKSAAPSNTSGGVKKPHRYKPGTVALREIRRYQKSTELLIRKLPFQRLVREIAQDFKTDLRFQSSAIGALQESVEAYLVSLFEDTNLCAIHAKRVTIQKKDIHLARRLRGE

SEQ ID NO: 13891 - protein, 475 aa, Mesorhizobium sp. BNC1
MLDDSKAGRTNRGGRRTPAFLKNLRGVKGWKEARAWLEWRGIEDIECIAPDQAGVARGKMMPSKKFISNTSLALPSAVFMATISGEYPEDGNGFTYPEDDGDLKLVPDLSTLSVVPWETDPTAQVICDLAHQDGRAVEFSPRNVLRRVVAKYAEHGLKPIVAPEIEFYLVHKNPDPDYPLTPPVGRSGRPIGGGQGYSIAGVNEFDELIDDIYHFSEGQGLEIDTLIHEEGAGQLEINLRHGDPVELADQVFLFKRTIREAALKHEMYATFMAKPIQDQPGSAMHIHQSVVTLKGGRNVFSDENGEETDVFRHFIGGLQQHIPNALIMLAPYVNSYRRLTQAGSAPVNTRWGYDNRTTAFRVPRSDPNSRRVENRIPSSDANPYLALAASLACGLIGILQKIEPDAPAGTAVNTDVINLPRGLLEAVALFEADESLRNIVGDLFASTYAAIKRAEFETFMKVISPWEREYLLLNV

SEQ ID NO: 13892 - protein, 189 aa, Helicobacter hepaticus ATCC 51449
MKNVLLPIARGFEEIELVSVADILRRAGVRVVVASLDSHKRVLGAHHIVIEADSALPELEMEHFNAIVLAGGYNGMQNLANNELIKLWLTTFKQEQKLIAAICASPIVLDKAGVLEGEFTCYPGCENQINMQGKNRNAEAVVKNGNIITSVGPATANVFALTIVKELCGGEKAQELYEELQMPSLKAYL

SEQ ID NO: 13893 - protein, 86 aa, Arabidopsis thaliana
MASSMLSSAAVVTSPAQATMVAPFTGLKSSAAFPVTRKTNKDITSIASNGGRVSCMTQAGVSRPKAVKALKESNGDIVSAIMELTT

SEQ ID NO: 13894 - protein, 688 aa, Propionibacterium freudenreichii subsp. shermanii
MSDLKWTDEDREAVNIARTLAADAVEAAGSGHPGTAISLAPLAYLLYQKVMNVDPDDEHWIGRDRFLLSAGHASVLQYSQLYLGGLGLELEDLKYLRQAGSRTPGHPEYGHTKFIEATTGPLGAGISMAVGMAMAARRERGLYDPDNTGASVFDRYVYSIAGDGCMQEGVQSEAASLAGVQELGNLIVFYDDNRITIEGKTRIAFDEDVEARYAAYSWDVQHIDWTNGGDHYEENVQALFDAIEAAKKVTDKPSLIRLTTVIGWPLPHMAGSAHVHGAAIGEDEINAMKKVIGFPTEPFTFNQDIVADTRKALAERGRSARAAWDERFAAWQGSHAEQAALLDRVLARKLPDDLQVPSFEAGAVSTRKASGKVISALAEQLPELWGGSADLAGSNNTTIEGAESFLPADRATDEWPGNPYGRVLHFGIREHAMGGALNGINLSGLTRAFGGTFFVFADYMRPPVRLAALMGAPSVFVWTHDSVGVGEDGPTHQPVEHLASYRAIPGLDIVRPADANETAAAWVEILSHHDRPAGIVLTRQNVRTVDRTSGEFASTDGVAKGAYVLREARNGKPEVILIATGSEVEPALDAQDILETQGIATRVVSMPCQEWFDAQPAEYREEVLPSSIDARVSVEAGLSLGWSKYVGFKGASVSLEHYGASAKGSLLMEEFGFTGEHVAEVAKGVLGK

SEQ ID NO: 13895 - protein, 774 aa, Aspergillus oryzae
MPRYAEAPADGSEVSSGSQLTKRVNKSEEPYETVTEQKATGHPRETDGEDSLGSRGDDDVLYVKGHPVIRNGNRLCADVSKFIVSVRDDGDPSLTFRSIVLGSVFTALSSVITMLYVFKPYQAQVSAVFLQLLVYVFGEAWARLTPRPDRFKWKWLQTVLTFLNFGQRFTIKEHVVAALIASSGNNGLNGVEVYAVERLFYNRGVSATTAVLGTFSMALCGFVLAGIMRPLIVYPGEMVYWSTLPQVVLYQNLHFDRRANKDRLTKFGWAMLLTAVWELFPAYIMTWLSGFSIFCLASMNAPKHTRTIFSTIFGGASSNEGMGLFNFSLDWQYIQSTYLSLPIKQQLNTWIGYVILYAAILGLYYSNAWDAKTFPFMSTSLFQSNGTQFSTSSVINSQGTIDFTKLEETGLPSLTSATVWGYLTQNLAIGALITHVFIFYGKDMVLAWKQSRSKTQPDPHYQAMLKYKEVPMWWYLVLFILAFVAGLIVNIKGETTLPVWGYIVSLLLGAFIAPFSCVLYGLYGTGVSTNQLSKMVAGALHPGRPLANLYFASWSHQCILLSVNLANWLKVGQYTKVPHRVMFATQIYGTLLGAALNYVVMTTIVSSQREILLDPVGNNVWSGSTIQGLNSQAITWALAKDMYGVSSRYFIVPLCLVIGLALPLVHWGLGKVIPRLRKLPLNTAIIVSYAGNPYYGNTSWIWSSIVVGLFSQFWLRRRLPEIYNKYNYLIGAAMDGGSQIIIFVLSFAVLGAAGKERPFPTWWGNPQGNPDHCL

SEQ ID NO: 13896 - protein, 885 aa, Propionibacterium freudenreichii subsp. shermanii
MSEKYIYDLSEGDASMKSLLGGKGAGVAEMMRLGVPVPDGFTVTTQACIETMNNGGTWPAGLRDQISDALARFEERAGRKLGASEKPLLVSVRSGAVVSMPGMMDTILNLGISDESVAAVAAEANNERFAWDCYRRFIQMYGEVVEGLDAHIYEDALTAMKQRKGASQDTDLTAEDLKELTTEFKQISDDALGGAWPSDPREQLMRAVEAVFNSWQNPRAKVYRKANHISDDLGTAVNVMQMVFGNRGETSATGVCFTRNPSTGENALYGEFLTNAQGEDVVAGIRTPRPLIEMKEVLPQAYGELVDTMHKMETHYRDMQDMEFTVENGKLYMLQTRNGKRTAAAALKVASDLVDEGLIDKEEAVRRIEPDQLDQLLHPAIDPGQSATPITKGLPASPGAAVGAAVFDADTAAERGEAGEPVVLIRFETTPDDIHGVLQAQGVLTAHGGMTSHAAVVARGFGKPCVAGATDIKIDTEAKTMTVGGVTVHEGDTLTLNGSTGEVFNTALKLIPPRLNEDFLKVVGWADEIRDLGVEANADNGTDAAKARELGAEGIGLCRTEHMFFGDDRLPAMHEMILSENDEQRQVALDKILPMQQSDFEAIFTAMKGLPVTVRLLDPPLHEFMPDLVTQALKVQEMELKGADPTKLAEERRTLAQVKKLHEQNPMLGTRGCRLGMLYPQIPDMQARAIARAALAVLDREGETVDLQIMVPLVHLRQELQRQREIVVAAVDDELDKAGQKLDYLVGTMIELPRAALVADQIAQEADFFSFGTNDLTQTTLGISRDDAENGFLGWYEAQGVVKRDPFATIDVDGVGQLVRMGTEKGRAANPKLSVGVCGEHGGDPDSIAFFQSVGLDYVSCSPFRVPIARFAAAKAKLAQADASK

SEQ ID NO: 13897 - protein, 477 aa, Helicobacter hepaticus ATCC 51449
MKNIYQSTIFLDKRACEKYHLTPEILMENAACALESLINSLTHKGSVITILCGSGDNGGDGYALARRLSGDYSIRIFQVKEPKSPLCIQAYERACECGIKFIKKILPCDVVVDCVVGSGLKGSLEREASEILSLANKNARLCIACDIPSGLSDKDEGFVFKADYTLCMGAIKLVCLSDRAKDYVGELYIGKLGLSGNHYEVTSNLKMLESSDLALPQRINKNVHKGDFGHLAVFVGEKSGAGILSAQSALHFGAGLVSIISQKDLQIPFDIMQTHTLPHNTTAIALGMGLGVKNVAQILQNLQESTLPCILDADVFHTPMIKNFLDKSLNQQTLDFSREIILTPHPKEFEALLKHCDLGDYNPQKRIDSMLSFTQKYPHTTLVLKGANVFIAKAQDIYINPLGINALAKGGSGDVLSGLIGALLAQGYNGLDSALQGSLAHTLAAREATKHIANYALTPSMLLESITTLQSHKRIHK

SEQ ID NO: 13898 - protein, 398 aa, Saccharomyces cerevisiae
MVSLTFKNFKKEKVPLDLEPSNTILETKTKLAQSISCEESQIKLIYSGKVLQDSKTVSECGLKDGDQVVFMVSQKKSTKTKVTEPPIAPESATTPGRENSTEASPSTDASAAPAATAPEGSQPQEEQTATTERTESASTPGFVVGTERNETIERIMEMGYQREEVERALRAAFNNPDRAVEYLLMGIPENLRQPEPQQQTAAAAEQPSTAATTAEQPAEDDLFAQAAQGGNASSGALGTTGGATDAAQGGPPGSIGLTVEDLLSLRQVVSGNPEALAPLLENISARYPQLREHIMANPEVFVSMLLEAVGDNMQDVMEGADDMVEGEDIEVTGEAAAAGLGQGEGEGSFQVDYTPEDDQAISRLCELGFERDLVIQVYFACDKNEEAAANILFSDHAD

SEQ ID NO: 13899 - protein, 302 aa, Mycobacterium avium 104
MTRGLVIGESLIDIVEDAEYVGGSPLNVAVGLGRLGRDVDFLTYLADDDHGRRIAAYLKDAGVQLVSESRAAERTATARSTIAADGSADYEFDLDWRLSGIPPVAPPLFVHTGSIAAVRDPGCLAVAALIDTYRVSATVTFDPNVRPSLIADRELAVSRIEHLVERSDIVKVSAEDLHWIDPDRSPEQLAQTWLGLGPAVVAVTMADRGAVGYCAAGTARVPTRAVRVVDTVGAGDSFMAGLLDALWEAGLLGGDRRGALRDIGIDTLTSALDAASLSSALTIARAGADLPDRAAVQAALRR

SEQ ID NO: 13900 - protein, 226 aa, Thermoproteus tenax
MKHLLARKAAEYIREGSIVGLGSGSTAKAFIEELAKRVREDGLTVTLVSTSVDSELKAAEVGLDKYLAPLWAVDRIDIAVDGADELTRDRLFLKGGGGAMFREKVVDYRASTLIIIAESHKLVDRIPARHPIPIEVLPAAWRLVADDIVKRWGGKAVLRVCQCGGKLGPLVTDNGNYILDWAPPGPIDPALEDELRGIPGVIESGIFSKRRDAVVLLADERGVFEL

SEQ ID NO: 13901 - protein, 985 aa, Xylella fastidiosa 9a5c
MQHLKYTHSDSFEIDKPRHALLEVLPKQTNNQTKPSRLAPIATSHTNVLPRIQTQSRCSQESNGTSALHLRIQTYLTLSACAREALEILMNRLKEALHNDPNPLETQEWLESIKAVIDIAGPERAHQLLEGVAEQIHRTGTNLPFSPITEYVNTIPTADEAKNPGDPALERSIRSIIRWNAMATVVRANRKPGDLGGHIASFASSATLYDVGFNHFWRAPSPQHPGDLLYIQGHSSPGIYARAFLEGRISESQLDHFRMEVDGKGISSYPHPWLMPQFWQTPTVSMGLGPLSAIYQAQFMKYLEHRGLIAPSDRKVWCFIGDGESDEPETLGAIALAGREGLDNLIFVVNCNLQRLDGPVRGNGKIIQELEGVFRGGGWNVIKLLWGAHWDPLLAQDTQGVLRKLMMETVDGEYQNCKAFGGEYTRKHFFDKYPETAAMVAHLSDNDIWRLNRGGHDPHKIYAAYHRAVNTQGMPTVILAKTVKGYGMGTAGESLNPTHQTKKLDHDAIKHFRDRFNIPISDQQLDAADHIPFYHPGPDSPEIKYMLARREALGGFLPQRRTKSSKSFIVPGLDKYERLLTSSGERTYSTTMAFVQSLNITLRDKALGPHIVPIVADEARTFGMEGLFRQIGIYAPFGQKYKPVDADQLMYYREDESGQVLQQGITEPGAIASWMAAGTSYSVSDVPMLPFYIYYSMFGFQRIGDIAWQAADMRTRGFLLGGTAGRTTLNGEGLQHEDGHSHLMAGAIPNVRSYDPTFGYEVTVILQHGMKAMMQDQIDEYYYLTLMNENYAHPDMPAGAEQGIIKGMYLLKDAGKPKKGELRVQLLGSGAILREAIAAAELLHQDFGITADLWSCPSFSELRKDGFDTERWNRLHPDSEPRTPYVTQQLENRQGPAIAATDYVRLFADQIRAFVPMHYTVLGTDGFGRSDTRSNLRRFFEVDRYFIAHAAIAALAKEGKMTGKDVARAIEQYNINPEKPNPVDI

SEQ ID NO: 13902 - protein, 371 aa, Pyrococcus furiosus DSM 3638
MKFPRKGIPQEEVMRELEKYTSKDLSFSSGKILGSMCTLPHELAKEVFCMYMDRNLGDPGLHPGTKKIEEEVIEMLSDLLHLERGYGHIVSGGTEANILAVRAFRNLADVENPELILPKSAHFSFIKAGEMLGVKLIWADLNPDYTVDVKDVEAKISENTIGIVGIAGTTGLGVVDDIPALSDLARDYGIPLHVDAAFGGFVIPFAKELGYDLPDFDFKLKGVQSITIDPHKMGMAPIPAGGIVFRHKKYLRAISVLAPYLAGGKIWQATITGTRPGASVLAVWALIKHLGFEGYMEIVDRAMKLSRWFAEEIKKTPGAWLVREPMLNIVSFKTKNLRRVERELKSRGWGISAHRGYIRIVSHASCDGGHD

SEQ ID NO: 13903 - protein, 340 aa, Thermoproteus tenax
MFKTHTFSGVMKLAVIPGDGIGPEVVSATLKVIEAAARRFSIPLDIKVVEAGDVAARKYGKPMPDEAWKIVDSADAVLKGPVGETAYDVTSAIRMKYVLYANIRPAKNLPGVPAVKPIDCVFVRENVEDVYVGAEYRVGDVAIALKVITREGTARVARVARRYAEMRRRKVTIVTKSNVLRVVDAFFRDVARGELDGLQVEEMYVDAAAMELVRNPSRFDVVLTTNQYGDILTDLAAQVAGSLGLAPSANIGDKKAMFEPIHGAAFDIAGKGIANPIATILSAAMMFEWMGRQDAANAVRGAVEEALRRGVATPDIGGRATTEEVGRQIAAIVESWPTTS

SEQ ID NO: 13904 - protein, 426 aa, Idiomarina baltica OS145
MADRKATLQIDGQSIELPVLSPSAGKDVVDVRSLGKHGYFTFDPGFLATGSCESKITYIDGENGVLLHRGYPIGDLATQADYLEVCYMLLHGEAPDEKQYQDFRKTITKHTMVHQGLHNFFNGFRRDAHPMAMLCAVTGALSSFYHDDLDIHDPDQRLRSAYRLIAKIPTIAAMAYKFSIGQPFVYPRNDLGYAENFLNMMFSVPAEDYEISPAVAKAMDRIFILHADHEQNASTSTVRLAGSSGANPYACIASGVASLWGPAHGGANEACLRMLAEIGSVENIPKYIEKAKDKNDPFRLMGFGHRVYKNMDPRATVMRESCHEVLKELKRDDPLLDVAMELERIALEDDYFVEKKLFPNVDFYSGIVLKAIGIPTNMFTVIFALSRTVGWVSHWHEMMSEESQKIGRPRQLYTGHTQRDFKPIKK

SEQ ID NO: 13905 - protein, 262 aa, Triticum aestivum
MGGRNRRWPTKRHHDASSNPRPPPPYSGYSHVDNQCQVPLWEREFCSLVGGISWQRFCENKHFAYMYKDIEQWDDSGAFENFQNAKSRFWSHYHGQPSDIPYPDPDLYIDEVDHRCEVDPELVADLDKVGVPFEADNKPAVAANNRCAQNQSGNWDIYLEKPTPEVNKWEADNSVSNAGWGASQEPLSSWNKISTGWGDALAQPGWGSSGNNHCSGNNWNSPHGASSNNNTYYQDTGRCVWQEKEQWRRVLPAEEQQAEEPG

SEQ ID NO: 13906 - protein, 604 aa, Synechococcus sp. CC9311
MCGIFGGFSFEASAFSGELPVMMAKSILHRGPDNTGYWSNEEALLGNCRLSIIDLSKNGNQPFYSKNKDIVVVQNGEIYNYIELRDLLIGEGACFQSDSDTEVVLHAYAIWGPDFVSRLNGMFSIAIYDSRVSTAVLRLYRDRLGVKPLYYCIDGGCLWFGSEIKAILAAGVKANPNYNALRSYFALNYIPPPQTAFANIYHLQPGHSAAITKSGVKLNRYWDCNDIGLNEDITTAEAKSGIITLLDDAVRIRLRSDAPFGAFLSGGLDSSSVVGLMSLYKESPTKTFSIGFEDARYDETSYAEMASKRFGTYHSTKIMSENALDIWSKFIWHCDQPHGDISFIPTYQVSENASQEVKMVLTGDGGDELFAGYDKYASFFSGECDRSHPRWFSDYAQFTGLIEADMAKRLFKGEIKASFEENDPYAPITESMLRFGQDDHINKVLYADTVNLLPGNNLVKPDRMAMAHSLEVRSPFLDYRLVEYAFSLPGKMKLKGTETKYIYKMAVEELLGETLTWRKKQMFTVPVGDWFRGHLADFCSRILLDNRSLSRGLYAESVLREVIEDHTSARKNYTRLLRALISLEIWFRLFIDQDMSNLELITSK

SEQ ID NO: 13907 - protein, 552 aa, Haemophilus somnus 129PT
MTALFTTAQNWLAQDPDAETRAELQTLLNQAKAGDMNAQKELHNRFNGRLQFGTAGLRGRLQAGSMGMNRVLVAQAAGGLAEYLKGYDSEPSIVLGYDGRKNSNVFVRDTAEIMAGAGIKTFLLPRKLPTPVLAYAIKYLNTTAGVMVTASHNPPEDNGYKVYLGKANGGGQIVSPADVDIAKLIDKVANGDIRDLPRSQHYTVLDDEIVEAYIAKTASIAKEPQANINYVYTAMHGVGYEVLSKTLAKAGLPQPHLVEEQIQPDGSFPTVKFPNPEEKGALDLAIKLAKAKNAEFIIANDPDADRLAVAVPDSEGNWKPLHGNVIGCFLGWYLAKQYHAQGKQGKLACSLVSSPALAEIAKKYGFQSEETLTGFKYIGKVNDLLFGFEEALGYLVDPDKVRDKDGISAAIAFLDLVRSLKKEGKTLTDYANDFTAEFGAYVSGQISIRVNELSDIGKMMTALRKEPLTELGGFKVTQFIDHSKTDRASDILVFVLENGSRLIVRPSGTEPKVKFYLDVCGTDPKNAGEVLAEFDENVRQILRQEKYGKQDC

SEQ ID NO: 13908 - protein, 332 aa, Anabaena variabilis ATCC 29413
MTKNLLEQLREMTVVVADTGDIQAIEKFTPRDATTNPSLITAAAKMPEYQEIVDQTLLQAKKDAGAGASKGQIVSLAFDRLAVSFGLKILQIIPGRVSTEVDARLSYDTEATITKARELIAQYKAAGIGPERVLIKIASTWEGIKAAEILEKEGIHCNLTLLFGLHQAIACAEAGITLISPFVGRILDWYKKETGRDSYPSAEDPGVISVTTIYNYYKKFGYTTEVMGASFRNIGEITELAGSDLLTISPGLLGELQATIGELPRKLDPAKAATLDIEKISIDKATFDKMHAADRMAYDKLDEGIKGFTKALEELETLLAERLARLEVVASH

SEQ ID NO: 13909 - protein, 440 aa, Mesorhizobium sp. BNC1
MTYILHRQIHGQLPVAAGGRGVKLFDSAGKEYIDASGGAAVSCLGHNHPDVVAALKRQAEKLAYAHTSFFTNEPAEALAERLVKAAPEGISHAYLVSGGSEANEAALKMARQFFVEKGEAQRRHIIARRQSYHGNTLGALAAGGNEWRRAQFRPLLIETHHIDPCYAYRYRQQGESDEEYGLRAAQQLEDKILELGPDTVMAFIAEPVVGATAGAVPAVSGYFKRIRDICDRYGVLLILDEVMCGMGRTGTLFACEEDGVSPDLVSIAKGLGGGYQPVGAVLLSRQIFDAFAQGSGLFQHGHTYICHPMACAAALAVQEVIERDNLLANVREMGSYLRARLEARFGNHAHVGDIRGRGLFLGLELVADRATKEPFDPARKIHAGVKKEAMARGLMVYPAGGTIDGARGDHVLLAPPFILDKETADTIVDRLGEAIDAALG

SEQ ID NO: 13910 - protein, 343 aa, Anabaena variabilis ATCC 29413
MAKLKVGINGFGRIGRLVLRAGINNPNIEFVGINDLVPPDNLAYLLKYDSTHGKLRSQVEAKDDGIVIDGHFIPCVSVRNPAELPWGKLGADYVVESTGLFTDSEGASKHLQAGAKRVIISAPTKDPDRVRTLLVGVNHDLFDPSKDVIVSNASCTTNCLAPIAKVINDNFGLTEGLMTTVHAMTATQPTVDGPSKKDWRGGRGAAQNIIPSSTGAAKAVALVLPELKGKLTGMAFRVPTPDVSVVDLTFKTAKATSYKEICAAMKQASEGSLAGILGYTDEEVVSTDFQGDTHSSIFDAGAGIELNSNFFKVVAWYDNEWGYSNRVVDLMLSMIQKEQLAAV

SEQ ID NO: 13911 - protein, 313 aa, Halobacterium sp. NRC-1
MLVAAHHTRMPTHAPAPGSGDPLGLHGVVPPVVTAFDADESLDADTTADHARMVVDAGVHGVFPLGTNGEFPLLTPSERDRVVTAVVDEVGGEVPVIAGVGAPSTRQTVAHAEHAASVGADGVVVVTPFYYPLDGTAAVEHYRRVAAAVDCPVYVYHIPSKTGNELSLETLAALAEIDTLAGVKDSSKDVPWLGQAVDAHPELTFLAGSDSLLAPGLDVGCAGLVSAVANVAPELVVGLYEAYDEGDRERARARQSTVYEVRAALKRGPYMAGVKAALGLRGFDAGPLRSPLRGLDDDDRAALEADLADLGLL

SEQ ID NO: 13912 - protein, 266 aa, Zea mays
MAMELPLFLGDGPDAALFSSLWSSFPDDLQPPPQQESVAELKQTLLATTLELEAAREELRRKEQSIAKLSDLVREVAKERDDARDQAQSLRLLAAQAAPPLVTSSVTDSDCSLASSPVDPFFDPVTSADNRRRCKFSPATPPAAPRQQQQRQPGAGLGSAADAALEMLAAKRPLPHRGRLLAAVMEAGPLLQNLLVAGQLPRWRNPPTVRAPDTLPLGASRAAGYADDAVTLAASGCTKRPMAAALPVLPAASCSPGFIAKRQRLH

SEQ ID NO: 13913 - protein, 125 aa, Halobacterium sp. NRC-1
MAQDAVDDIVDAAIENNEVVLFMKGTPAAPQCGFSERAIRLISDYRPDVHTVDVLQSTDEFRAALERHSGWETTPQAFVDGSFVGGSDILAELADRGDLADELNADGVDTTADDAALDADIDAPF

SEQ ID NO: 13914 - protein, 307 aa, Mesorhizobium loti MAFF303099
MILCCGEALIDMLPRITTQGEPAFAPYVGGAVFNTAIALGRLGAPAGFFSGLSSDLFGGQFRDALGASKVSSTYAHTSPRPTTLAFVRLTNGQATYTFYDENTAGRMLTIDDLPSLGNEIEAMLFGAISLISEPAGGAYEEFMRREHASRVMMLDPNIRPNFIPDKAKHLRRIREMMAMADIVKLSDEDLHWFGEAGSHEDVIRNWLDRGPKLIVVTHGSEGAVGYTKDHTVTVMPEKVEVVDTVGAGDTFNAGILASLHEQGLLTKAAIGGLPQDAIRKALALGAKAAAVTVSRAGANPPWRHEIA

SEQ ID NO: 13915 - protein, 483 aa, Prunus dulcis
MSSSSSSSSSPNNLPLKPIPGDYGWPFFGHIKDRYDYFYNQGRYDFFKTRIEKYQSTVFRTNMPPGILIASNPKVIALLDAKSFPIIFDNTKVLRRDVLDGTYMPSTAYTGGYRVCAYLDPSEPNHATLKSYFAALLASQHTKFIPLFQSSTSDMFLNLEAQLSKDGKAYFNTLSDDMSFNFAFELFCGQSPSNTKLGSKGPSLVTLWLFPQLAPQITFGLPKFLALAEDFLLHTFSYPAFLVKSPYKKLYDAFYESAASALDLAEGKFGLSREEACHNLLFVAGFNAFGGMKLLFPALIKWVASGGEELHRELRNEIRAVLKESEGEVTFAALEKMTLTKSVVYEALRIEPPVPYQYGKAKEDIVIQSHDATFEIKKGEMIFGNQNFVGKDPKVFENPEEFVAHRFVGEGEKLLKYLYWSNGRQMDDHPTAENKQCPGKDLVVLISRLMLVEFFLRYDTFTVDAGTVLLGSSVTFKSLTKAS

SEQ ID NO: 13916 - protein, 363 aa, Wolbachia endosymbiont of Drosophila ananassae
LEVGRNASIDEIKKAYKKLALKYHPDRNPGNQEAEEKFKEVTAAYEVLSDSEKRAGYDRYGHEGASGGFQGFSSAGDFSDIFNDFFGGGFGGGASRSRAKRSTTGVSGADLRYDLEITLEDAFKGIQAPIHYVTNVKCDTCQGTGGEGAIKPVQCHTCQGSGRIRTQQGFFTIERTCTTCYGEGEIIQNKCKKCGGSGRRRDEVNISVSIPKGIEEGAKVRISGKGEAGTKGGKSGDLYVYVKIIFHKIFARNKADLHCKVPIRMTLAVLGGEIDIQSIDGAKIKVKVPEGTQTGTKLRCREKGMPYMNSHARGDLYVQVIVETLNPKNLTKKQIELLKALEEEENASVQQQSEGFFSKVKKK

SEQ ID NO: 13917 - protein, 360 aa, Triticum aestivum
MARVEALSMSGLSVIPVEYVRSMDERQSLGDAYDQAAASWSTAGCQRIPIVNVAPFDGADPSSPASAAVVDAVRAAAEDWGVMHVAGHGIQDDLIDALRGAGMGFFGMPIADKEAYANNPAAGILEGYGSRLAGSAGEDGKREWEDYLFHQLHPDARADHARWPAHPPEYVPVTKSFGERVSELAARLLAILSLGLGVPAPTLERRLRLSDEEVAVEDDLLLKMKINYYPPCPQPELAVGVEAHTDVSALSFILTNGVPGLQVLNSAGAWVTARDEPGTLVVHVGDALEILSNGRYTSVLHRGLVNRRTVRISWVVFAEPPPDSVRLRPLPELLVNGAEPRFEPRTFRQHLENKVLKKKD

SEQ ID NO: 13918 - protein, 521 aa, Solanum tuberosum
MAASIGALKSSPSSNNCINERRNDSTRAVSSRNLSFSSSHLAGDKLMPVSSLRSQGVRFNVRRSPMIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIVI

SEQ ID NO: 13919 - protein, 336 aa, Sulfolobus tokodaii
GFTVALIQGDGIGPEIVSKSKRILAKINELYSLPIEYIEVEAGDRALARYGEALPKDSLKIIDKADIILKGPVGESAADVVVKLRQIYDMYANIRPAKSIPGIDTKYGNVDILIVRENTEDLYKGFEHIVSDGVAVGMKIITRFASERIAKVGLNFALRRRKKVTCVHKANVMRITDGLFAEACRSVLKGKVEYSEMYVDAAAANLVRNPQMFDVIVTENVYGDILSDEASQIAGSLGIAPSANIGDKKALFEPVHGAAFDIAGKNIGNPTAFLLSVSMMYERMYELSNDDRYIKASRALENAIYLVYKERKALTPDVGGNATTDDLINEIYNKLG

SEQ ID NO: 13920 - protein, 110 aa, Oryza sativa (japonica cultivar-group)
MLSLLGLTEFFPVLVIGSECDRAKPFPDPYLKALELIGASPDHTFIFEDSASGIRAGVAANVPVVGLTTRNPEKVLQDAGASLLIKDFQDPKLLSILEEIEPTVAAVEQV

SEQ ID NO: 13921 - protein, 515 aa, Yarrowia lipolytica CLIB122
MLRALNTVQRLSSTRAMSTSSISSLLKNPNLLRNQGYVNGQWVSSKTGDTFSVENPATGETLGQVPEFSVAEADEAVQHAQTAFKTFKHTTGRERSKMLRKWYDLMQENAGDLATLVTLENGKSLADAKGEIGYGASFFEWFSEEAPRIYGDIIPSANPANRIYTIKQPIGVCGIITPWNFPSAMITRKAAAAVAAGCTMVIKPGSETPYSALALAYLAEQAGIPKGVVNVVTTKKNTRAFGNALCENPTVKKVSFTGSTGVGKTLMGASASTLKKLSFELGGNAPFIVFEDADIDRAVDGAIASKFRGTGQTCVCANRIYVHESIAEKFAERMAAVVKDFKVGNGLDPNTTHGPLIHEGAKGKIQEQVDDAVKKGGKVLIGGSDAPEIGKAFFQPTVISGAKSDMLIASEETFGPIAAIFPFKTDAEVIELANKAEVGLAGYFYSKDVYRIQQVAEALEVGMVGVNTGLMTECALPFGGIKESGFGREGSKYGLDDYMVLKTIVVSGVEPHIQP

SEQ ID NO: 13922 - protein, 1203 aa, Coccidioides immitis RS
MPSFKDEHILIIAPGSQTTLAQLGLPDSFTPAKFRFPTRMFPAEKKGEWEPFKIRQKVITVKKTTPKDSATRNDAAAPTTGTSNAAEKSEDTEMKDAADGVQQPAKEQDTRPELVEVEEEQVVYEEDPTSDEGAVYPIRGGAVVDWTCFFALLTHIYNTLSPPFHTPIMLIAEPVWTLRDRETLTQFIFEKFKTPAFCLMDSAVAVCYAYGTPNATVVDIGHEKADVTAVTDFMASEYGRGIALAGCGGDAMTSRLFELLQSQGFTREMCEQLKRSNICEILPTGTPLPTSGQDREPAKAPPPSAPGKGPDIARNVGNGDADDDEGILDVAAIVSGNTSEYLAKREREKAEKAATRKGHGDSSATTKQVRLPNSKKEKATFQFQEYKPVESRDESGQKTKQFVLHKRDVEVGTERFLATTPSDTKASEHGSYSILDTLAAQIHHTIHSVSDTSKRSELWDSMIILGNGSKIRGFPQALVSTITQKYVLSPSGTIFTSEIPSALSTPLPTGGTNTPAHQPNPSPLLHPAAHGVNPLLVAATHANNPIAPNHLNPSMNNPSDPNASAHHRSTGHSQTPTSVKLLRPPEYFPEWKDQGSGGSSAASMAANNVPASGGAVTGVATSSNNVGMEEATFLGAQVAAKVIFVIDQGLTKGFLSRVEYNDAGPTAIHDYSITGAIKDAKDGAPYIKKYAQSSYEISISMPRTTAARPSTAAAERRHVPLADDILNAGHLRTKKANKRKSRHDDDAEADDHYIDAKSSRKILQIGQDLAEEEAAEERAAAAARRPAATNSAFDFESRFGRDLEEGSDEEEFGKFGEEEDQWEDEGEVEEIEVDPNDLEMFHKFVGRDDEDPIFNPRQPGEEEEGEGTNLADLILEKIAAYEAKQSGQPQIIGGGLPEDAVQLPAKAVEVYEKVGFLLSRYKSGPLPKPFKILPTLPHWDTLLDITQPDKWTSNSIYAATRIFISAKPHIAQHFISVVLLDRVREEIRENKKLHVHIYNALKKALYKPACFFKGFLFPLVAGGTCTLREAHIVSSVIARVSIPVLHSAAALLRLCEISAEQTSTSLTSEGTGATNIFIRVFLQKKYALPYKVIDALVFHFLRFRAVQPQETDGDTDMNDPSAAKAHKLPVLWHQSLLVFAQRYRNDITEDQREALLDLLLVAGHKDIGPEVRRELLAGRGRGVMAPELQQQNNGGDDTMDVTM

SEQ ID NO: 13923 - protein, 170 aa, Arabidopsis thaliana
  misc_feature (100)..(100): Xaa can be any naturally occurring amino acid
  misc_feature (125)..(125): Xaa can be any naturally occurring amino acid
  misc_feature (146)..(146): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRKKWIPCVEFXELEHGFVYREQGNSPGYYDGRDWTXWEASLFGWTDSAPGLKESERXRRGTPRAFIRIFGFEKTPATPGHQ

SEQ ID NO: 13924 - protein, 113 aa, Synechococcus sp. CC9311
MAGDTIFARILRGEIPCDEVYSDESCLAFRDVAPVAPVHLLVIPRKPLESLLEAEAGDEELLGHLLLVAARVAKQEGLSDWRTVINSGEGAGQTVFHLHVHVIGGRSLDWPPG

SEQ ID NO: 13925 - protein, 671 aa, Idiomarina baltica OS145
MCGIAGVFNHRVNDPIDAQTLVNMAAIMHHRGPDGYGYHIQSEQGIGFSHARLSIIDLDEERAKQPFLSADERLMLTHNGEFYDFKRIRADLTARGARFRTKSDSEIVLHLFERYGLEATLKELRGEFAFGLYDKDEDALYLVRDRFGIKPLYWTETDEGVVFGSELKVLFAHPQVKRAFSAEGLYHQLIQVMVPGSTAFEGVHQVQPGQVVKIKRNNGTLNIDTLKYWDVDFPNEHDYPGDEVDETEYVEGVREKLLEAVQHRMTADVPVGCYLSGGIDSCSILGLASASTQTSVKAFTIGFDSDDYDETPIAREMAEATDADHHIMALKANDLYDHFVKTLWHTERTIYNTLGVAKYLMSQEVHEAGYKVVMTGEGSDELFAGYPAFRKDMFLHGLDHLPEIERLEWQKLLEKNNQLFKGAMLAREEFSSDALNKKVGFTPSCVQPWLSCSSVAKPLINRDLQKQLGNYDPGQAIADTLDETYLAGRHPLDRAQYVWIKTMLEGQILTWGGDRVDMANSMEARPAFLDHHLAEYAFTVPPHLRIKGNKEKYVLREAMKGLLPETLYKREKFAFMAPPAHTDPEKWKAVERLAEEFLSEQAVKDAGLLDFDAVQAVFARHSSSDVTAEEQVQLDAVINHMLGVQVLHHHFVATDVPKQAQQRAQELGWHA

SEQ ID NO: 13926 - protein, 558 aa, Arabidopsis thaliana
MHCFPCFSSPKNKKSSTTNETNDNNEPKPDDRRRAEETEEIEQSEGTSLKIFTFRELATATKNFRQECLLGEGGFGRVYKGTLKSTGQVVAVKQLDKHGLHGNKEFQAEVLSLGQLDHPNLVKLIGYCADGDQRLLVYDYISGGSLQDHLHEPKADSDPMDWTTRMQIAYAAAQGLDYLHDKANPPVIYRDLKASNILLDDDFSPKLSDFGLHKLGPGTGDKMMALSSRVMGTYGYSAPEYTRGGNLTLKSDVYSFGVVLLELITGRRALDTTRPNDEQNLVSWAQPIFRDPKRYPDMADPVLENKFSERGLNQAVAIASMCVQEEASARPLISDVMVALSFLSMPTEDGIPTTVPILSFKDKSMSIALSRHDSNLVSPPPELATEDDKSSTSSGEESSLESEKESVSKNEYKKKHEEEDSSMESDDESDSNSEHEKDQPPKPIDEKNQAQSLKIKYRYSWEDIDVNDERLSSKSSQKSNDESTSSRYDSDRDQDEKGKEEEEEEEAEEKHTHIEHIDSSKTDDDQSVYFDNDDDSGDDNGGSLHRIKSDVAIDSIKE

SEQ ID NO: 13927 - protein, 411 aa, Nicotiana plumbaginifolia
MNALAATNRNFKLASRLLGLDSKLEQCLLIPFREIKVECTIPKDDGSLATFIGFRVQHDNARGPMKGGIRYHPEVDPDEVNALAQLMTWKTAVANIPYGGAKGGIGCSPSDLSISELERLTRVFTQKIHDLIGVHTDVPAPDMGTNPQTMAWILDEYSKFHGYSPAVVTGKPIDLGGSLGRDAATGRGVLFAAEALLRDHGKSIAGQRFVVQGFGNVGSWAAQLITEQGGKIVAVSDITGAIKNKNGIDIASLLKHVKENRGVKGFHGADSIDPNSILVEDCDVLIPAALGGVINRDNAKDIKAKFIVEAANHPTDPEADEILAKKGVVILPDIYANSGGVTVSYFEWVQNIQGFMWDEERVNTELKAYMNRGFKDVKDMCKTHNCDLRMGAFTLGVNRVARATTLRGWEA

SEQ ID NO: 13928 - protein, 440 aa, Coccidioides immitis RS
MLQVPLRERNTDMASTTKAVILVGGPSRGTRFRPLSLDVPKPLFEVAGHPIIWHALKAVTKIPDIREVILIGYYDETVFRDFIKDSLKEFPQFKIQYLREYRALGTAGGLYHFRDAILKGRPERFFVLNADVCCSFPLVEMLKLFVEKDAEAVILGTRVSNETATNFGCIVSDAHTKRVLHYVEKPESHISNLINCGVYLFATECIFPSIKSAIKRRTARPRLFSYPSSEHLESSYGAEQDDEGEKSEVLRLEQDILPDLADSNRFFVHETKDFWRQIKTAGSAVPANALYLQKAFQSGSEELAAPSATIVPPVYIHPTATVDPTAKLGPNVSVGARAVVGAGARIKESIVLEDAEIKHDACVLYSIIGWSSRVGAWARVEGTPIPTGSHSTSIIKNGVKVQSITILGKECGVGDEVRVQNCVCLPYKELKRDVANEVIM

SEQ ID NO: 13929 - protein, 523 aa, Salinibacter ruber DSM 13855
MDSSKRHLLLILDGWGLADDPSVSAVEQADTPFVDHLYDEYPHGVLKASGLEVGLPDGQMGNSEVGHTNLGAGRVVYQEILRISKAIEDGSFFENDALVRAARHAKASDQKLHLMGCFSDGGVHSHLEHLYGLLELARREGLAPAQVNVHAFTDGRDTDPHGGVDYVEQFQKKADEIGVGRLASIVGRYYAMDRDERWARTERAYRLLTDGTGAAFDDPVTALKASYDDGVTDEFVEPRRIRADDADAFGDHGTRIEDGDAVVYYNFRSDRARQLTRAFTEADFDGFERERPDDLLFVTMSPYDDEFDLPVAFEKLNLEGTLGEVLSARGGRQLRAAETEKYAHVTYFFSGGREAPFDGEDRVLVPSPKVDTYDQQPEMSAPELADRVSRSLREADYTLAVLNFANPDMVGHTGDFEAAVAACEAVDRGARQVVEAARDQGYSVSIIADHGNADRLQNPDGSPHTAHTTALVPHIILKDGFEGPVRDGKLGDVAPTILTLLGEDVPDAMDGEVLVPAERAAAS

SEQ ID NO: 13930 - protein, 389 aa, Arabidopsis thaliana
SFRSKAVHFVTDLTAGLLNPISDKPSSAHPPPPLPDEEDESKRNQLESTTAEQPKDLVDEPDTSSFSAFLGSLLSSDPKDKRKDQDPEDEEDEEEDEEEDSEAETSDTSSSSANPTRTMKETTSGGAAKKSFLSKYKQHFRNFYQAVKFPGVKERKGNSDVIPDDEETEYYDGLEMKPMQNNNVKEEVTVVVQAIIPEISEPSLLLSEQSRRSLYTSLPALVQGRKWILLYSTWRHGISLSTLYRKSLLWPGLSLLVVGDRKGSVFGGLVEAPLIPTDKKYQGTNSTFVFTNKSGQPTIYRPTGANRFYTLCSKEFLALGGGGRFALYLDSELLSGSSAYSETYGNSCLADSQDFDVKEVELWGFVYGSKYDEILAHSKTMEPGLCRWS

SEQ ID NO: 13931 - protein, 356 aa, Coprinopsis cinerea okayama7#130
MSQEYEKRRLVGVHAEHVSNISSTDYPGVYPGLDDSWSLSKFKKNLKVQITRLSQHTIEFDLVGVDASIANAFRRIMIAEVPTIAIEHVYVWDNTSVIVDEVLAHRIGLVPLNVNPSIMDSRSPQNDPTDRDTLIFKLDVTCTRNPNAPKGSTNPDELYINHEVLSRDLVWSPVGQQAEVFEGCPPAPINPNIVLTKLRPGQAVNMELHAVKGVGKDHAKFTPVATASYRLLPHIKIKKPIPPEHAEKFAKCFSPGVIKVDPQTKQVSVDEHNVRKDTVTREVFRHPEFADSVELSRVRDYFLFNVESEGPYAPERLLPEAIKVMREKIATIKAAAEALLNDQNGAGDGDVSMADA

SEQ ID NO: 13932 - protein, 336 aa, Pseudomonas putida GB-1
MKAAVVAPGRRVDVVEKTLRPLQHGEALLKMQCCGVCHTDLHVKNGDFGDKTGVVLGHEGIGVVQEVGPGVTSLKPGDRASVAWFYQGCGHCEYCNSGNETLCREVKNSGYTVDGGMAEACIVQADYSVKVPDGLDSAAASSITCAGVTTYKAVKISNIRPGQWIAIYGLGGLGNLALQYAKNVFNAKVIAIDVNEEQLRFASEMGADLVVNPLNEDAAKVIQAKTGGAHAAVVTAVAKGAFNSAVDALRAGGRLVAVGLPSESMDLNIPRLVLDGIEVVGSLVGTRQDLQEAFQFAAEGKVVPKVTLRPIEDINQIFDEMLEGKIKGRMVIQFEG

SEQ ID NO: 13933 - protein, 284 aa, Streptococcus pneumoniae
MKLDGYTRLAAVVANPIKHSISPFIHNRAFEATDTNGAYVAWEIEASDLVETVANIRRYQMFGINLSMPYKEQVIPYLDKLSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQCNPAVNGLGMLLYQAAEAFQLWTDKEMPTEEIWQSLTEKYQ

SEQ ID NO: 13934 - protein, 488 aa, Zea mays
MASASMLARSLLRTPDPTQTSHPNRRSAAVVSFPRRHRRLSVRASVSTASPSPPPQPAAAAAGVPKHCFRRGADGYLYCEGVRVEDAMTAAERSPFYLYSKPQILRNLAAYRDALQGLRSIIGYAVKANNNLPVLRVLRELGCGAVLVSGNELRLALQAGFDPARCIFNGNGKTLEDLKLAAESGVFVNVDSEFDLENIVRAARATGKKVPVLLRINPDVDPQVHPYVATGNKTSKFGIRNEKLQWFLDSIKSYPNEIKLVGVHCHLGSTITKVDIFRDAAVLMVNYVDEIRAQGFKLEYLNIGGGLGIDYHHTNAVLPTPMDLINTVRELVLSQDLTLIIEPGRSLIANTCCFVNRVTGVKSNGTKNFIVVDGSMAELIRPSLYGAYQHIELVSPPTPGAEVATFDIVGPVCESADFLGKDRELPTPDEGAGLVVHDAGAYCMSMASTYNLKLRPPEYWVEADGSIVKIRHGEKLDDYMKFFDGLPA

SEQ ID NO: 13935 - protein, 403 aa, Glycine max
MASATFSVAKPALQANGKGFSEFSGLRSSSGFLPFSRKSSEDFHSVIAFQTYAVGSSGGYKKGVTEAKLKVAINGFGRIGRNFLRCWHGRKDSPLDVIAINDTGGVKQASHLLKYDSILGTFDADVKPVGSNVISVDGKEIKVVSDRNPANLPWKDLGIDLVIEGTGVFVDREGAGKHIQAGAKKVLITAPGKGDIPTYVVGVNEYDYSPDEPIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNAAFRESADNELKGILSVCDEPLVSVDFRCTDVSSTVDSSLTMVMGDDMVKVIAWYDNEWGYSQRVVDLADIVANKWK

SEQ ID NO: 13936 - protein, 392 aa, Triticum aestivum
MLRLRCCVLNHLLSSPATSPASHLHRLVSAAAPAPAAPPNATFAVEDYLVETCGLTRAQALKASAKLPHLKSPSNPDAVLAFLAGLGLSGADVAAAVARDPRLLCAKLDKALASNVAGLAGLGLSRCEIARIVSLAGYSLGNKSAVSKLHYYLPLFGSPEKFIQAMKFNTNLLTYSLERVTKPNVAFLRKCGLGACDIAKLCAARSRMLTINIDRLRAMVAFAEGLGVPRGSRMFWRALNAVAALREENIAAKVDSLKNIFRWSGAEVGIAFCKAPMVLALSKDLLQSKSDFLISEVGLTPAYIAPRSTLLTFSLEGRLKPRYYVTKFLKENGLLDHDRDYYSAVILTEKVFMEKFICPHKEAAPQLSEDYAVACKGEVPTRFRFSGTKNLQ

SEQ ID NO: 13937 - protein, 284 aa, Streptococcus pneumoniae
MKLDGYTRLAAVVANPIKHSISPFIHNRAFEATATNGAYVAWEIEASDLVETVANIRRYQMFGINLSMPYKEQVIPYLDKLSDEARLIGAVNTVVNENGNLIGYNTDGKGFFKCLPSFTISGKKMILLGAGGAAKSILAQAILDGVSQISVFVRSVSMEKTRPYLDKLQEQTGFKVDLCALEYVSELQARIAESDLLVNATSVGMDGQSSPVPENIVLPETLLVVDIIYQPFETPFLKWARSQGNPAVNGLGMLLYQAAEAFQLWTGKEMPTEEIWQSLTEKYQ

SEQ ID NO: 13938 - protein, 248 aa, Chlamydophila abortus S26/3
MNGILSGKKAIVTGGSRGIGFAISKLFVEQGADVEIWGINDEGGKQAAQELSKIGRPATFAKVDVSKSQSVKDAVQNFITAHGNIDILVNNAGITRDNLLMRMSEEEWSAVINTNLNSLYYVCSSVIRPMIKARSGSIINISSVVGLMGSPGQTNYAAAKAGIIGFSRALAKEVAARNIRVNCIAPGCIDTDMTRVLNDNLKTEWLKNVPMGRMGFPEEIANAALFLASPLSSYITSQVLSVDGGMTY

SEQ ID NO: 13939 - protein, 643 aa, Burkholderia xenovorans LB400
MNANPKFLSADAHVDEAAVAPLPNSRKVYVTGSRPDIRVPMREISQADTPDSFGGEKNPPVFVYDTSGPYSDPEARIDIRAGLPALRQAWIEERGDTEALTGLSSDFGRERAADTATADLRFQGLHRTPRRAIAGKNVSQMHYARKGIITPEMEYIAIRENQRRAEYLESLKTSGPNGEKLAAMMGRQHPGQAFGASAFGPNGLTEITPEFVREEVARGRAIIPNNINHPESEPMIIGRNFLVKVNANIGNSAVTSSIGEEVDKMTWAIRWGGDTVMDLSTGKHIHETREWIIRNSPVPIGTVPIYQALEKVNGKAEDLTWEIFRDTLIEQAEQGVDYFTIHAGVRLQYVPLTAKRMTGIVSRGGSIMAKWCLAHHKESFLYEHFEDICEIMKAYDVAFSLGDGLRPGSIYDANDEAQLGELKTLGELTQIAWKHDVQTMIEGPGHVPMQLIKENMDLQLEWCDEAPFYTLGPLTTDIAPGYDHITSGIGAAMIGWFGTAMLCYVTPKEHLGLPNKDDVKTGIITYKLAAHAADLAKGHPGAQVRDNALSKARFEFRWEDQFNLGLDPDKAREFHDETLPKDSAKVAHFCSMCGPHFCSMKITQDVREFAAQQGVTDDEALKKGMEVKSIEFMKKGAEIYQRQ

SEQ ID NO: 13940 - protein, 451 aa, Glycine max
MATHAALASTRIPSNTRFPSKASHSFPTQCALKRLEVTEFSGLRSTSCVTYANSARESSFFDLVASQLTPKTNGSTPVRGETVAKLKVAINGFGRIGRNFLRCWHGRKDSPLEVVVVNDSGGVKNASHLLKYDSMLGTFKADVKILDNETITVDGKPIKVVSSRDPLKLPWAELGIDIVIEGTGVFVDGPGAGKHIQAGAKKVIITAPAKGADIPTYVVGVNEGDYTHQISNIISNASCTTNCLAPFVKILDEEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYSQRVVDLAHLVASKWPGAAKAGSGDPLEEFCETNPADEECKVYE

SEQ ID NO: 13941 - protein, 611 aa, Glycine max
  misc_feature (131)..(131): Xaa can be any naturally occurring amino acid
MLWSYASHYVPPQHRTNSFQTLTDDSTSRGGARPRDGGRGGSGSRGFSRPRIPSNRLPVEEPQDGSDAINFDAYESVPVEASGKDVPPPVNTFNEADLDEGLKRNIDRCKYVKPTPVQRHAIPIASAGRDXLMACAQTGSGKTAAFCFPIISGILKGRSLSGFSSMPARGAAVAYPTALILSPTRELSCQIRDEVNKYAHQTGVKVVVAYGGAPITQQLRLMEKGVDILVATPGRLVDIIERERVSLTKIKYLALDEADRMLDMGFEHQIRKIVEQMQMPSPGIRQTLLFSATFPNDIQKLASDFLSNYIFLSVGRVGSSTELIVQKIELVQDMDKRDHLINHLRRQKVHGANGKHALTLVFVETKRGADVLEGWLLRSGFSAVAIHGDKVQMERERALRSFKSGLTPILVATDVASRGLDIPHVAHVINFDLPRDIDNYVHRIGRTGRAGKSGLATAFFSDKNSPIAKALIGLLQEANQEVPSWLNQYATEGSSSGGGGRGYEAQRYRSGSYGGHDFRNVTEPEVQNYNCYNTNGNAVQFVESYTADDASYVDTSYDIQNSNIDCSFECLHIASSGSYNHTDSCELNGGGGRVEEDGPRGYASIVATGWD

SEQ ID NO: 13942 - protein, 246 aa, Streptococcus pneumoniae
YVAWEIEASDLAETVANIRRYQMFGINLSMPYKEQVIPYLDKLSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLYALENVSELQARIVESDLLVNATSVGMDGQSSPVPESINLPETILVADIIYQPFETPFLKWARSQGKPAVNGLGMLLYQAAEAFQLWTGKEMPTEEIWQSLTEKYQ

SEQ ID NO: 13943 - protein, 1163 aa, Sinorhizobium meliloti 1021
MPKRQDIKSILIIGAGPIVIGQACEFDYSGTQACKALKEEGYRVILVNSNPATIMTDPGLADATYVEPITPEVVAKIIAKERPDALLPTMGGQTALNTALSLRRMGVLDRYNVEMIGAKPEAIDKAEDRALFREAMAHIGLETPKSRLANATDIKDHDRKSHEAERSALKAKLSGDELDKALDELENQWNLGEGDRKQRYVNHAMAIAAQALDDVGLPAIIRPSFTLGGTGGGIAYNRSEFFEIVGSGLDASPTTEVLIEESVLGWKEYEMEVVRDKADNCIIICSIENIDPMGVHTGDSITVAPALTLTDKEYQIMRNASIAVLREIGVETGGSNVQFAVNPENGRLVVIEMNPRVSRSSALASKATGFPIAKIAAKLAVGYTLDELENDITGGATPASFEPSIDYVVTKIPRFAFEKFPGAEPTLTTAMKSVGEVMAIGRTFAESLQKALRGLETGLTGLDEIEVPDFDDNGDGRNAIRAALGTPTPDRLRMVAQALRLGMSEAEVHEACKIDPWFIAQFKAIVDMEARIREHGLPADAENLRMLKAMGFSDARLATLTGKRPKEVAELRNALNVRPVYKRIDTCAAEFASPTAYMYSTYETPFVGAARSEAQVSDRKKVVILGGGPNRIGQGIEFDYCCCHAAFALKDAGYEAIMINCNPETVSTDYDTSDRLYFEPLTAEDVIEIMRAEQENGTLHGVIVQFGGQTPLKLAEALEKNGIPILGTAPDAIDLAEDRDRFQKLLMKLDLNQPNNGIAYSVEQARLVAGEIGFPLVVRPSYVLGGRAMQIIHSESMLQSYLLDTVPGLVPEDIKQRYPNDKTGQINTLLGKNPLLFDSYLTNAIEVDVDCLCDGKDVFVSGIMEHIEEAGIHSGDSACSLPVHSLGTDMVDELERQTGALARALNVGGLMNVQFAIKDGTIYVLEVNPRASRTVPFVAKTIGAPIAKIAARVMAGEMLDEAIAAYGKKPNPRNLKHIAVKEAVFPFARFPGVDTLLGPEMRSTGEVIGLDTDYALAFAKSQLGAGVDLPRDGTVFVSVRDEDKERVLPAIRILSDIGFKVMATGGTARFLGEQGIVATKINKVLEGRPHVEDAIRNRQVQLVINTTDGNKAISDSKSLRRATLMQKVPYYTTMAGAEAAALAIKALKAGNLEVRPLQSYFET

SEQ ID NO: 13944 - protein, 612 aa, Candida glabrata CBS 138
MENKEHHHHHHHHHHHHSNGSYVSNKVSSLADGSRVGNYQIVKTLGEGSFGKVKLAYHVTTGQKVALKIINKKVLAKSDMQGRIEREISYLRLLRHPHIIKLYDVIKSKDEIIMVIEYAGNELFDYIVQRNKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGASDLIKRMLIVNPLNRISIHEIMQDEWFKVDLAEYLVPQDLKQQEQFNKKSGNEENVEEIDDEMVVTLSKTMGYDKDEIYEALESSEDTPAYNEIRNAYILIKDNKSLIKDMKQDNNVTQELDTFLSQSPPTFQQNGDGMKASEDQKKKHSGRRLASSVTQQRTFHQPPFMDQSKEEDSTISILPTSLPQIHRANMLAQGLPAASKISPLVTKKSKTRWHFGIRSRSYPLDVMGEIYIALKNLGAEWAKPSEEDLWTIRVRWKYDSDESRLIEDGVKKIPNLMKIVIQLFQIETNNYLVDFKFDGWESTYGDSTISTNMSEDEMSTFSAYPFLHLTTKLIMELAVNSQGN

SEQ ID NO: 13945 - protein, 449 aa, Mycobacterium avium 104
MVIIALVAAISGMLYGYDTGVISWALLQLTQDFNITEGWQQVIAASILLGAVAGALTCSWLSDLRGRRGTLLMLAVVFIVGALWCADAADSVMLSLGRLVLGFAVGGATQTAPMYVAELAPPAYRGRLVLCFQIAIGVGILTATLVGAGGSISWRGPIGLACVPAAIMLWLLLRLPESPRWLVKKDNRDAARAVLEHVRPEGYDVAAELDEATELARVERTAATRGWRGLRDAWVRPALVLGCGIAVFTQLSGIEMIIYYSPTILTDDGVYRSVALQVSVCLGAAYLIAQLVGLAIIDRVGRRRLTLIMVPGAAISLFALGLLFITSDSGRDVIPYIMICLIAFMLFNGGGLQLMGWLTGSETYPLAVRPAATALQSATLWGTNLVITLTMLSLIKAIGVGPSMWLYALFNVAAWIFVFFRMPDLTGKTLEEIEYQLSEGKFRPSDFGR

SEQ ID NO: 13946 - protein, 121 aa, Brassica napus
SRNPPPLSNNSTKKLQIMFCMKTTEKRRMILGGVHDLRGNQNSGEIESLARFAIQEHNNKENKVLEFKKIVKAREQVVAGTMYYLTLEANEGGQAKNFEAKVWVKPWMNFKQLQEFKESSS

SEQ ID NO: 13947 - protein, 444 aa, Mycobacterium avium 104
MAKLDRVPLPVEAARVAATGWQVTRSAARVLTKLPAKGPWQQKVIKQLPQTFADLGPTYVKFGQIIASSPGAFGESLSREFRGLLDRVPPADPDEVHKLFLEELGADPSELFASWDETPFASASIAQVHYATLHTGEEVVVKIQRPGIRRRVAADLQILKRFAQAVELAKLGRRLSAQDVVADFSDNLAEELNFRLEAQSMEAWVSHLHASPLGKNIRVPQVYWDFTTDRVLTMERVSGIRIDDVAAVRKAGFDGVELVKALLFSLFEGGLRHGLFHGDLHAGNLYVDEAGRIVFFDFGIMGRIDPRTRWLLRELVYALLVKKDHAAAGKIVVLMGAVGTVKPEAQAAKDLEKFATPLTMQTLGDMSYADIGRQLSALADAYDVKLPRELVLIGKQFLYVERYMKLLAPKWQMMSDPQLTGYFANFMVEVSREHSSEFESDVEV

SEQ ID NO: 13948 - protein, 409 aa, Thermus thermophilus HB8
MREEFLEEIPLDAPPEEAKELRTEVMTLNVGPQHPSTHGVLRLMVTLSGEEVLEVVPHIGYLHTGFEKTMEHRTYLQNITYTPRMDYLHSFAHDLAYALAVEKLLGAVVPPRAETIRVILNELSRLASHLVFLGTGLLDLGALTPFFYAFRERETILDLFEWVTGQRFHHNYIRIGGVKEDLPEEFVPELKKLLEVLPHRIDEYEALFAESPIFYERARGVGVIPPEVAIDLGLTGGSLRASGVNYDVRKAYPYSGYETYTFDVPLGERGDVFDRMLVRIREMRESVKIIKQALERLEPGPVRDPNPQITPPPRHLLETSMEAVIYHFKHYTEGFHPPKGEVYVPTESARGELGYYIVSDGGSMPYRVKVRAPSFVNLQSLPYACKGEQVPDMVAIIASLDPVMGDVDR

SEQ ID NO: 13949 - protein, 95 aa, Synechococcus sp. CC9311
MTADPLTPAVSERICRHMNDDHGDAVLQFALHYGGVSAANIATMTAVNADAMSLEVDGKPLRIPFDHTLTDSEDAHRTMVAMLRAMPSDGSKGES

SEQ ID NO: 13950 - protein, 359 aa, Pyrococcus furiosus DSM 3638
MKVVIVGNGPGGFELAKQLSQTYEVTVIDKEPVPYYSKPMLSHYIAGFIPRNRLFPYSLDWYRKRGIEIRLAEEAKLIDRGRKVVITEKGEVPYDTLVLATGARAREPQIKGKEYLLTLRTIFDADRIKESIENSGEAIIIGGGFIGLELAGNLAEAGYHVKLIHRGAMFLGLDEELSNMIKDMLEETGVKFFLNSELLEANEEGVLTNSGFIEGKVKICAIGIVPNVDLARRSGIHTGRGILIDDNFRTSAKDVYAIGDCAEYSGIIAGTAKAAMEQARVLADILKGEPRRYNFKFRSTVFKFGKLQIAIIGNTKGEGKWIEDNTKVFYENGKIIGAVVFNDIRKATKLEKEILDFYS

SEQ ID NO: 13951 - protein, 285 aa, Bacillus subtilis subsp. subtilis str. 168
MANQKKKTLPPQHQNQQPGFEYLMDPRPVFDKPKKAKKLEGKTAIITGGDSGIGRAVSVLFAKEGANVVIVYLNEHQDAEETKQYVEKEGVKCLLIAGDVGDEAFCNDVVGQASQVFPSIDILVNNAAEQHVQPSIEKITSHQLIRTFQTNIFSMFYLTKAVLPHLKKGSSIINTASITAYKGNKTLIDYSATKGAIVTFTRSLSQSLVQQGIRVNAVAPGPIWTPLIPASFAAKDVEVFGSDVPMERPGQPVEVAPSYLYLASDDSTYVTGQTIHVNGGTIVNG

SEQ ID NO: 13952 - protein, 250 aa, Streptomyces griseus subsp. griseus
MNPTYRTTSRGGSMQKRIVASEFLGTLLLVFFAVGSAVVAVEYLGTVGIALTFGFTLLALAYALGPISGCHVNPAVTLGMYMAGRIDIRSAVERWVSQFLGAIVGAALLFLLAKQIPGLETSGEFGTNGYDDRSAVGINIGGAFLAEVVLTFLLVYVVLAVTHKVAVTGFDGLPIGLALAAIHLVGIPLTGTSVNPARSFGPALFAGGAALSQLWLFIVAPLVGGAIAAYAHRLTHPYPNVLPAETEDAV

SEQ ID NO: 13953 - protein, 591 aa, Cicer arietinum
MSSTNDIGPLSLENFKNNLSASWRVVGLKTSNATYQISQPETHLREEKQKEKDGRSSVGLPQWTDSPVKLARRQLIEKRMANRAAELVKQDDEVIVKLEDSAIERSKSVDSAVLGKYNIWRKENENENADNTVRLMRDQIIMARVYLSIAKMKNKLQLYQELQSQLKESQRALGEATSDADLHHNEHEKIKAMGQVLSKAKDQLYDCKLVTGKLRAMLQTSDEQVRGLKKQSTFLSQLAAKTIPNGIHCLSMRLTIDYYLLPPEKRKFPRTENLVNPNLYHYALFSDNVLAASVVVNSTVVNAKDPSKHVFHLVTDKLNFGAMNMWFLLNPPGKATIYVENVDEFKWLNSSYCPVLRQLESATMKEYYFKAGHPTTTGASNLKYRNPKYLSMLNHLRFYLPQVYPKLDKILFLDDDIVVQKDLTGLWDVDLHGKVNGAVETCGESFHRFDKYLNFSNPHIAKNFDPNACGWAYGMNMFDLKVWKKKDITGIYHRWQNLNEDRVLWKLGTLPPGLMTFYGLTHPLNKSWHVLGLGYSPSVDRSEIENAAVVHYNGNMKPWLEIAMTKYRPYWSKYVKYNHPYLRNCKLSEWS

SEQ ID NO: 13954 - protein, 299 aa, Bacillus subtilis subsp. subtilis str. 168
MSDSNLTNPIKAFFHDEFPEQYQEPPGLQKNMKPVPDCGEKSYKGSGKLTGRKALVTGGDSGIGRAAAIAYAREGADVAINYLPEEQPDAEEVKELIEAEGRKAVLIPGDLSDESFCQDLVKQSHHELGGLDVLALVAGKQQAVENIEDLPTEQIYKTFEVNVFSLYWVVKAALPYLPEGASIITTTSVEGYNPSPMLLDYAATKNAIIGFTVGLGKQLASKGIRVNSVAPGPIWTPLQISGGQPTENIPKFGQGTPPAPLNRAGQPVELADVYVFLASENSSYVTSQVYGITGGIPTA

SEQ ID NO: 13955 - protein, 598 aa, Oryza sativa (japonica cultivar-group)
MLVLASFLLLLCHHAHADCEPATCGNLTINPPFWLDEPGRPPCGPPTFQLQCRGSEAFVAHSFFQTYQVVRIFTGNSSVVVVDRSLPLESGCPVPWFNISIGFVMGPFLISRANKELVFVHNCTTTKRRPPQGFRRMPCSPDESFVFLGDGRPRLLLPGCSMSVVPVLGLQDGDYVASMRRGLLLEWMLVPGDCQKCSASGGQCEYSSDGMGFSCKCPSGVHNPTSCVAGDSKSNGRKKTLIVLIPVAVSLLFPCAYVLIWHRKGQILCYLLCNKTRSRNESNIQKLIVSYGSLAPKRYKYSEVAKITSFLSNKLGEGGYGVVFKGKLQDGRLVAVKFLHDSKGNGEEFVNEVMSIGRTSHVNIVSLFGFCLEGSKRALIYDYMPNSSLDNYIYSEKPKETLGWEKLYDIAIGIARGLEYLHHGCNTRIVHFDIKPQNILLDQDFCPKIADFGLAKLCCTKESKLSMTGARGTIGFIAPEVLYRSFGVVSIKSDVYSYGMMLLEMIGGRKNVKSMVQNSSEKYFPDWIYDHFYQGDGLQACEVTSEVEEIAKKMTLIGLWCVQVLPMHRPTITQVLDMFEKALDELDMPPKQSFCESL

SEQ ID NO: 13956 - protein, 280 aa, Aspergillus oryzae
MANGADLRTLVSELHNALNRKQFDAANDLLSRAKRTLLLQNALIPTSSTSPELIALAREVLELGALSSIRQTDAPSFTRYYQQLQPFYDLERDSANAGKVDFKTSQRSKITGLYLLLLLSMGDSTSFHTVLEGLVEEASLKGKSIEDDPCIKYPVELERNLMEGSYDKVWRETKSERVPSEDFGLFSNVLVGTIRSEIADCSEKAYPSLPISNAKNLLFLESEGAVIEFAQQRGWVLRDGRIYFPVEPEAAARSEKDILVASTAIIENAIGYARELETIV

SEQ ID NO: 13957 - protein, 165 aa, Oryza sativa
MGSSDFSWTLPDHPKLPKGKPVAVVVLDGWGEADADQYNCIHVAETPTMDSLKKGAPEKWKLVKAHGTAVGLPSDDDMGNSEVGHNALGAGRIFAQGAKLVDTALASGKIFEGEGFKYIKESFDQGTLHLIGLLSDGGVHSRLDQLQLLLNGASANGAKNRVHFL

SEQ ID NO: 13958 - protein, 498 aa, Aspergillus oryzae
MASSFASILKDASLFVERSYVNGQWVSSNSNATFNVTNPANEAQVGVAPESTLDDLNVAIEAAADAFPTWRSVPGRQRGRILRRIADLLVENKEDIGKIITAENGKAKGDAEGEVMFAASFFEWFGEEASRIYGDIIPHSSAAGRTRVIKEPVGVCGLIVPWNFPLAMGARKVAAALAAGCTVVMKSDGLTPFASNAMAVVAERAGVPKGVFNVVTALNNTPQLGLAMCESDIIKKISFTGSTRVGKLLMKQSSSTLKKLSLELGGNAPFIVFNDADIETAITSALISKFKVTGQTCVCANRFYVQEGIYDRFAQRLVEEVSKFKVGNGLEDPSVTHGPLTNGVAKVEEHIKDAVSKGAKVLLGGNRLPALGKNYHELTILGDANDSMLVSKEETFGPVAALMKFKTEDEVVQRANNCEVGLASYLITSNLGTSHRVSERLEFGMVAINTGVISDAPAPFGGVKHSGMGREGSKYGVDDYMTIKMITTGGINTVYTRL

SEQ ID NO: 13959 - protein, 531 aa, Oryza sativa (japonica cultivar-group)
MGCCGSSLQAGTHPEKPPGMAAPPQRPSFSLNQHQAPGSAAAQGVGRGEVPAFAEFSLAELRAATGGFAAENIVSESGEKAPNFVYRGRLQRTRRAIAVKKFPKMAWPDPKQFEEEAKGVGKLRHRRLANLIGYCCDGDERLLVAEFMPNDTLAKHVFHWENQTIEWAMRLRVAHHIAEALDYCSSNERPLYHDLNAYRVLFDENGDPRLSCFGLMKNSRDGKSYSTNLAYTPPEYLRNGRVTPESVIFSFGTVLLDLLSGKRIPPSHALDMIRGKNIQVLLDSHLEGKYSTEEATALVDLASQCLQYEPRDRPNTGKLVSILDPLQTKLEVPSYEMLGIPKHEEEAPPAPAPAPAPQPQHPLSPMGEACSRMDMTAIHQILVATHYRDDEGTNELSFQEWTQQMRDMLDARKRGDFAFRDKDFKTAIECYTQFVDVGTMVSPTVYARRSLCHLMSDQPDAALRDAMQAQCVYPDWPTAFYMQAVALSKLNMQSDAMDMLNEASQLEEKRQERLWSKDASAQSPLRLKGLC

SEQ ID NO: 13960 - protein, 788 aa, Mycobacterium avium 104
MATDRIANPWGTRTPYAPGTRWPERIDTYLADGVTAESVDRWVQSAAVLHSNGDGLDIAVKDGRIVGVRGRAVDRVNHGRLDPKDLFGWQANASADRLTTPLLRVRGALRPCDWDTAMERIVARSRELLDRHGPSSIGFYTSGQLFAEEYYTQAAIAHGAIGTNHVDGNTRLCTATAAEALKESFGCDGQPGSYTDVDHADVIALFGHNVAETQTVLWARMLDRLAGSDPPAIVCVDPRLTPVARHATVHLAPLPGTNVALMNGLLHEIIGNGWIDRDYIDAHSVGFDELQCRVSEFTPEWVAEICGVAATDLRRAARLIGTAQRLLSTVLQGFYQSHQATAAAVQVNNIHLVRGMLGRPGCGVLQMNGQPTAENTRECGADGDLAGFRNWSNDSHVAELADLWNLEPLQIPHYGPPTHAMQMFRFAEEGTLRMLWVTATNPAVSLPELPRIRDILSQQRLFLVVQDIFLTETAALADVVLPAAAWAEKTGTFTNADRTVHLSEKAVEPPGSARSDLEIFLDYARRMDFRDKDGRPFPPWTDPESAFEAWKKCSAGRPCDYTGLSYAKLRGGSGIQWPCNTDHPDGIERLYEDGRFPAAPDYCEAYGKDLITGAPLQPDEYRSLNPSGKAIIKAAQYLPPHERPGPDYPFALITGRTIYHFHTRTKTARAQQLQDAAPEVWVEVSERDARRLGIEAGDLVHVSTPRGRITCAARVGGIRDGVLFVPFHYGYWDRDGGDHQRAGNELTATDWDPASKQPSFKTAAARLDMAPTHTAAPVSEAVAAGSPS

SEQ ID NO: 13961 - protein, 254 aa, Oryza sativa (japonica cultivar-group)
MESTEPLQDIMCEFRAGKMSLDGTRVIPDTRKGLVRIGRDQIVFPEEAVFEKVTQSSGRVYILKFRHDSRKFFFWMQEPSADDDSQICRQVNAYINRPLDGEAVSIEAEMSHEDTADDDISSRAGNLVDQSMTADLAGEVTSAAGPVRLEDLQRILSAIQPSDAVADPDAGLGLGDILKPDLVLPLMETLPIEQLASYLPEGPWTAGDILELLQSPPLRQQVEAFTHVLRTGQIDLAQFGVDPSKCNPSHLHLY

SEQ ID NO: 13962 - protein, 377 aa, Coccidioides immitis RS
MAAHRLFRPASRLLSSRLCSAPLRSTFQPTVCTQSLHQKRTYADATGVKEVAVRDALNEALAEELASNDKVFILGEEVAQYNGAYKVTKGLLDRFGDKRVIDTPITEAGFAGLAVGAALAGLHPVCEFMTFNFAMQAIDQIINSAAKTHYMSGGIQPCNITFRGPNGFAAGVAAQHSQDYAAWYGSIPGLKVLAPWSSEDAKGLLKAAIRDPNPVVFLENELMYGQVFPMSEAAQKDDFVLPIGKAKIERPGKDLTIVTLSRCVGLSLNVASQLKSKYGVEAEVINLRSVKPLDIETVIKSVKKTGHLMAVESGFPMFGVASEILALTMEYGFDYLQAPAIRVTGAEVPTPYALKLEEMSFPQEDTILSQAAKLLRV

SEQ ID NO: 13963 - protein, 303 aa, Synechococcus sp. CC9311
MVTSTPADASTQRELRIRAAVMAPRQMLPSHQRRLKGGTTSFMVVIHVLATVALLPRFWSWQGLVAFGVLYWTTVLGVTLGLHRLVAHRSFEVPGWLERVLVVMGTLACQSGPIDWVALHRHHHRFSDQPNDHHDAGRGLWWSHSEWMLHDIPALKEKHRYAGDLLSDRFYVWLDRWFLVLQIPLGLALYWYGETAGVHGGGVGLVLWAIPLRLAVVYHVTWLVNSATHAFGYRNFNSPDLSRNCWWVAVLSFGEGWHNNHHAYPNSARHGLRWFEFDITWMHIRLLRRLGLTRKVRQARYIG

SEQ ID NO: 13964 - protein, 83 aa, Triticum aestivum
MAENFQLQGRHGKSRVRVSRVWRRPAAAGGHVIVEWNVAVSIVSDCLPSYTSSDNSAIVATDSIKNTVYVKAKECTEVVSMEE

SEQ ID NO: 13965 - protein, 355 aa, Shigella flexneri 2a str. 2457T
MSQKYLFIDRDGTLISEPPSDFQVDRFDKLAFEPGVIPELLKLQKAGYKLVMITNQDGLGTQSFPQADFDGPHNLMMQIFTSQGVQFDEVLICPHLPADECDCRKPKVKLVEGYLAEQAMDRANSYVIGDRATDIQLAENMGINGLRYDRETLNWPMIGEQLTKRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 13966 - protein, 396 aa, Streptomyces avermitilis MA-4680
MSTKDFIEKDYYKVLGVPKDATEAEIKKAYRKLAREFHPDANKGNAKAEERFKEISEANDILGDTKKRKEYDEARTLFGNGGFRPGPGAQGGSFNFDLGDLFGGGAQQGGGAGGGFGGGIGDVFGGLFNRGGAGPGTGTRTQPRRGQDIESEVTLSFTEAVDGATVPLRMSSQAPCKACSGTGDANGTPRVCPTCVGTGQVARGSGGGFSLTDPCPDCKGRGLIAENPCEICKGSGRAKSSRTMQVRIPAGVSDSQRIRLRGKGAPGERGGPAGDLYVVVHVDAHPVFGRKGDNLTVTVPVTFAEAALGGEVKVPTLGGPAVTLKLPPGTPNGRTMRARGKGAVRKDGTRGDLLVTVEVTVPKDVSGKARDALEAYREATAGEDPRAELFQAAKGA

SEQ ID NO: 13967 - protein, 451 aa, Pseudomonas putida GB-1
MAYDFDLFVIGAGSGGVRAARFAAGFGAKVAVAESRYLGGTCVNVGCVPKKLLVYGAHVADELEQAAGFGWTLEEGHFDWGTLIANKNREIERLNGIYRNLLVNSGVTLLQGHARLTGANEVEVDGQRYSAEHILIATGGWPQVPDIPGKELAITSNEAFYLKDLPRRVLVVGGGYIAVEFAGIFQGLGANTTLLYRGDLFLRGFDGSVRTHLKEELEKRGLDLQFNADIQRIDKLEDGSLKATLKDGRELVADCVFYATGRRPMLDNLGLENTGVELDARGYIRVDEQFQTTAPSILAIGDVIGRVQLTPVALAEGMAVARRLFKPEQYRPVDYQNIPTAVFSQPPIGTVGLTEEQALAAGHKVQVFESRFRAMKLTLTDIQEETLMKLVVDAETDKVLGCHMVGPDAGEIIQGLGIALKAGATKQQFDETIGVHPTAAEEFVTMRTVTR

SEQ ID NO: 13968 - protein, 388 aa, Triticum aestivum
  misc_feature (66)..(66): Xaa can be any naturally occurring amino acid
MAITTASASPAMQEAAKTPSASPPRATAASPARYRPSPLVIFSACLVLIGSSGPLLLRVYFVHGGXRLWLSALVQISGWPLLLPPLCVSIFRGRRHGIVNLLLPPRLVGAAVVLGSLYAVSCFVYAMGSQALPLSTSSLLLATQLAFTAVFAFLFVGLRFTPFSANAVLLLTIGPAVLGVGPGSGKPAGEPSKTYWTGFGEAIAAAALAGLVLPLVEVAMERFGRRRGPAASAPPPYSTVMQMQAMMGLAGTMVCLLGMAIKSDFNALPIEAAAFGLGETKYYLVLVWGAVAWQLLNLGVVGLVTCASSLLAGIMVAVLLPLSEVLAVIFLHEKFDGPKGIALVLCLWGFASYMYGEKVQQKKAAAQKNQLLQQQMARKTGDLELANP

SEQ ID NO: 13969 - protein, 227 aa, Candidatus Kuenenia stuttgartiensis
MKKSLTREEMRELDRKAIEEYKIPGILLMENAGRNVAEEVVRETDDLQREKIAIVCGKGNNGGDGFVTARHLSNKGIPVEVFIFAKTTDIPKESDAGINLRILMNMKIPVKEYIDLQAVNDALGNLKHFTILIDALFGTGLSGEVREPFTTLIRGINTLKKKIIAVDIPSGLNCDTGNVLGAAIKAGKTVTFAACKKGFYLGEGPNHTGEVVVTDISIPGELLRQMC

SEQ ID NO: 13970 - protein, 465 aa, Klebsiella pneumoniae
MHDKYDVLIIGGGPGGYVAAIRAGQLGLRTVLVEKQHLGGICLNWGCIPTKALLHGAEVAHTITHASQLGISVGEVNVDLQKLVQFSRTVSQQLTAGVAYLLKKNGVRVIDGTARLRGKGQITVEDARGEARDYRADHVILATGARPRALPGIAPDGEHIWTYFEALRPKLLPKSLLIIGSGAIGVEFASLYNDLGCKVTLVELASQILPVEDAEVSAAVRKSFEKRGIQIHTQTLVTQVQLTDTGVRCTLNNTGGEYSQDVERVLLAVGVQPNIEDLGLETLGVELDRGFIKTDAACRTNVFGLYAIGDVAGPPCLAHKASHEGVLCVETLAGVEGAHPLDRDYVPGCTYARPQVASLGLTESTALARGRPIRIGKFSYQSNGKALVSGETEGFVKTIFDAETGELLGAHMVGAQVTEQIQGFGIARHLEATDESLLSMIFAHPTLSEAMHESILAACDQPLHQ

SEQ ID NO: 13971 - protein, 417 aa, Haemophilus somnus 129PT
MDFFLYKDGHLMAENVSVKKIAEQFGTPAYIYSRATLERHWYAFDNALGDHPHLICFAVKSNPNIAILNIMAKLGSGFDIVSQGELERVLFAGGDPKKVVFSGVAKSEQEIARALEVGIRCFNVESAAELIRINQVARKMGKIASISLRVNPDVDAHTHPYISTGLKENKFGVSVEQAREVYRQASQLENIKIVGIDCHIGSQLTELQPFLDATDRLIVLMEQLKKDGITLEHVDLGGGLGVTYSDEKAPHPSEYATALLEKLKNYQNLEIILEPGRAITANAGILLTRVEYIKSNESRHFAIVDTGMNDMIRPALYQAYMNIIEVDRTLSRETKVYDVVGPICETSDFLGKQRSLAIAQGDFIVQRSAGAYGASMASTYNSRPRAIEIMVDGEQVHLIKRREEFAELWHLEKLLEM

SEQ ID NO: 13972 - protein, 800 aa, Aspergillus oryzae
MFMIRNVSKFLFGDTSKESIIEIPQGELYLVRPLSPKGYSELIFKDAAASIRRTGQEYQYQLVIQRAYEEGEEELSADEDEQGGADNLDKDEKIFLLDEALHFRTEVREGGAKVLAWRDLSGDIGDLYEFVCDPSVPSDKIPTFELAAFQCQYERKYRQSAQKATEQDLQQFSYQEEKPIPSASPNASPTKSRAHSLTSGDSAAAMAKDVEYQKSKGHIKPADNGEESTVAPPSAEQPEAKEILAKEKAELHMFDFPSGTFVIQDADVTATVSEIGNWQYWLQISGNEKEWLGQAVVADINPVFNFEYLSFIFNHYTEDGSAYSWLLRFKDQETEERFQEGLMQALWEQLNEMKWVKVKEDDREYVLDAFQDLTMEDAADNREEEEEEEEEEEDEDQHDGQRSEHYDSDEEEDDVVTRDDDGNVNSQLAVGYKHDRSFVVRGSKIGVFKHTADNNLEFSTTISKVETPNGKLFSPKKVMLHAEDSNMILQNSENPNSLYRMDLEYGKIVDEWNVHDDIPVNTFAPETKFSQMTNAQTFVGASHNALYRIDPRLAGSKLVDADLKQYASKNDFSSVATTEKGYIAVASNKGDIRMFDRLGINAKTHIPALGEPIIGLDVSADGRWVLATCRTYLLLIDSLQKEGKNEGKLGFERSFGKDSKPQPRRLGLQPAHVAQFQHETKKPLAFTPARFNTGVDSQETSIITATGPFIVTWSMKKVLAGRKDPYTIKRYSEEVMADNFRFGSDKNVIVALPNEVNMVAKRALQKPTRESIAGPPVTPSRRSTRWGSRLGRDDIVNSPY

SEQ ID NO: 13973 - protein, 346 aa, Bacillus clausii KSM-K16
MRASVLKALKTIELEERTKPKPGAGEVLIQMKAVGICGSDLHYYEHGRIGERVAKPPFVLGHECAGVVTKVGPEVADLNVGDHVVIEPGLPCGECSSCRVGHYNLCPKVLFLSSPPNDGVLMEYICHPAKFTYKMPEGLSFELASLAEPLSVGLYTAQKTSIQPGSNIVIMGMGPVGLCMILAAKWYGASNIVVTDIEPYRLEIAKKIGAMDTIQVNHEADRAGLLAEADRLGGFDMVIDTSGAEAAFDMAVNLLKRGGTIGGIGFPGGAKSTIPLLKMMQREIVYQPIYRYRHTFKHALALLEKEQEAAQLLLTDFFPMSQISAAFDYAASNKDKSIKVIIHPDK

SEQ ID NO: 13974 - protein, 1164 aa, Arabidopsis thaliana
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQFICLVGSTLRAPHGCHAQYMTNMGSIASLAMAVIINGNEEDGNGVNTGGRNSMRLWGLVVCHHTSARCIPFPLRYACEFFMQAFGLQLNMELQLALQVSEKRVLRMQTLLCDMLLRDSPAGIVTQRPSIMDLVKCNGAAFLYQGKYYPLGVTPTDSQINDIVEWLVANHSDSTGLSTDSLGDAGYPRAAALGDAVCGMAVACITKRDFLFWFRSHTEKEIKWGGAKHHPEDKDDGQRMNPRSSFQTFLEVVKSRCQPWETAEMDAIHSLQLILRDSFKESEAMDSKAAAAGAVQPHGDDMVQQGMQEIGAVAREMVRLIETATVPIFAVDIDGCINGWNAKIAELTGLSVEDAMGKSLVRELIYKEYKETVDRLLSCALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSIDGKIIGAFCFLQIPSPELQQALEVQRRQESEYFSRRKELAYIFQVIKNPLSGLRFTNSLLEDMDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 13975 - protein, 461 aa, Aspergillus oryzae
MASHMPPATGAGASAPRKVEEITQMAQNYDYNPSIPLRYWLRTAATLLREARIYEREGHDEQAYFLLFRHAQLVLVNLAKHSEAKDEQNRKALMEAEKEVSRNLEKLEILRPRINKRHKRYTELMNDRQARSPPLGTNHTAPNQQQPQDPALVGVAEPLEAGENRDLAVKLARTEIHRRATARKAVRQAGITPQEEQRRRTAGIWGDWENALDKNGPETDNDLSRRIQNISTPLTSAAQTQAPAPPAKVKPVADGGDGRSNLDPSSFTFKPSAYLENGTPLRTVFLPPELRSTFLSLAASNTRRNLETCGILCGTLISNALFISRLLIPEQTSTSDTCETVNETAIFEYCDSEDLMILGWIHTHPTQTCFMSSRDLHTHSGYQVMLPESIAIVCAPSKTPDWGVFRLTDPPGLKTVLNCTQPGLFHPHAETNTYTDALRPGHVFEAKGLEFETVDLRPNGS

SEQ ID NO: 13976 - protein, 337 aa, Shewanella sp. ANA-3
MAIKIGINGFGRMGRLALRAAWEWDDVEFVQINDPAGDAATLAHLLEFDSVHGRWRYPVTANQDGIQIQDKTIRTTRNKTIAETDWSGCDVVIEASGVMKTKALLQAYLDQGVKRVVVTAPVKEEGVLNVVMGVNHQLYDPAIHPIVTAASCTTNCLAPVVKVIHEQIGIKHGSMTTIHDITNTQTILDAPHKDLRRARACGLSLIPTTTGSATAITHIFPELKGKLNGHAVRVPLANASLTDCVFELERSVTEAEVNMLLQTAAEGELKGILGYEERPLVSVDYKTDPRSSIVDALSTMVVNGTQLKLYVWYDNEWGYANRTAELARLVGQLDLPR

SEQ ID NO: 13977 - protein, 195 aa, Oryza sativa (japonica cultivar-group)
MSKLCQSACKAAKSLLSATAAASSQRTSLLAVYMLQDQEAHAAEMERTFIAIKPDGVQRGLISEILSRFERKGFKLVAIKLVVPSKEFAQKHYHDLKDRPFFNGLCDFLSSGPVLAMVWEGEGVIKYGRKLIGATDPQKSEPGTIRGDLAVVVGRNIIHGSDGPETAKAEIGLWFEPRELVSYTSNEEKWIYGVN

SEQ ID NO: 13978 - protein, 317 aa, Glycine max
MGHSAAVWDYRAATEITKDWNGIHQIVLRTPRGASAQVCLHGAQVTSWRNEHGEELLFTSSKAIFKAPKAIRGGIPICFPQFGNCGSLELHGFARNRMWAIDDNPPPLPANDSSGKSFIDLVLKSSEEDMKGWPYSFEFHLRVSLTTDGDLTLISRVRNINGKPFSFSFAYHTYLLVSDISEIRIEGLETLDYLDNLFQKERFTEQGDAITFESEVDRVYLSSPNIIAVLDHERKRTFVIRKDGLPDVAVWNPWEKKSKSMSDFGDEEYKQMLCVDGAVIEKPVNLKPGEEWTGRLQLSIVPSSFCSDHLGLDRSDL

SEQ ID NO: 13979 - protein, 78 aa, Arabidopsis thaliana
  misc_feature (17)..(17): Xaa can be any naturally occurring amino acid
  misc_feature (29)..(29): Xaa can be any naturally occurring amino acid
MASFMLFSAAVGTFPGXNTMGALYTGLKXTLFFPDHPRPNNIIFITRNGGRGICLKELPPLLKKKIETLFYLPDLTDD

SEQ ID NO: 13980 - protein, 789 aa, Shewanella sp. ANA-3
MQQYVLWYQELGMGDVNLVGGKNASLGEMISNLANAGVQVPGGFATTSYAFNEFLEQSGVNQKIYDILATLDVDDVNALAQVGAQIRQWVIDTPFQPALEQAIREAYDKLAAETSDASFAVRSSATAEDMPDASFAGQQETFLNVKGFDSVLVAIKHVFASLFNDRAISYRVHQGYEHHGVALSAGVQRMVRSDKAASGVMFTMDTESGNNDVVFITSSFGLGEMVVQGAVNPDEFYVHKPILTQGHKAVVRRNIGSKLIQMVYSDDASHGKQVKIEDVAAEKRRQFSINDAEVMELAKQAMVIEKHYGRPMDIEWAKDGNDGKLYIVQARPETVRSREDVQLIERYHLKSRGAVISEGRAIGHKVGSGVAKVLTSIADMDQIQPGDVLVTDMTDPDWEPIMKRASAIVTNRGGRTCHAAIIARELGVPAVVGCGDVTDRIKNGQLVTVSCAEGDTGYIYEGKQEFEVVSNRVDALPALPMKIMMNVGNPDRAFDFARLPNEGVGLARLEFIINRMIGIHPKALLEFNQQDAALQEEINEMIAGYDSPVEFYIARLVEGIASIGSAFYPKKVIVRMSDFKSNEYANLVGGDRYEPEEENPMLGFRGASRYISESFRDCFALECEAIKRVRNEMGLKNVEVMIPFVRTVKEAEQVIELLKEQGLERGKDGLRVIMMCEVPSNALLADQFLEHFDGFSIGSNDLTQLSLGLDRDSGIISHLFDERNEAVKILLSMAIKAAKAKGAYIGICGQGPSDHADFAAWLVEQGIDTVSLNPDTVIDTWLYLAEAHG

SEQ ID NO: 13981 - protein, 548 aa, Wolbachia endosymbiont of Drosophila ananassae
MEQFENFYITTPVYYVNDKPHIGHAYTSLLCDVVARFMKLAGKNVKFTTGTDEHGQKIEKAAKAKEMQPKEFTDDVSVSFKELAKFMNFEYDDFIRTTEERHKKAVIALWNRLEERGQIYLDSYSGWYSVRDEAFYQESELIDGKAPTGAEVQWIKEESYFFRLSNWQDKLLELYKNQPSFIFPESRRNEVISFVRSGLIDLSISRTSFNWGIKVPGNDKHVIYVWIDALTNYLTSIGFPSTEGEEYKRFWAEPETQIPVSSTGMTPNQGKTQIPVSSTGMTPNLADNSFNVHVIGKDILRFHAVYWPAILLAADLPLPKQIAVHGWWLNEGEKISKSLGNVIDPIGLAQEFGVDQLRYFLLREASFGQDGNFSKKNMISRINSELANNIGNLVQRTISFLHKQCSGIVPTIDQILLKGEESLPGCKAILDQVMNHLSKYEFNHIILLIINISSEANAYIDKSAPWTLSKTDRERVNLVIYKLLEYIRIIGILLQPIVPKSAEMILNQLQIPKEQRDLKSLCNACVSLGITLPKPTPVFLRVDAKEEK

SEQ ID NO: 13982 - protein, 201 aa, Photorhabdus luminescens subsp. laumondii TTO1
MLTAQQIEKLDWEKVAYMMPVIVQHAISGDVLMMGYMNKEALNITISSGKITFFSRSKQRLWTKGESSGHFLNLVNIYPDCDNDTLLALADPIGPTCHFGTHSCFAPAQTEWGFLYQLEKLLASRKTADPDHSYTAKLYASGTKRIAQKVGEEGLETALAAAVNNREELTNEAADLMYHLMVLLQDQELDLSCVIRRLRER

SEQ ID NO: 13983 - protein, 355 aa, Photorhabdus luminescens subsp. laumondii TTO1
MNQKLLFIDRDGTLITEPPTDFQVDRLDKLALETEVIPALLALQKSGFRLIMITNQDGLGTDSFPLEQFEPPHNLMMQIFSSQGIHFDEVLICPHKPEENCHCRKPKIKLVEKYLTEGLMDTANSYVIGDRETDLQLAKNMGIQGLHYHPKNLGWFAICEQLTRQDRHAHVQRITKETSINIDVWLDHEGSSDINTGVGFFDHMLDQIATHGGFRMHVQVKGDLCIDDHHTVEDTGLALGEALKLALGDKRGICRFGFVLPMDECLARCALDISGRPHLEYKAEFKHQRVGDLSTEMIEHFFRSLSYAMACTLHLKTKGSNDHHRAESLFKAFGRTLRQAIRVEGDTLPSSKGVL

SEQ ID NO: 13984 - protein, 344 aa, Shewanella sp. ANA-3
MAVFNHVSFDEHEQVVFCHDKESGLKAIVAIHNTNLGPAVGGCRMWNYQSDDEALTDVLRLSRGMTYKNALAGLTMGGGKSVIIADPKRPDREALFRAFGRFINSLGGRYYSAEDVGTTTADIMIAHQETPYMAGLEGKSGDPSPFTALGTYLGIKAAVKHKLGLDSLKGLKIAVQGVGHVGYYLCKHLHEEGAELIVTDIHQASLDKVATDFGAIVVAPQDIYAQDVDVYAPCALGATLNDVTLPQLKAKIVAGCANNQLAEVRHGEQLKEMGILYAPDYVINAGGIINVSFEKDYDAAKSEAKVREIYNTLLKIFTKADAENRTTAAVADEMARAIYQAAKA

SEQ ID NO: 13985 - protein, 651 aa, Thermus thermophilus HB8
MKETRDLETLSVNAIRFLAIDAVEKARSGHPGMPMGMAPLAYLLFREVMRHNPLDPDWPDRDRFVLSAGHGSMLLYAVLHLTGYDLPLEELKSFRQWGSKTPGHPERGHTPGVEVTTGPLGQGISTAVGLALAERKLAAEFNRPGHVVVDHYTYVLASDGDLMEGVSGEAASLAGHWGLSKLIVFWDDNRISIDGPTDLAFTEDVLARYRAYGWQTLRVEDVNDLEALRKAIKLAKLDERPTLIAVRSHIGFGSPKQDSAKAHGEPLGPEAVEATRRNLGWPYPPFVVPEEVYRHMDMREKGRAWQEAWEKALEAYARAYPDLHQELMRRLRGELPPLPEEPPSFDKPIATRAASGRALNLLAPRLPELLGGSADLTPSNNTKAEGMEDFSRANPLGRYLHFGVREHAMGAILNGLNLHGGYRAYGGTFLVFSDYMRPAIRLAALMGVPTVFVFTHDSIALGEDGPTHQPVEHLMSLRAMPNLFVIRPADAYETFYAWLVALRRKEGPTALVLTRQAVPLLSPEKARGLLRGGYVLEDVEEPQGVLVATGSEVHLALRAQALLREKGVRVRVVSLPSFELFAAQPEAYRKEVLPPGLPVVAVEAGASLGWERYAHKVVALDRFGASAPYPEVYERLGFTPERVAEAFLSLV

SEQ ID NO: 13986 - protein, 451 aa, Pseudomonas fluorescens PfO-1
MSSASSSSTVHPVDRVLPVRQMLTLGLQHMAVSYIGAIAVPLIVASALKMSHADTVVLISTTLFCSGIATLLQTVGFWRFGVRLPILQGVAFSSVGPVIAIGSNPEVGFAGVCGAVIGAGIFTMLIAPFVGRLRRFFPPVVTGCIVTVIGLQLFPIAYEWVGGGRNASNFGAPAFLAVAVVVLLTILLVNRYGSPLLRNMAVLVGMLVGAGLAYGLGMGNFHSVEDAPWLTVPYPFYFGLPTFSLIPIATMVVVMIVQMVESMGLFVAIGDIVDKPVEDKQVINGLRANGLASTIAGMFAAFPFIAFMENVGLVILTGVRSRWVVAISGLLMCSIALVPKAGAIIASMPTAALGGAGIAMFGVVAAAGIQTLAKVDYERNRYNVLIVGFTIAAALVPVLAPTLFKQLPEWSQPFLHSSVVIACLVSVLLNAALNGVSMPETTAGKSASHIL

SEQ ID NO: 13987 - protein, 506 aa, Brucella melitensis 16M
MVMSTIVKPQPLTGLEVREFSMLIDGKWVGSDSGKSIERVAPGHGVTVSRYPAGNKANVERAVSAARKAFDDGRWSSKTASQRSLVLLKAADLIEARAEELAYLDAIEAGKPISQVRGEISGSVDIWRYAAALARDLHGESYNTLGDGTLGVVLREAIGVVSIITPWNFPFLIVGQKLPFALAAGCTAVVKPSELTSGSTLLLGEILAEAGVPDGVVNIVTGTGADVGQHMSTHPHVDMVSFTGSTGVGKLTMANAAQTLKKVSLELGGKNPQILFPDADMDAFIDAAVFGAWFNAGECCNAGSRLIVHRSVVDAIVGRVADLSKKVIVGDPLDASTQVGAIITPQHLTKVGAYVDQARKAGAAIAHGGEVLDLGLGQYMGPTILAGVKADMAVAREEVFGPVLSVLSFDTVEEAISIANAVDYGLSAGVWSRDFDTCMTIGRKVRAGTVWMNTFMDGTPELPFGGYRQSGLGRELGRHAVEDYTETKTLNMHIGARTGWWMPQAK

SEQ ID NO: 13988 - protein, 466 aa, Yersinia pestis KIM
MMSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKVTK

SEQ ID NO: 13989 - protein, 131 aa, Bacteroides fragilis YCH46
MNVILFDGICNLCNGAVTFVVKRDRKGLFRFVSLQSETGKSLLKRYAVESTNKTLYYFRNNRCYSKSTAILYILKDLGGFWQCLYPLILIPAKLRDAIYLLVSKYRYRIFGKADSCIKPFGFSSEESKRSD

SEQ ID NO: 13990 - protein, 516 aa, Sinorhizobium meliloti 1021
MRDTSPFYITTAISYPNGKPHIGHAYELIATDAMARFQRLDGREVFFLTGTDEHGQKMQQTAKKEGISPQELAARNSAEFQNMARLLNASNDDFIRTTEQRHHEASQAIWMRMGEAGDLYKDSYAGWYSVRDEAYYQENETELRGDGVRYGPQGTPVEWVEEESYFFRLSAYQDKLLKHYEENPDFIGPAERRNEVISFVKSGLKDLSVSRTTFDWGIKVPNDPSHVMYVWVDALTNYVTATGCLTDPTGPRAKFWPANIHVIGKDIIRFHAVYWPAFLMSAGLPLPKRVFAHGFLLNKGEKMSKSLGNVVDPFNLVEHFGLDQIRYFFLREVSFGQDGSYSEEGIATRINSDLANGIGNLASRSLSMIVKNCDGQVPLCGPLTDEDKAMLAAADSLIGTAREEMGKQLIHRALAAIIAVVSETDRYFAGQEPWALKKTDPSRMATVLYVTAEVVRQVAILLQPFMPESAGKLLDLVAVPTDRRDFAHLGEAGRLVSGTPLEAPKPVFPRYVAPEA

SEQ ID NO: 13991 - protein, 703 aa, Burkholderia xenovorans LB400
MTSRNRRDFLRSAAHAAGSATALSMLPLGIRNALAIPANNKTGTIRDVEHIVVLMQENRSFDHYFGTLKGVRGFGDTRAINLPNGKPVWYQPLAADIGYVLPFRPSAPNLGLQFLQDLAHDWTSTHAAWNGGRYDQWVPAKSATTMAYLTREDIPFHYQLADAFTICDAYHCSLMGPTDPNRYYMWSGWVGNDGSGGGPVIDNSELGYGWSTYPEVLQSAGISWKIYQDIGTGLDANGSWGWTQNPYIGNYGDNSLLYFNQYRNAQPGNPLYDNARTGTNAAKGDGYFDILKRDVQNNALPQVSWIVAPEAYSEHPNWPANYGAWYIDQVLQILTSNPEVWSKTVLLVNYDENDGFFDHMAPPFAPSSSANGLSTVDTTNEIYTGDAKTPSGPYGLGPRVPMLVVSPWSKGGYVCSELFDHTSVIRFIEKRFGHDHNLGESNITPWRRAVCGDLMSAFNFSNPNDAIPALPSTSGYVPADQNRHPDYVPLPPALQAVPKQEPGVRPARALPYELFVRVHGEGAANTLTMRFVNTGRAGAVFLVYAAHSLDAPRTYTVEAGKRLQDPLPLNADGSYDYTVYGPNGFLRRFAGKPVSRSWWHGSDIARPEVAEGYDVSNGNLQLRLENVGSARCQFTIVNAYDPGNAIKHSVRGGDTEQLYLDLRNAHGWYDLAITVDTDPLFARRFAGHVETGKSSMSDPALGA

SEQ ID NO: 13992 - protein, 932 aa, Aspergillus oryzae
MAATKIDGTQIAKNIRAGLKNEIQQIQESNPRFKPSLVIFQGTYVRMKLKAAEEAGIICKIVNLPETAIESELLQDITKANNDPSVHGILVQLPLPQHMSEHTITSAVADEKDVDGFGAINIGELAKRGGHPLFVPCTPQAVMELLRVSGVNPAGKKAVVLGRSDIVGSPVSYLLNKADATVTLCHSKTPDVESIIKTADILVAALGKTEFVKGEWLKPGVVVIDVGINYKPDPSKKSGQRLVGDVDFESAVQVASQITPVPGGVGPMTVAMLMQNVVNSAKAYFEKQKDRHITPLPLKLARPVPSDIAISRAQYPKAITQIASEIGISPHELEPYGHTKAKVSLDVLDRLAHRRNGKYILVCGITPTPLGEGKSTTTLGLTQAIGAHLNRIVFANVRQPSQGPTFGIKGGAAGGGYSQVIPMDEFNLHLTGDIHAITAANNLLAAAIETRMFHEATQKDGPLYKRLVPAKKGKREFQPVMFKRLKKLGITKTNPDELTNEEIRRFARLDIDPETITWRRVLDVNDRHLRGITVGQAPTEKGLTRETGFDISVASECMAILALSNSLEDMRDRLGRMVVATSKSGDPVTCDDIGAGGALAALMKDAIKPNLMQSLEGTPVLVHAGPFANISIGASSVIADKLALKLAGTEPDEDHEAKTGFVVTEAGFDFTMGGERFFNIKCRSSGLTPDTVVIVATVRALKVHGGGPEISPGAPLNEVYRTENVDILRKGCVNLKKHIENARQYGVPVVVAINRMETDTEAEIDVIREEAIAAGAEDAIPANHWAEGGAGAVDLAKGVLAASSKPKDFKLLYELEGTIQERIERIGKVMYGAEKIELSELAQKKVDTYTAQGFGHLPICIAKTQYSLSHDPALKGAPTGFTVPIRDVRLAVGGGYLYALAADIQTIPGLPTAPGYLNVDIDTETGEIDGLF

SEQ ID NO: 13993 - protein, 289 aa, Glycine max
MNLKNMKIPNVPGGGASSALLKLGLLGGIGLYAAANSLYNVEGGHRAIVFNRLVGVKDKVYPEGTHFMIPWFERPVIYDVRARPHLVESTSGSRDLQMVKIGLRVLTRPLPNQLPTVYRTLGENYNERVLPSIIHETLKAVVAQYNASQLITQREAVSREIRKILTERAANFNIALDDVSITSLTFGKEFTAAIEAKQVAAQEAERAKFVVEKAEQDKRSAVIRAQGEAKSAQLIGQAIANNPAFITLRKIEAAREIAHTISNAANKVYLNSDDLLLNLQEMKLEPGRK

SEQ ID NO: 13994 - protein, 429 aa, Burkholderia xenovorans LB400
MSNPTHHARAEGHYSVLVIGGGQAGLSVSYYLKQAGIDHLVVEKNTVTHTWREQRWDAFCLVTPNWQCALPGYPYRGDDPHGFMKKDEIIAYLDGFIAQVDAPMMEHTEVKRVKQRDDGVYAITTTQGDFTADQVVVASGGYHTPIVPRLAERLPARIVQLQSSAYRNPQALPEGAVMVVGTGQSGAQIAEDLHLAGRKVVLAVGEAPRCARFYRGRDVVDWLADMQYYDMPVEKHPLREGVRDNTNHYVTGRDGGRDIDLRKFAAEGMELYGRLDDLRDGQFHFAPTLAANLDAADDTYNRINASIDGFIAKHGIDAPAGGVYEPVWRPQQERTTLDLDGSGIAAIIWCIGFTPDFSWLDAPVFNGRGYPAHTRGITPIDGLYFVGLPWLHTWGSGRFSGIARDAEFIVDAIREKARERASLAAAVAA

SEQ ID NO: 13995 - protein, 308 aa, Escherichia coli O157:H7 EDL933
MAVAMDNAILENILRQVRPLIGQGKVADYIPALATVDGSRLGIAICTVDGQLFQAGDAQERFSIQSISKVLSLVVAMRHYSEEEIWQRVGKDPSGSPFNSLVQLEMEQGIPRNPFINAGALVVCDMLQGRLSAPRQRMLEVVRGLSGVSDISYDTVVARSEFEHSARNAAIAWLMKSFGNFHHDVTTVLQNYFHYCALKMSCVELARTFVFLANQGKAIHIDEPVVTPMQARQINALMATSGMYQNAGEFAWRVGLPAKSGVGGGIVAIVPHEMAIAVWSPELDDAGNSLAGIAVLEQLTKQLGRSVY

SEQ ID NO: 13996 - protein, 613 aa, Oryza sativa (indica cultivar-group)
MAQLQETYACSPATERGRGILLAGDPKTETIAYCTGRSVIIRRLDAPLDCWAYPDHAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCGEDFLANYYEGPPFKFKHSIRDHSNFVNCIRYAPDGSKFISVSSDKKGLIYDGKTGDKIGELSSEGSHTGSIYAVSWSPDSKQVLTVSADKTAKVWDILEDASGKLNRTLACPGTGGVDDMLVGCLWQNDYLVTVSLGGTFNVFSASNPDKEPVTFAGHLKTVSSLAFFPQSNPKTILSTSYDGVIMRWIKGVGYGGRLMRKNNTQIKCFTVAEEELVTSGYDNKVGNVFRIPLNGDQCGDAESVDVGGQPNALNLAIQKPEFALVTTDSGIVLLHKSTVISTTKVNYTITSSAVSPDGTEAIVGAQDGKLRIYSINGDTVTEEALIEKHRGAITCIHYSPDVSMFASADANREAVVWDRATREIKLKNMLFHSARINCLAWSPDNRLVATGSLDTCAIVYEIDKPASSRITVKGAHLGGVHGLTFVDNDSLVTAGEDACIRVWKLVPQ

SEQ ID NO: 13997 - protein, 682 aa, Amycolatopsis mediterranei
MTQVETHCPYCALQCGMSLEGTRVTPRDFPVNAGGLCQKGWTSGSLLTSPRRLTTPMLRVNGALEPVSWDFALDHVARKLAEIQGEHGPDGVAIFGGGGLTNEKAYLLGKFARVALGTSQIDYNGRFCMSSAAAAGIKAFGADRGMPFPVTDLKNADVVLLAGANPAETMPPFTQHLRGTDLIVVDPRRTPTAELASLHLAPAPGTDLALALGILHAVVESGHLDRSYVDDRTSGFAEMWRIAASWWPERAERVTGVSAADMRLAAEKLAAARNAYVLTARGTEQHATGTATVGAWINLALSLGLPGRPGSGYGCLTGQGNGQGGREHGQKADQLPGYRKLDDPAAREYVASVWGVDADSLPGPGRSATELLEALGQENGPKALMVFGSNVVVSAPRSQRVQDRLSGLDFLVVADFVLSETAALADVVLPVTQWAEEDGTLTNLEGRVLLRRKALTPPPGVRSDLDVLNGLALRLGQPENRFPADAETVFEELRIASKGGIADYSGVSYDRLRAGEALHWPVPADDHPGTPRMFLESFAHPDGRARFVPVEHTGPAELPDDEFPLQATTGRVLQHYQSGAQTRLIGELNDVVPEVFVEVHPDTAKRAGLEEGDRAVVRSRRGETVARVRFTQSLKPDLIFLPFHFPGEQRANLFTNPALDPVSRMPEFKVCAVSLSTVDGAA

SEQ ID NO: 13998 - protein, 245 aa, Brassica napus
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQDLETANSISSVEKNYEPT

SEQ ID NO: 13999 - protein, 174 aa, Triticum aestivum
  misc_feature (82)..(82): Xaa can be any naturally occurring amino acid
  misc_feature (154)..(154): Xaa can be any naturally occurring amino acid
MAAAGDAGEKKMITLKSSDGEEFEVEEAVAMESQTIRHMIEDDCADNGIPLPNVNSKILSKVIEYCNKHVQAKPADGAAAAXGASDAAAPAAPAEDLKNWDAEFVKVDQATLFDLILAANYLNIKGLLDLTCQTVADMIKGKTPEEIRKTFNIXNDFTPEEEEEIRRENQWAFE

SEQ ID NO: 14000 - protein, 460 aa, Arabidopsis thaliana
MDPCSFVRIIVGNLAVRFPRSPSSSSSSSSSSGPSVSDVSSGNCYCKIKFKSFPRQIVSVPVLLRTESESESRCCSGNVSTVAACFSLSKSQIETSLKKAKWSVLSVEVYSRRSASCGFVAASGEKLIGRFQVTLDLKAAESKTCLAHNGWVDLGTKSKNNKKSGSDPELHVSVRVEPDTRFVFQFDGEPECSPQVFQVQGNAKQAVFTCKFGFRNSGDRNLSLSLSSVTSGKEQFSKERKGWSITIHDLSGSPVAMASMVTPFVPSPGSNRVSRSSPGAWLILRPDGYTWKPWVRLQAWREPGVSDVLGYRFELYKDGIAVAVSASSSISTKLGGSFIIDGSTSTTTTASWSSSEGSFDLSSWSSIRSSRTDSGSGSDFRFSLSQAQQNLGFVMSTRVQGVEKQSKPKVEVGVKHVTCTEDAAAHVALAAAVDLSMDACRLFSQKLRNELRQPSRVDIV

SEQ ID NO: 14001 - protein, 640 aa, Salinibacter ruber DSM 13855
MGTIHLSNANLRGHAVATRRSAPQDHSNRCPAMKQTDLRDIAIVAHVDHGKTTLVDSMLWQSGIFRDNEEVQERVMDTMDLEREKGITIMANNTAVRYEGTKINIVDTPGHADFGGEVERTLRMVDGIMLLVDAAEGPLPQTRFVVQKALELDLPPIVVLNKIDRKDARPEESLDEIYDLFIDLGADMEQLEFPVLYTVATEGRCKTDLDNEEWSTLRPLFETMIDEIPPPTGDPDGTLQVLVTSVQRDDYLGPVAIGRVEQGVLQDRQDVTLCHRDGSTEQAEVTALFEYEGLQREETDAAGPGQIVAIAGVEGIGLGESISHPEHPEPMTPLDVDPPTMSMEFRINDGPFSGQEGEFVTSRQLRDRLFDEARNNLAIRVEETDSANVMRVYGRGELQMAILIEQMRREGYEFCVGMPQVITKEIDGETREPYETAEIDIPEEYMGVVMERLGERKGQMEHMVHQDSGRVRLTFRVPSRGLIGYRSKFLTDTKGTGLLTHRFEEFGAWAGEIPHRTSGALVADREGETTPYGLMELQDRGDFFVAPGDAVYKGMIVGENNKPQDLDLNVTKEKQLTNMRAAAGTELEHVPPPREMSLEDAIEFIREDELVEVTPEAYRLRKRHRKPKARRRAQEERAAG

SEQ ID NO: 14002 - protein, 129 aa, Oryza sativa (japonica cultivar-group)
MASEKEAALAAVPNDNPTIFDKIIKKEIPSTVVFDDEKVLAFRDINPQAPTHIVIIPKVKDGLTGLSKAEERHVEILGYLLYVAKVVAKQEGLEDGYRIVINDGPSGCQSVYHIHVHLLGGRQMNWPPG

SEQ ID NO: 14003 - protein, 324 aa, Yersinia pestis KIM
MTVQPQAELAMILPPIFHGCYCEGEAPNMSQKELWYETLHANFGQYFSVENVLFREKTEHQDLVIFENPELGRVMALDGVVQTTERDEFIYHEMMTHVPLLAHGQAKKVLIIGGGDGAMLREVSRHKNIEQITMVEIDAGVVEFCRQYLPNHSAGAYDDPRFKLVIDDGVNFVNQTTEKFDVIISDCTDPIGPGESLFTSVFYEGCARSLNEGGIFVAQNGVCFLQQDEAVNSHNKLSHYFSDVSFYQAAIPTYYGGIMTFAWATQNPALRQLDLATLQNRFAQAGLACRYYNPAIHVGSFALPQYLLDALTTIPKVIGVDSSE

SEQ ID NO: 14004 - protein, 539 aa, Arabidopsis thaliana
MASRIINHSKKLKHVSALLRRDHAVAVRCFSNSTHPSLVGREDIFKARLNYSSVERISKCGTGNVTMLSGISTTSTKLSSPMAGPKLFKEFISSQMRSVRGFSSSSDLPPHQEIGMPSLSPTMAEGNIARWLKKEGDKVAPGEVLCEVETDKATVEMECMEEGFLAKIVKEEGAKEIQVGEVIAITVEDEDDIQKFKDYTPSSDTGPAAPEAKPAPSLPKEEKVEKPASAPEAKISKPSSAPSEDRIFASPLARKLAEDNNVPLSSIKGTGPEGRIVKADVEDFLASGSKETTAKPSKQVDSKVPALDYVDIPHTQIRKVTASRLAFSKQTIPHYYLTVDTCVDKMMGLRSQLNSFQEASGGKRISVNDLVIKAAALALRKVPQCNSSWTDEYIRQFKNVNINVAVQTENGLYVPVVKDADKKGLSTIGEEVRFLAQKAKENSLKPEDYEGGTFTVSNLGGPFGIKQFCAVINPPQAAILAIGSAEKRVVPGTGPDQYNVASYMSVTLSCDHRVIDGAIGAEWLKAFKGYIETPESMLL

SEQ ID NO: 14005 - protein, 190 aa, Oryza sativa (japonica cultivar-group)
MILSVLSSPALVSGLMVVRAKNPQNSGIYTVGDFMTKREELHVVKSTTSVDEALEMLVEHRITGFPVIDDEWNLVGVVSDYDLLALDSISGNGLAEVDIFPEVDSTWKTFNEIQKLLSKTNGKVIGDVMTSAPLVVRETTNLEDAARLLLETKYRRLPVVDSSGKLVGIITRGNVVRAALKIKKKFEGEL

SEQ ID NO: 14006 - protein, 310 aa, Yersinia pestis KIM
MVNCVISSAYVISKKEPYSMGLLVVLRTHEVFNPPHMRDVTGNIKNQTGTEKILRRQYRVITETTVPISKSESLPYIILSQPEHYRLFTLMKEIEKLIANNRTWSNTICKDDPGFFEHLAQSQKPRFLWIGCSDSRVPAEQLTGLKSGELFVHRNVANLVIHTDLNCLSVVQYAIDVLQVEHIIICGHLGCGGVEAAIKGEEMGLIDNWLLHIRDLWYKHSSLLGELPQEERSNVLCQINVVEQVYNLGHSTIVRSAWKRGQKAMIHGWVYGIENGLLRDLEVSATSLGSLEMVYRKAMAELLQNNKEDH

SEQ ID NO: 14007 - protein, 249 aa, Phaseolus vulgaris
MVKITLGTFDDSFSVASLKAYFSELHATLIFVFAGVGSAIAYNELTKDAALDPTGLVAVAVAHAFALFVGVSVAANISGGHLNPAVTFGLAVGGNITLLTGFLYWIAQLLGSILACLLLNLVTAKSIPTHGPAYGVNAFQGVVCEIIITFGLVYTVYATAADPKKGSLGTIAPIAIGFIVGANILAAGPFSGGSMNPARSFGPAVVSGNFADNWIYWVGPLIGGGLAGLIYGDVFIGSYAAVPASETYP

SEQ ID NO: 14008 - protein, 292 aa, Coprinopsis cinerea okayama7#130
MFYVIGLGLCDEKDITVRGLEAVKGASRVYLEAYTSILMIQQDRLEEFYGKPVILADRDMVETQSDEILRDADKEDVAFLVVGDPFGATTHTDIILRARALGIQTRVIHNASIMNAVGACGLQLYNFGQTVSLVFFTETWKPDSYYDRVKENVQLGMHTLVLLDIKVKEQSEENLARGRKIYEPPRYMSIPTAVSQMLDTESTRQENVLNPESTLAIALSRVGGDGNQQRIVAGTLKELQGQPPEVFGEPLHSIVIVGKRVHYLEIEYAEAFAVDKENWRRVARDVYGCAGL

SEQ ID NO: 14009 - protein, 467 aa, Staphylococcus epidermidis ATCC 12228
MLKRFHKGIIISLAIEKGMIRMKANKYLIFILGALGGLLYGYDNGVISGALLFIHKDIPLNSTTEGIVVSSMLIGAIVGAGSSGPLADKLGRRRLVMLIAIVFIIGALILAASTNLALLIIGRLIIGLAVGGSMSTVPVYLSEMAPTEYRGSLGSLNQLMITIGILAAYLVNYAFADIEGWRWMLGLAVVPSVILLVGIYFMPESPRWLLENRNEEAARQVMKITYDDSEIDKELKEMKEINAISESTWTVIKSPWLGRILIVGCIFAIFQQFIGINAVIFYSSSIFAKAGLGEAASILGSVGIGTINVLVTIVAIFVVDKIDRKKLLVGGNIGMIASLLIMAILIWTIGIASSAWIIIVCLSLFIVFFGISWGPVLWVMLPELFPMRARGAATGISALVLNIGTLIVSLFFPILSDALSTEWVFLIFAFIGVLAMIFVIKFLPETRGRSLEEIEYELRERTGARTE

SEQ ID NO: 14010 - protein, 335 aa, Fragaria x ananassa
MGVERVQDIASTISEDTIPAEYIRSENEQPGITTVPNTVLECPTIDFSDPDEEKLLKQIFEASIDWGMYQIVNHDISNEAISKLQAVGKEFFELPQEEKEVYAKDPNSKSVEGYGTFLQKELEGKKGWVDHLFHKIWPPSTINYRFWPKTPASYREANEEYAKNLHKVVEKLFKLLSLGLGLEAQELKKAIGGDDLVYLLKINYYPPCPRPDLALGVVAHTDMSALTILVPNEVQGLQACRDGQWYDVKYIPNALVIHIGDQMEIMSNGKYRAVLHRTTVSKDKTRISWPVFLEPPADQVIGPHPKLVNDKENPPEYKTKKYSEYVYNKLNKMPQ

SEQ ID NO: 14011 - protein, 422 aa, Oryza sativa (japonica cultivar-group)
MGDGRVGGGTNRPAWLQQYELVGKIGEGTYGLVFLARLKQSHPHAAAGVGRRGSPIAIKKFKQSKEGDGVSPTAIREIMLLREINHENVVKLVNVHINHADMSLYLAFDYAEHDLYEIIRHHREKLNLPINPYTVKSLLWQLLNGLNYLHSNWIIHRDLKPSNILVMGEGEEHGIIKIADFGLARIYQAPLKPLSDNGVVVTIWYRAPELLLGAKHYTSAVDMWAVGCIFAELLTLKPLFQGVEAKATPNPFQLDQLDKIFKVLGHPTVEKWPTLANLPCWQNDQQHIQGHKYENTGLHNIVHLPQKSPAFDLLSKMLEYDPRKRITAAQALEHEYFRMDPLPGRKLERKLCNILCVQLIPQLILKEQQAFNQLKRHQGTQLLATSLWYRDPFRGKCNNPWSVCREWVVQTWRPLVQLRKEA

SEQ ID NO: 14012 - protein, 587 aa, Nicotiana tabacum
MASFSIKFLAPSLPNPARFSKNAVKLHATPPSVAAPPTGAPEVAAERLEPRVEEKDGYWILKEQFRKGINPQEKVKIEKEPMKLFMENGIEELAKIPIEEIDQSKLTKDDIDVRLKWLGLFHRRKNQYGRFMMRLKLPNGVTTSAQTRYLASVIRKYGKEGCADITTRQNWQIRGVVLPDVPEILKGLAEVGLTSLQSGMDNVRNPVGNPLAGIDPEEIVDTRPYTNLLSQFITGNSRGNPAVSNLPRKWNPCVVGSHDLYEHPHINDLAYMPATKDGRFGFNLLVGGFFSAKRCDEAIPLDAWVPADDVVPVCKAILEAFRDLGFRGNRQKCRMMWLIDELGVEGFRAEVEKRMPQQQLERASPEDLVQKQWERRDYLGVHPQKQEGYSFIGLHIPVGRVQADDMDELARLADEYGSGEIRLTVEQNIIIPNIETSKIEALLKEPVLSTFSPDPPILMKGLVACTGNQFCGQAIIETKARSLKITEEVQRQVSLTKPVRMHWTGCPNTCAQVQVADIGFMGCLTRDKNGKTVEGADVFLGGRIGSDSHLGEVYKKAVPCDDLVPLVVDLLVNNFGAVPREREETED

SEQ ID NO: 14013 - protein, 374 aa, Oryza sativa (japonica cultivar-group)
MSLYLAFDYAEHDLYEIIRHHREKLNLPINPYTVKSLLWQLLNGLNYLHSNWIIHRDLKPSNILVMGEGEEHGIIKIADFGLARIYQAPLKPLSDNGVVVTIWYRAPELLLGAKHYTSAVDMWAVGCIFAELLTLKPLFQGVEAKATPNPFQLDQLDKIFKVLGHPTVEKWPTLANLPCWQNDQQHIQGHKYENTGLHNIVHLPQKSPAFDLLSKMLEYDPRKRITAAQALEHEYFRMDPLPGRNALLPSQAGEKIVQYPVRPVDTTTDFEGTTSLQPTQAPSGNAAPGNQSVVPRPIPRQMQQPMVGMSRMGGTNMAAFGAAPQGGIAGMNPGNIPMQRGAGAQSHPHQLRRKADQGMGMQNPGYPTQQKRRF

SEQ ID NO: 14014 - protein, 346 aa, Oryza sativa (japonica cultivar-group)
MGDGRVGGGTNRPAWLQQYELVGKIGEGTYGLVFLARLKQSHPHAAAGVGRRGSPIAIKKFKQSKEGDGVSPTAIREIMLLREINHENVVKLVNVHINHADMSLYLAFDYAEHDLYEIIRHHREKLNLPINPYTVKSLLWQLLNGLNYLHSNWIIHRDLKPSNILVMGEGEEHGIIKIADFGLARIYQAPLKPLSDNGVVVTIWYRAPELLLGAKHYTSAVDMWAVGCIFAELLTLKPLFQGVEAKATPNPFQLDQLDKIFKVLGHPTVEKWPTLANLPCWQNDQQHIQGHKYENTGLHNIVHLPQKSPAFDLLSKMLEYDPRKRITAAQALEHEYFRMDPLPGRK

SEQ ID NO: 14015 - protein, 290 aa, Nicotiana benthamiana
MNLNNVKVPKMPGGGAASALIKLGVVAGLGVYGVANSLYNVDGGHRAIVFNRIIGVKDKVYPEGTHFMIPWFERPVIYDVRARPHLVESTSGSRDLQMVKIGLRVLTRPVPDQLPTVYRTLGENYNERVLPSIIHETLKAVVAQYNASQLITQRENVSREIRKILTERAANFNIALDDVSITSLTFGKEFTAAIEAKQVAAQEAERAKFVVEKAEQDKRSAIIRAQGEAKSAQLIGQSIANNPAFITLRKIEAAREIAQTMSHAANKVYLSSDDLLLNLQDLNLDGAGKR

SEQ ID NO: 14016 - protein, 584 aa, Nicotiana tabacum
MASFSVKFSATSLPNHKRFSKLHATPPQTVAVAPSGAAEIASERLEPRVEEKDGYWVLKEKFRQGINPAEKAKIEKEPMKLFMENGIEDLAKISLEEIEGSKLTKDDIDVRLKWLGLFHRRKHHYGRFMMRLKLPNGVTTSSQTRYLASVIRKYGKDGCADVTTRQNWQIRGVVLPDVPEILKGLDEVGLTSLQSGMDNVRNPVGNPLAGIDPHEIVDTRPYTNLLSQYVTANFRGNPAVTNLPRKWNVCVIGSHDLYEHPQINDLAYMPATKDGRFGFNLLVGGFFSPKRCAEAVPLDAWVPADDVVPVCKAILEAYRDLGTRGNRQKTRMMWLVDELGVEGFRAEVVKRMPQQKLDRESTEDLVQKQWERREYLGVHPQKQEGYSFVGLHIPVGRVQADDMDELARLADEYGSGELRLTVEQNIIIPNVKNSKIEALLNEPLLKNRFSTDPPILMKNLVACTGNQFCGKAIIETKARSMKITEEVQLLVSITQPVRMHWTGCPNSCAQVQVADIGFMGCLTRKEGKTVEGADVYLGGRIGSDSHLGDVYKKSVPCEDLVPIIVDLLVDNFGAVPREREEAED

SEQ ID NO: 14017 - protein, 260 aa, Oryza sativa (japonica cultivar-group)
MGDGRVGGGTNRPAWLQQYELVGKIGEGTYGLVFLARLKQSHPHAAAGVGRRGSPIAIKKFKQSKEGDGVSPTAIREIMLLREINHENVVKLVNVHINHADMSLYLAFDYAEHDLYEIIRHHREKLNLPINPYTVKSLLWQLLNGLNYLHSNWIIHRDLKPSNILVMGEGEEHGIIKIADFGLARIYQAPLKPLSDNGVVVTIWYRAPELLLGAKHYTSAVDMWAVGCIFAELLTLKPLFQGVEAKATPNPFQVWAFTLK

SEQ ID NO: 14018 - protein, 350 aa, Listeria monocytogenes str. 1/2a F6854
MTYKITSLAGDGIGPEIMTSGLQVLEAVAKKYNHTFEIESHTFGGAGIDVAQDPIPSSTLKACQDADAILLGAIGGPKWDNASKRPEDGLLALRKALGLFANIRPIQVPSSITHLSPLKKEIVENTDFVVVRELTGGLYFGEPKHWDESAAVDSLTYTRAEIERIIEKAFEIAATRNKKVTSVDKANVLASSKLWRKIAEEVASRHPDITLEHLYIDAAAMLMIQRPTTFDVIVTENLFGDILSDEASVITGSLGMLPSASHAENGPSLYEPIHGSAPDIANQNIANPMSMISSVSMMLRQSFSLFKEADAIDAAATRTMQAGFLTADLGGNTTTTDFTDEVLKQIEGGE

SEQ ID NO: 14019 - protein, 587 aa, Nicotiana tabacum
MASFSVKFSATSLPNPNRFSRTAKLHATPPQTVAVPPSGEAEIASERLEPRVEEKDGYWVLKEKFRQGINPAEKAKIEKEPMKLFMENGIEDLAKISLEEIEGSKLTKDDIDVRLKWLGLFHRRKHHYGRFMMRLKLPNGVTTSAQTRYLASVIRKYGKDGCGDVTTRQNWQIRGVVLPDVPEILKGLDEVGLTSLQSGMDNVRNPVGNPLAGIDPHEIVDTRPYTNLLSQYVTANFRGNPAVTNLPRKWNVCVIGSHDLYEHPHINDLAYMPASKDGRFGFNLLVGGFFSPKRCAEAVPLDAWVPADDVVPVCKAILEAYRDLGTRGNRQKTRMMWLVDELGVEGFRAEVVKRMPQQKLDRESTEDLVQKQWERREYLGVHPQKQEGYSFVGLHIPVGRVQADDMDELARLADNYGSGELRLTVEQNIIIPNVENSKIESLLNEPLLKNRFSTNPPILMKNLVACTGNQFCGQAIIETKARSMKITEEVQRLVSVTKPVRMHWTGCPNSCGQVQVADIGFMGCLTRKEGKTVEGADVYLGGRIGSDSHLGDVYKKSVPCEDLVPIIVDLLVNNFGAVPREREEAED

SEQ ID NO: 14020 - protein, 181 aa, Coprinopsis cinerea okayama7#130
MQAIKCVVVGDGAVGKGEYIPTVFDNYSANVMVDGKTISLGLWDTAGQEDYDRLRPLSYPQTDVFLICFSLVSPPSYENVRTKWYPEISHHAPSTSIVLVGTKLDLREDPMTIEKLRERRMAPIQYSQGVAMAKDIGAVKYLECSALTQKGLKTVFDEAIRAVLNPPPRVSKKNSSRCVIL

SEQ ID NO: 14021 - protein, 344 aa, Chlamydophila abortus S26/3
MLTLGLESSCDETACALVDANAKIVANVVFSQQDHVSYGGIVPELASRAHLQVFPSVVQSALKESGVSLEDIDLFAVTHTPGLIGALAIGVNFAKGLAVGCQKPIIGVNHVEAHLYAAYMEASSVEFPALGLVVSGAHTAIFLMEDPLTYKLIGKSRDDAIGETFDKVARFLGLPYPGGALIEKLAVHGCESSYPFSPSKVPGYDLSFSGLKTAVLYAIKGNNSNHRTPLPELSESQKNNISASFQKAAFTSVAQKLPNIVKKFSCRSLLVGGGVANNKYFQSLLKNTLDLPLYFPSSKLCTDNAAMIAGLGRELFLSEKITSGITPCARYQWESASVSLSPLP

SEQ ID NO: 14022 - protein, 483 aa, Glycine max
MASAAAPTTFSLLHSTTPASSSSATSASPSRVQLSSSLRSRPLARRLGFAAADPLLAANVAARVAAVRGGKGARGVVSMAKKSVGELSAADLKGKKVFVRADLNVPLDDNQNITDDTRIRAAIPTIKHLIQNGAKVILSSHLGRPKGVTPKYSLAPLVPRLSELIGIQVVKAEDSIGPEVEKLVASLPDGGVLLLENVRFYKEEEKNDPEHAKKLASLADLFVNDAFGTAHRAHASTEGVTKYLKPSVAGFLLQKELDYLVGAVSSPKRPFAAIVGGSKVSSKIGVIESLLEKVDILLLGGGMIFTFYKAQGLSVGSSLVEEDKLDLATSLLAKAKEKGVSLLLPSDVVIADKFAPDANSKVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 14023 - protein, 1257 aa, Arabidopsis thaliana
MDQAKGYEHVRYTAPDPRDEGLGSINQRFSHDSSTNVNTYVRPPDYGVSTPARPVLNYSIQTGEEFAFEFMRDRVIMKPQFIPNVYGEHSGMPVSVNLSALGMVHPMSESGPNATVLNIEEKRQSFEHERKPPSRIEDKTYHELVQSAPVISSKNDTGQRRHSLVSSRASDSSLNRAKFLCSFGGKVIPRPRDQKLRYVGGETRIIRISKTISFQELMHKMKEIFPEARTIKYQLPGEDLDALVSVSSDEDLQNMMEECIVFGNGGSEKPRMFLFSSSDIEEAQFVMEHAEGDSEVQYVVAVNGMDLSSRRSSLGLSPPGNNLDELLHGNFDRKIDRAATEPAVASLTPLAGNESLPASQTSQPVTGFSTGNEPFSQPYLGQQLQFPGLGNHQIYTSGHMASIGYIDEKRSAPLHVQPQPHYIPYSVNPETPLESLVPHYPQKPEQGFLREEQIFHVQDPETSSKEAKMRRDDSFQKVNDHPISTVESNLSAKEPKMRRESSTPRVNEYPVSSMPSDLIVPDDLPKEEAPIVTQTSSSTPDPSSSTLSEKSLRKSEDHVENNLSAKEPKMRKEHSTTRVNEYSVSSVSSDSMVPDQALKEEAPISMKISNSTPDPKSLVYPEKSLRTSQEKTGAFDTTNEGMKKNQDNQFCLLGGFSVSGHGTSNNSSSNVSNFDQPVTQQRVFHSERTVRDPTETNRLSKSDDSLASQFVMAQTTSDAFLPISESSETSHEANMESQNVHPTAPVIPAPDSIWTAEGSMSQSEKKNVETNTPEHVSQTETSAKAVPQGHNEKGDIVVDINDRFPREFLADILKTKESLNFPGLGPLHADGAGVSLNIQNNDPKTWSYFRNLAQDEFERKDLSLMDQDHPGFPTSMTNTNGVPIDYSYPPLQSEKVASSQIHPQIHFDGNIKPDVSTITIPDLNTVDTQEDYSQSQIIGAESTDATLNAGVPLIDFMAADSGMRSLQVIKNDDLEELKELGSGTFGTVYHGKWRGTDVAIKRIKRSCFIGRSSEQERLTSEFWHEAEILSKLHHPNVMAFYGVVKDGPGGTLATVTEYMVNGSLRHVLLSNRHLDRRKRLIIAMDAAFGMEYLHSKSIVHFDLKCDNLLVNLKDPARPICKVGDFGLSKIKRNTLVTGGVRGTLPWMAPELLSGSSSKVSEKVDVFSFGIVLWEILTGEEPYANMHYGAIIGGIVNNTLRPTVPNYCDPEWRMLMEQCWAPDPFVRPAFPEIARRLRTMSSSAVHTKPHAVNHQIHK

SEQ ID NO: 14024 - protein, 710 aa, Coccidioides immitis RS
MSSVPPNGPPGRVPPAGRAGPFIKVRRPKPADPLVRPKKRPIPRSQGLAPGGAPVANGQPRPSPQLPPKPQSNTSTPKPPPIPSADDMTVNGFSGPLLCQNYVDFALVTTKRALKEGLKHHVAKFLSKKNIDPRDESQFTRPVRLQRRDPRATTEPPPIERQQNAQKGREGNLTEAEREALEAKKAARAKEREENLAQIAPSASGGPKRTNVPKQRIQQVFKSEMTPEEIAKARVKYEEALPWHLEDFDNKNTWVGKYEAAMSETYAMFVLEKNGKLRLVPIDKWYKFSGKNPFKALTIEEAEKYMSKKIKDPRWFMEKEQERKQERELADFAKQRKVYTGRVVSSGVGEGGEGDDMDFEEDRFADDEEHVVVEEDEEAKLAEKRIKKDQLKANVFNLRDERDYEAEENQERREKEALKEFGKKVRKALQRREKNYDYSSGSDANPWSEDESTDESEAERIRAEDEKKEGEKSSAPQTKGTSTPSDRGKFTDALKKGPTQQMKKRPGSPNVSDASGTDTPRKKAKNKHIAQPLSTTASKPGSRPMSPAPSTTTSATQRKQDATKPAGKKRMRSGTGGAGSGSDAERGAASGAEVSDSAVAKKLKINPPGVSSKRGTPAGSRAGSPPVRPSTPATATTVAPVGSFPTHAEVHAAIPPTGISSGDLLKLFRHRLGDMKTNYPKFIAIVKEVGVFAKEDKLLRPAPNFKPSGS

SEQ ID NO: 14025 - protein, 350 aa, Bacillus clausii KSM-K16
MKVVNHATKYERLKHFLNALNEPTYRYKQITEAIFKHRIGAFNKMTTLPKALRESLINEFGPSILTVEPVLETTSQQVTKVLLKVAGNNQVEAVRMHYEAGWESFCISSQCGCGLGCTFCSTGAIGLKQNLSADEMTDQLLYFYLKGHSLDSVSFMGMGEALANVRIFDALNVLVDRQLFALSPRRITVSTVGIIPNIQRMTSSFPQMNLTFSLHSPFHDQRSELMPINNKYPLDQVMNVLDQHIHETGRKVYIAYVMLRGVNDSEKHAEALVKRILNNRYPHLYHVNLIRYNPTVGTPENYGQTIEEKLQTFYRVVKSARIPVTIRSQFGREIDAACGQLYGQYQAKKR

SEQ ID NO: 14026 - protein, 363 aa, Debaryomyces hansenii CBS767
MTPNPSLVLNKINDISFEKYDAPEITEPNDVIVEVKKTGICGSDIHYYTHGAIGGFILKSPMVLGHESSGIVSAVGKGVTSLKVGDKVAIEPGVPSRHSDAYKGGHYNLCPHMVFAATPNSEDGGVNPPGTLCKYYKSPEDFLVKLPDHVSLELGALVEPLTVGVHAAKLGSIKFGDVVVVFGAGPVGLLAAAVATKFGATKVMVVDVFESKLEMAKQIGVATHTFNPKLGSNKDLVAAFDNTEPSVVMECSGAEPCIKSAVDILRVGGRYIQIGNSAKPVSFPMTEFATKELTLFGSFRYGFNDYKTSVAILDENYRNGKENAAIDFESLITHRFKFDDAIDAYDLVKGGNGCVKCIISGPE

SEQ ID NO: 14027 - protein, 403 aa, Coccidioides immitis RS
MARVFTALRSTRAERVGSPTGDLMDFFLEPPLSGARSGLPLVEFLHHGNSQIRQIACEHLVGYSTSQPSLFKRQQLLPIRDLKLLARDYAPIAKNAFTMLVNLSGDEEVLKLLTEDDGFLETLLVKVTNVKEPNASEITMLLANMAKSDSMKRIISLTRAVPSGASKSSKAMDQLMDCFVKGNEGGLNKSNDTNYDYLAYFFADISKHEEGRAYFITEQEYDSVIPITKLTVFTEHRSHIRRKGVASTLKNIAFEISAHPSLLSESQINILPYILLPIAGPEEFDDDESAAMLPDLQLLPPDKERDSDPEIITTHLETLLLLTTTKEGRKIMRDVQVYPLIRECHSHIDDPKVMEGCDRLVQVLMRGEEGDEDKDAEAMERAKAKALEEAPREDDEDKIVEIF

SEQ ID NO: 14028 - protein, 398 aa, Streptomyces avermitilis MA-4680
MAAMTSSARPLLNRRLAEFGTTIFAEMSALAMSTGAINLGQGFPDTDGPEEIREAAVRALRDGRGNQYPPGPGVPELRTAIAAHQQRRYGLTYDPDTEVLVTAGATEAIAATLLALLEPGDEVIAFEPYYDSYAACIAMAGGTRVPVTLRPHPEDGRFRLDLDELRDAVTDRTRLLLVNTPHNPTGTVLTREELTAIAELAVERDLLVVTDEVYEHLVFDDAEHLPLATFPGMRERTVSISSAGKTFSFTGWKVGWVTGAPGLVTAVRSAKQFLTYVASGPFQYAVAEALALPDTYFEAFRADMLAKRDLLAAGLTAAGFEVFRPAGTYFITTDIRPLGERDGFAFCRALPERAGVVAIPNAVFYDHREAGAPFVRFAFCKRTDVLEEAAKRLGTLRG

SEQ ID NO: 14029 - protein, 548 aa, Streptomyces avermitilis MA-4680
MIEPHAPAPPGAAPPWGGQSRPWLPVRPGVGRFFVLAGVFVCAACGLVYELELVALASYLIGDSVTQASVVLSVMVFAMGIGSLAAKRLRPHAAAGFGAIEAALALVGGSSAMALYAVFAWTGDWGGVWAGGPRCLLVAFSLAIGLLIGAEVPLLMELIQRIRRQDAGGAVADLFAADYVGALVGGLAFPFLLLPLLGQLEGVLLTGTVNALAGGALVLGLFRRDLTRRGRWLLIVVNLVVLGLLATAAVLVDDFERAARQAVYGRDVRVALQTGVQEVVLTGGTRGRPLDLFLDGRLRVSGHDERRYHEALVHPAMSDGRHARVLVLGGGDGLAAREVLRYADVARVDVVELDAGVVRLARRDPALSSLNAHAYDDPRVHVVTADAFCRLRHTRSAYDVVISDLPDPGITASTKLYSQEFYGLVSRVLAPGGRLVVHAGPVASRPRAYWTVEATVRAAGLRTVPYRVGGRDTGFAAGPDRSTDASRAPRDWGFVLASRTGPALSLGPGGPRLRTLTRASLAADALDPGRARPPDVAPSTLVHPRYAD

SEQ ID NO: 14030 - protein, 520 aa, Silicibacter sp. TM1040
MTETAHDRLLIIDFGSQVTQLIARRLRELNVYCEIHPYQNVTMDFVREFAPKAVIFSGGPDSVTREGSPRAPQEIFDYGVPILGICYGQQVMMHQLGGTVQSGHGTAEFGRAYVTPTEERIDMLSGWFLDQTEQVWMSHGDHVSEIAPGFKVYGTSPNAPFAITADLERNFYAVQFHPEVHHTPNGKTLYENFVRLAGFSGDWTMGAYREQMVETIREQVGDKKVICALSGGVDSSVAAALIHEAIGDQLTCVFVDHGLLRKNEAEEVVGMFRDHMNLQVIHADETELFLGELEGQSDPETKRKIIGKLFIDVFQKYADQIEGAEFLAQGTLYPDVIESVSFSGGPSVTIKSHHNVGGLPEKMGLKLVEPLRELFKDEVRALGRELGLPDSFIGRHPFPGPGLAIRCPGEITRDKLDILREADAIYIDQIRKHGLYDEIWQAFVAILPVRTVGVMGDGRTYDYACALRAVTSVDGMTADYYPFSHEFLGETATRIINEVKGINRCTYDITSKPPGTIEWE

SEQ ID NO: 14031 - protein, 470 aa, Zea mays
MHMMRRLKSIASGRSSVSDPGGDSGSKRPKFEQDGAGDIVMEPHLTEDKPVRIDQESSSSSNRDAEASTSTSMKPVKTEEAGADLLPKEMNIMTISDDKADGHNDKEGEGVTLDGTGTETGQIIVTTIGGHNGKPKQKVSYMAELVVGTGSFGIVFQAKCLETDETVAIKKVLQDKRYKNRELQTMQLHDHPNVVQLKHHFFSTTQKGEVYLNLVLEFVSETVYRVAKYYNRMNQRVPIIYVKLYAYQMCRALAYIHRVVGVCHRDIKPQNLLVNPHTHQLKICDFGSAKKLVPGEPNISYICSRYYRAPELIFGATEYTTAIDIWSVGCVVAELLIGQPLFPGESGVDQLVEIIKILGTPTREEIRCMNPNYSEFKFPQIKAHPWHKLFGKRMPPEAVDLVSRLLQYSPNLRCTAVDACAHPFFDELRDPKVCLPSGRPLPALFDFTAAELEGLPIELVHRIVPEHMRK

SEQ ID NO: 14032 - protein, 317 aa, Staphylococcus epidermidis ATCC 12228
MKMEKEQAHWIYKTMNEIRFFEEKVHKIFSDGRIPGFVHLYVGEEAVATGVMSQLNDDDYITSTHRGHGHAIAKGCDLNGMMAEIMGKRDGLGHGKGGSMHVAEIDKGMLGANGIVSGGFGLAIGASISIINQGKDNVAVCFFGDGAANEGNFHEGLNFASILDLPVLFICENNQFAEGTTHDYASASETIAERAAAYNMPGVRVDGMDVVEVYKATQEAVERAKKGEGPTLIECDTYRKYGHFEGDEQKVKSPDDRNADKNATVEFRKRAIEENWLTEKEADEIEKAAEQAVEDAVKFAEESELPDEDSLYKDVFA

SEQ ID NO: 14033 - protein, 165 aa, Streptomyces griseus subsp. griseus
MTTKVYFDITIDDAPAGRITFNLFDDVVPKTTENFRALATGEKGFGYAGSSFHRVITDFMLQGGDFTRGDGTGGKSIYGEKFADENFKLKHDRVGLLSMANAGPNTNGSQFFVTTVLTPWLDGKHVVFGEVADEDSMKLVRKIEALGSPSGKTRAKVTIAASGVL

SEQ ID NO: 14034 - protein, 346 aa, Staphylococcus epidermidis ATCC 12228
MSEERKLTFMGAINEAIDQSMEKDEDVILIGTDVSGGAKVDHIKDDDTFGGVFGVTKGLAKKYSRKRVIDTPIAEHITLSTAVGAAATGLRPIAELMFNDFIGFGLDPILNQGAKMRYMFGGKAKIPLVVRTVHGAGASAAAQHSQSLYNMFAAIPGVKVVVPSNPYDAKGLLMSAIQEDNLVVFSEDKTLLGQKGNVPEEPYTIEIGKANVTREGDDLTIVAIGKMVAVAEETAEKLAEDQVSVEVIDLRSVSPWDQETVLDSVKKTGRLIVIDESNPQCNIAGDVASVIGDVGFDYLDGPIKKVTAPDTPVPFAANLEAAYMPNADKVLDIASELIDDLKKANA

SEQ ID NO: 14035 - protein, 489 aa, Pseudomonas putida GB-1
MSSMIKHWINGREVESKDTFVNYNPATGDAICEVASGGAEEVAQAVAAAKEAFPKWANTPAKERARLMRKLGELIDQNVPKLAELETLDTGLPIHQTKNVLIPRASHNFDFFAEVCTRMDGHTYPVDDQMLNYTLYQPVGVCGLVSPWNVPFMTATWKTAPCLALGNTAVLKMSELSPLTANELGRLAVEAGIPNGVLNVIQGYGATAGDALVRHPDVRAISFTGGTATGKKIMQTAGLKKYSMELGGKSPVLIFEDADLERALDAALFTIFSLNGERCTAGSRIFIQESVYPQFVAEFAARAKRLIVGDPTDPKTQVGSMITQQHYDKVTGYIRIGMEEGARLVAGGLERPANLPAHLAKGQFIQPTVFADVNNKMRIAQEEIFGPVVCLIPFKDEAEALQLANDTEYGLASYIWTQDIGKAHRLARGIEAGMVFINSQNVRDLRQPFGGVKGSGTGREGGQYSFEVFAEIKNVCISMGSHHIPRWGV

SEQ ID NO: 14036 - protein, 352 aa, Pseudomonas fluorescens PfO-1
MNDHNNNIQLETAMTTTTMTMIQALRSAMDVMLERDDNVVVFGQDVGYFGGVFRCTEGLQTKYGTSRVFDAPISESGIVGVAVGMGAYGLRPVAEIQFADYVYPASDQIISEAARLRYRSAGEFTAPMTLRMPCGGGIYGGQTHSQSIEAMFTQVCGLRTVMPSNPYDAKGLLIASIENDDPVIFLEPKRLYNGPFDGHHDRPVTPWSKHPQAQVPDGYYTVPLDVAAITRPGKDVTVLTYGTTVYVSQVAAEESGVDAEVIDLRSLWPLDLETIVKSVKKTGRCVVVHEATRTCGFGAELVSLVQEHCFHHLEAPIERVTGWDTPYPHAQEWAYFPGPSRVGAALKRVMEV

SEQ ID NO: 14037 - protein, 425 aa, Staphylococcus epidermidis ATCC 12228
MSENIIMPKLGMTMKEGTVEEWFKSEGDTVKQGESIVTISSEKLTNDVEAPASGTLLEIKVQAGEDAEVKAVLGIIGEEGEAIDKDEDDLASEKVKEDNEHEKETQEVKDTSQQSSDNKDNSPKSAARERIFISPLARNMAEDKGLDINKIKGTGGNHRITKLDIQRVEANGYDYASDTTSNEDTSHVPTQTVDTSAIGEGLNPMRQRIAQNMRQSLNSTAQLTLHRKVDADRLLDFKDRLATELKQADQDVKLTVTTLLAKAVVLALKEYGAMNARYEQGELTEYEDVHLGIATSLDEGLMVPVINHADTKSIGTLAHEIKSSAEAVREGNTGAVQLEGATFTITNMGASGIEYFTPILNLGETGILGVGALTKEVVLEADNIKQVSKIPLSLTFDHQILDGAGAADFLKVLAKYIENPYLLML

SEQ ID NO: 14038 - protein, 457 aa, Pseudomonas fluorescens PfO-1
MQSLNTTLLIIGGGPGGYVTAIRAGQLGISTILVEGESLGGTCLNIGCIPSKALIHVAEQFHQTQHHNQHSALGISVSAPTLDITKSVEWKDGIVDRLTTGVAALLKKNKVQVINGWAKVIDGKTVEVGDTRIQCEHLVLATGSKSVNLPILPIGGPIISSTEALAPKSVPKRLIVVGGGYIGLELGIAYRKLGAEVSVVEAQDRILPAYDAELTQPVHDALKQLGVKLYLKHSVLGFDGTLQVRDPNGDTLNLETDQVLVAVGRKPNTQGWNLEALNLDMNGSAIKIDSRCQTSMRNVYAIGDLSGEPMLAHRAMAQGEMVAELISGKTREFNPTAIAAVCFTDPELVVVGKTPDEAKAAGLDCIVSNFPFAANGRAMTLESKTGFVRVVARRDNHVIVGWQAVGVGVSELSTAFAQSLEMGARLEDIGGTIHAHPTLGEAVQEAALRALGHALHL

SEQ ID NO: 14039 - protein, 339 aa, Pseudomonas fluorescens PfO-1
MGNESINWDKLGFDYIKTDKRYLSYFRNGEWDKGTLTEDNVLHISEGSTALHYGQQCFEGLKAYRCKDGSINLFRPDQNAARMQRSCARLLMPHVSTEQFIEACKEVVRANERFIPPYGTGGALYLRPFVIGVGDNIGVRTAPEFIFSVFAIPVGAYFKGGLTPHNFQISTFDRAAPQGTGAAKVGGNYAASLMPGSQAKKAHFADAIYLDPLTHKKIEEVGSANFFGITHDNKFVTPNSPSVLPGITRLSLIELAKSRLGLEVVEGDVFIDKLSDFKEAGACGTAAVITPIGGISYNDHLHVFHSETEVGPVTQKLYKELTGVQTGDVEAPAGWIVKV

SEQ ID NO: 14040 - protein, 434 aa, Coprinopsis cinerea okayama7#130
MDDDAPGAPVSKPHSTSLPPLTPKETAHLAAVFCIFWFIANWTVNASLDFTSVASATILSSMSGFFTLGIGRLFRVERLSWLKVTTVLVSFLGVILVSWSDHGKQTSLPDPSQPPTNPGPKNPILGDALALISAVFYAIYVILLKVRIKSESRIDMQLFFGSRLWAGVLINMAITWSSDYLYVLSMLKTTPLVVTVGLSLTIPFAVLGDFLKGRGSEIQVVLGALLPKERRTRTHGHQSSVKLPKRSYAVGDSAVEHIDIGSAKDAPANALLQAMSSPEDSSIGVSLTKKEKLALKREAFLQKLELSKTHSKSHERRMKRKAKEQLASGMTEIQAVLAALEEPQEPQGTESKAGESGETTTASGSSQTASSKSLKIGAGKSEPLSKAQRKKALQLERLRQPLILTNPSFSSNPFSTVRLHAQNTLLKKQPPPTT

SEQ ID NO: 14041 - protein, 562 aa, Triticum aestivum
  misc_feature (231)..(231): Xaa can be any naturally occurring amino acid
  misc_feature (481)..(481): Xaa can be any naturally occurring amino acid
  misc_feature (497)..(497): Xaa can be any naturally occurring amino acid
  misc_feature (522)..(522): Xaa can be any naturally occurring amino acid
MELGAAGMRRSASHNSLSGSDDFDLTHLLNKPRINVERQRSFDDRSLSDVSYSGGHARGGGGFDGMYSPGGGLRSLVGTPASSALHSFEPHPIVGDAWEALRRSLVFFRGQPLGTIAAFDHASEEVLNYDQVFVRDFVPSAMAFLMNGEPEIVKNFLLKTVLLQGWEKKVDRFKLGEGAMPASFKVLHDDKKGVDTLHADFGESAIGRVAPVDSGFWWIILLRAYTKSTGXLTLAERPECQKAMRLILSLCLPEGFDTFPTLLCADGCCMIDRRMGVYGYPIEIQSLFFMALRCTLLMLKHDAEGKDFVERIATRLHALSYHMRSYFWLDFQQLNDIYRYKTEEYSHTAVNKFNVIPDSIPDWLFDFMPCEGGFFVGNVSPARMDFRWFALGNMIAIVSSLATPEQSMAIMDLIEERWEELIGEMPLKICYPAIENHEWRIVTGCDPKNTRWSYHNGGSWPVLLWLLTAASIKTGRPQIAXRRAIDLAERRLLKDGXWPEYYDGKLGKYVGKQARKFQTWSXIAGYLVAKMLLEDPSHLGMIALEEDKAMKPVLRRSASWTN

SEQ ID NO: 14042 - protein, 971 aa, Oryza sativa (japonica cultivar-group)
MAAARLPSPAPVAHPPALRARPLAPHLYAALPRAPYPAWQWRGARAASPARREAVVRGAAVAEDEGVELADDDDGERGVGGGDGGSESFRTPARHPPAVAFAIGVGSHGIMVICWIGGGANEHPQPHGDLRFVSLSIFPFIDVTYLYNVVFTLVFFRKASLAMGASASSSVTSKLTNDGENQRVKYASSTMQGYCPTMQDALAVELDLDALRNTSFFGVYDGDGGAEVAMYCAKRFHAMLCEDENYLNNLPNAITSVCSRLDDDLQRSNEWKESLYPRGNGECFQFLKTGVCANLWHSEELGFMLPQQAYRAPLYEGSTACVVIIRGNQITVGNVGDSRCVVSHNGQAIDLSIDHKPTVGSERERILRAGGRVLVKRIPVMGSDGRLMRGWGYFELKKNQNIPASQQMVTCDPEFTIVDITADTEFLVIATDGIWGHMSSQDVVDFIRKELHSGEENLRAICEKLLDHCLTSRDNVTVILVRFKPGAAVIPILSDIDEEPVLSDVEEEPHEPQHNPGDGGGGQQDIGGESEELPLAHFPQEYLLPVYGDHPLLTGAVVQEPLPLPEGGDHPVPPKKKIKVAPLLPERADQPVVTSNSATTTRPQLCAPYDDEIEATLRAMETNPAERPSPYFLETTQGGRMTALVRASMIAFMDEFSRFHELADGTLQRAAYFLDRYLSVTPESDDALQLRLVGATAVFLAAKYEDQYTLRKIDASMVAARRGYTSETRHKMVSIMETEMLAALGFNLGGPTAYTFVEHFTRYYGDGEEEELLKEAAHRFADGSLLTYGFHRYLPSIVAASSIFLARLDVLGHEPWSQDLAELTGYKAIDLMGCGYYRSLSVSNSPSPCANPGNYIALVTLRVAEEMRPPLPPPARAERHGTGTVRVTRVKLLKPRDTLLLGQAYRLITVDEVTRVLQAKKEEKSRRAAAQHHLESKPAGAAGVGINSSGDDHTRPIRPAHLYIVSCRCSW

SEQ ID NO: 14043 - protein, 466 aa, Escherichia coli O157:H7 EDL933
MDKKQVTDLRSELLDSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 14044 - protein, 284 aa, Pseudomonas putida
MTTSTGKINLLGLTQPEMEQFFDSIGEKRFRAGQVMKWIHHFGVSDFAAMTNVGKVLREKLEAVAEIRPPEVVSEDISADGTRKWVIRVASGSCVETVYIPTDDRGTLCVSSQAGCALDCSFCSTGKQGFNSNLTAAEVIGQVWLANKSFGTVPAKVDRAITNVVMMGMGEPLLNFDNVIAAMKIMMDDLGYGISKRRVTLSTSGVVPMIDELAKHIDVSLALSLHAPNDELRNKLVPINKKYPLKMLLESCMGYMSTLGASACSPSSTPCSRTSTTSPSMPRR

SEQ ID NO: 14045 - protein, 517 aa, Triticum aestivum
  misc_feature (418)..(418): Xaa can be any naturally occurring amino acid
MAVSPLALVLLLLAFAVSLLYILRRPAPLRSGSDGGRRHLPPSPRGLPLLGHLHLLGSLPHRALRSLAAAHGPVLLLRLGRVPAVVVSSPAAAEEVMRARDLAFASRPRSAMADRLLYGRDVAFAPYGEYWRQARRVCVVHLLSPLRILSFRGVREEEAAALVERVRGAAAGGAAVDLCELLVAYANTVVSRAAFGDDSARGLYEEGNKERELRKVFNDFQELLGTAPLGELLPWLGWLDAVRGMEGKIRRTFKALDGVLEKVIGDHRRRRQAGQQTGDDGGDHRDFVDVLLDVSDTDDEAGMRLSTTEIKAIILDMFAAGTDTTSTAMEWAMAEVITHPDSMRKLQDELRAAVGGSGHVITEDHIDKLHYLKAVVKETLRLHPPIPLLVPREPQDDAEILGHHVPAGTRVVINAWAXGPGPGGRGSAPEEFVPERFLDGAVDYKGQDFQLIPFGAGRAGVPPGSDSPRRTVEMALASLMYHFDWEPAGASLDMREVNGLAVHLKSGLPLVAKLRFR

SEQ ID NO: 14046 - protein, 302 aa, Pseudomonas putida GB-1
MNAKVVVVGSLNMDLVARAQRLPRAGETLPGESFFTVPGGKGANQAVAVARLGGSVAMIGNVGDDDYGRQLHRALYVEGIDCQGVSTCPGVSSGVALITVDAASQNCIVIIPGANGLLTPRSVQRFDALLQAAEVIICQLEVPAETVAWTLARGHELGKQVILNPAPATGPLPADWFAHIDYLTPNESEAEALTGMAVTDQESARRAGERLLQLGAGKVIITLGAQGALRITAQGHQHYPASVVQPLDTTAAGDTFVGGFAAGLVRGLEEGEAIVFGQRAAALSVTRAGAQPSIPYLAELTP

SEQ ID NO: 14047 - protein, 400 aa, Streptomyces griseus subsp. griseus
MTGTGTGLTSRWQGALMDNYGTPRLPLVRGEGAHVWDEEGTRYLDFVGGIAVNALGHAHPAVVEAVSTQIASLGHVSNLFIAEPPVALAERLLQLFGRAGRVFFANSGAEANEAAFKIGRLTGRPHMVATDGGFHGRTMGALALTGQPGKQEPFRPLPGDVTHVPYGDADALRAAVTTDTALVIIEPTQGENGVVVPPKGYLEAAREITRATGTLLVLDEVQTGIGRCGQWFEHQAHQGVEPDIVTLAKGLGGGLPIGATVAFGPAADLLKPGHHGTTFGGNPVACAAGLAVIDTLAADGVLADVKRLGERIRDGVEALGHPLVSHVRGAGLLLGIVLTGPLAPQVQQAAQGAGLLVNAPAPDVVRLMPPLIIGDAEVDAFLEILPSALDAAHGDGRSGA

SEQ ID NO: 14048 - protein, 488 aa, Shigella flexneri 2a str. 301
MKKVNHWINGKNVAGNDYFQTTNPATGEVLADVASGGEAEINQAVAAAKEAFPKWADLPMKERARLMRRLGDLIDQNVPEIAAMETADTGLPIHQTKNVLIPRASHNFEFFAEVCQQMNGKTYPVDDKMLNYTLVQPVGVCALASPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPNDPNTQVRALISQQHWEKVSGYIRLGIEEGATLLAGGPDKPSDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 14049 - protein, 451 aa, Nostoc punctiforme PCC 73102
MVNSLDNNPPHKVVIVGGGFGGLYAAKTLAKAAVNVTLIDKRNFHLFQPLLYQVATGALSPADISSPLRSVLSKSKNTKVLLGEVNNIDPEAQKVTVGEEAIAYDTLIVATGAKHSYFGKDNWEEFAPGLKTVEDAIEMRSRIFSAFEAAEKETDPEKRRAWLTFVIVGGGPTGVELAGAIAELANQTLKEDFRNIDTSEAKILLLEGLDRILPPFAPELSQEAEASLTRLGVVVQTKTLVTNIENDTVSLKQGDEVKEIASKTVLWAAGVKASAMGKVLAERTGAECDRAGRIIVEPDLSIKGHPNIFVVGDLANFSHQNGKPLPGVAPVAKQEGEYVATLVQKRLAGNSLPPFAYTDHGSLAMIGHNSAVVDLGFIKLKGFVAWLFWLVIHIYFLIEFDNKLVVIIQWAWNYFTRNRGARLITGKESLTEFVISDRNNYSAENKQPVNV

SEQ ID NO: 14050 - protein, 494 aa, Sinorhizobium meliloti 1021
MLQALSNVLVTPAEMTAVDKDAARSGIDSFSLMRSAGTAVSAAALRLYPEALRFVVLCGPGNNGGDGYIAAAALADTGASVAVFALGDAAMLKGDAARARDAFALVPRPLDAYGPQSGDVVIDALFGAGLARDVPDEARTVIEQVNASGVPVLAVDLPSGIDGRTGEIRGLSFVAAHTVTFMAAKPGHLLMPGRARCGTLEIFDIGIPARLVADRAGDLHVNTPAMWEQHLGALDPATHKYKRGHLAVLCGGPVSTGAARLSAAAGLRAGAGLVTLASPAEALAVNAAHLTAVMLKEINNAAGLAAWLKDRRLNAFVLGPGFGVGKKARDFVLMLCGRALVLDADGISSFREGREQLFDRIAAEGGEVVMTPHEGEFARLFPDIAEDAALSKIEKAQAAARLSHAVIVYKGPDTVVAAPSGRAAVNVNAPPWLATAGSGDVLAGIIGAHLAQGMPAFQAAASAVWRHGEAGVVAGRTATAESLVESIAPLRGNA

SEQ ID NO: 14051 - protein, 454 aa, Coprinopsis cinerea okayama7#130
MPVSLVRVLSRGLHVSARRHALSQFNMPAMSPTMTEGGIASWKKKEGEAFSAGDVLLEIETDKATIDVEAQDDGILAKILAQDGSKAVPVGSVIAIIGEEGDDLSGAAALAEEAASKPQASPPKAEEKAPEQPKPQPTPAPEPVKVESKESLPKGDRIFASPIAKKIALERGIPLAKVKGTGPSGRIIREDVEKWKAPEAAAPAASATTAAAAAQPSVPSTDYVDTPVSNMRRTIGARLTQSKQELPHYYLTAEINMDKVLKLREVFNKTLGEKDKSAKLSVNDFIVKATACALSDVPEANSAWLGEVIRTYKKADISVAVATPTGLITPIVKDAGAKGLASISAETKALAKKARDGKLAPAEYQGGTFTISNLGMYGIDHFTAIINPPQSCILAVGATQARLVPAPEEERGFKTVQVMKVTLSCDHRTVDGAVGARWLNAFKGYLENPLTFML

SEQ ID NO: 14052 - protein, 469 aa, Sinorhizobium meliloti 1021
MTTANEVLKQIKENDVKFVDLRFTDPKGKLQHVTMDVVCVDEDMFADGVMFDGSSIGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKALNAFTNPSTNSYKRLVPGYEAPVLLAYSARNRSASCRIPFGTNPKAKRVEVRFPDPTANPYLAFAAMLMAGLDGIKNKLHPGKAMDKDLYDLPPKELKKIPTVCGSLREALESLDKDRKFLTAGGVFDDDQIDSFIELKMQEVMRFEMTPHPVEFDMYYSV

SEQ ID NO: 14053 - protein, 510 aa, Triticum aestivum
  misc_feature (188)..(188): Xaa can be any naturally occurring amino acid
MAFVSFLELSLSLLCFVVFYYFHARSKRKNPVIPLEWPLVGMLPALLANLPRLHDWVTSLLTASPLNFRFVGPPRSGMELFLTSDPANVRHVFTSNFANYPKGPEFAEIMDILGGGIFNADGDSWRRQRAKAQLLMSGPRFRAFVTRCSRRKVERDLLPAARPRRPAAAPGVCDLQDVFLRLTFDTTXTLVFGVDPGCLAIGFPEVPFARAMDDAMDVLLVRNVLPPSWWKLVRWLGVGYERKMAVAWRDIDRFIGETIAKRREAVKARGGIEDSADLLSSYIDDDDEASTVVDAFLRDTTMNLMLAGRDTTGSGLSWFFYLLTRNPGVVSKILAELDTVSSSTTTPDGMVTYDPDELGRLTYLHAALCESLRLYPPVPMEHKGVVAAEALPSGHEVRPGDKVMVSLYAMGRMEAVWGKDCREFRPERWIGEDGKARYVPSYKFVSFNSGPRTCLGKDMAFVQLKAVAAAVVRNFEVEAVPGHAVEPKISIILHIKNGFKARIKRRHADA

SEQ ID NO: 14054 - protein, 478 aa, Streptomyces avermitilis MA-4680
MASAFEYAPAPESRSVVDIAPSYGLFIDGEFTEAADGKVFKTVSPSTEEVLSEIAQAGEADVDRAVKAARKAFEKWSALPGSERAKYLFRIARIIQERSRELAVLETLDNGKPIKETRDADLPLVAAHFFYYAGWADKLDHAGFGANPRPLGVAGQVIPWNFPLLMLAWKIAPALATGNTVVLKPAETTPLSALFFADICRQAGLPKGVVNIIPGYGDAGAALVEHPDVNKVAFTGSTAVGKAIARQVAGTEKKVTLELGGKGANIVFDDAPIDQAVEGIVTGIFFNQGQVCCAGSRLLVQESVQDELLDSLKRRLSTLRLGDPLDKNTDIGAINSAEQLSRITSLVDQGEAEGAERWSPACELPSSGYWFAPTLFTNVTQAHTIARDEIFGPVLSVLSFRTPDEAVAKANNSQYGLSAGIWTEKGSRILAVASKLRAGVIWANTFNKFDPTSPFGGYKESGFGREGGRHGLEAYLDV

SEQ ID NO: 14055 - protein, 284 aa, Silicibacter sp. TM1040
MTKEVWNTERLHDHFAQSLRVSEMYYDSKTEHQRLKVFQNGTFGRVLTLDDVVQTTEGDNFIYHEMLTHVPILAHGAAKRVLIIGGGDGGIAREVLKHASVEHVTMVEIDAGVVDFSKEYLPMLSQGAFDDARLNLVINDGAVFMKETEDKFDVIIVDSTDPIGPGEVLFTDTFYGHAARALTEDGIIVTQNGVPFMQGDELTNTMRAFQALFQDATCYLATIPTYVGGPMALGWGSHSTKARSVDLTTLEARFAAAGLSPDYYTPEVHKAAFALPGYVKKLFP

SEQ ID NO: 14056 - protein, 335 aa, Caulobacter crescentus CB15
MAVRVAINGFGRIGRLVLRSIAEHGRRDIEVVAINDLGPVETNAHLLRYDSVHGRFPGVVTSGEDWIDVGMGKIKVTAIRNPAELPHKDLGVDIAFECTGIFTSKEKAAAHLEAGAKRVLVSAPCDGADKTIVFKVNDDTLSADDLVVSNGSCTTNCLAPIAKVIHDLVGIERGYMTTIHSYTGDQPTLDTMHKDLYRGRAAALSMIPTSTGAAKALGLVLPALKGKLDGSSIRVPTPNVSVVDLKFVPGRETTVAELNDALKAAAAGPLKGVLGVTDEALVSTDFNHIAESSTAALAQTQVIEGKLGRVLSWYDNEWGFATRMSDTALVMAKFL

SEQ ID NO: 14057 - protein, 396 aa, Caulobacter crescentus CB15
MTFRTLDTADLAGKRALVRVDFNVPVDGGKVADDTRLKAALPTIRFLADKGAKVVLLAHFDRPKGKVVPEMSLAFVAEPLAALLGAPVAFVGDCVGPAAAEVVNGLADGGVALLENVRFHAGEEKNDAEFAKALAANGDVYVNDAFSAAHRAHASTEGLAKLLPAYPGVSMQRELEALDAALGNPKKPVIGIVGGSKVSTKLDLLNNLVAKLDRLAIGGGMANTFLFAQGHDVGGSLCEKDLADTAREIMEKAKAAGCELLLPVDVVVAKKVAPGVETAVRSLSEVQADDLILDAGPESAKRLLAAMDQSLTLIWNGPLGVFEVPPFDEATVSAAKHAASLAKSGKIVAVAGGGDTVAALNHAGVSADFTFVSTAGGAFLEWMEGKTLPGVAALES

SEQ ID NO: 14058 - protein, 574 aa, Escherichia coli O157:H7 EDL933
MDIQKRVSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDRDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGLVLPELKDIQKVSRAIAFAVGKMAQQQGVAVKTSAEALQQAIDDNFWQAEYRDYRRTSI

SEQ ID NO: 14059 - protein, 129 aa, Silicibacter sp. TM1040
MQKVFNMHDLVKFSPETLKYNEAGLVPCIAQDVESGEILMMAWMNAESVAKTLETGRVTYWSRSRQSFWIKGESSGHVQELVELRVDCDRDALLAMVRQTGPACHTNRRSCFYTAIRDGEEHEIMTPIS

SEQ ID NO: 14060 - protein, 475 aa, Triticum aestivum
  misc_feature (118)..(118): Xaa can be any naturally occurring amino acid
  misc_feature (257)..(257): Xaa can be any naturally occurring amino acid
MAASSAPLAFSASASALSARLRLAAPAASCAATTRRRRPVVVRAKIREIFMPALSSTMTEGKIVSWAAAEGDRVAKGDAVVVVESDKADMDVETFYDGIVAVVLVPAGESAPVGAPIXALLAESEEDVALAVAQAQALSSGQPQQEAPALSDAAASPPPPAAPVAAAPAPVAAGTKGVATPQAKKLAKQHRVDLAKVTGTGQFGRITPADVEAAAGIQPKPKVAPTPAAAPVAAASSVKAVPQAAVLPPVPGATVVXPFTAMQAAVSKNMVESLSVPAFRVGYPILTDKLDALYEKVKPKGVTMTVLLAKAAAMALAQHPVVNASCRDGTSFTYNSSINIAVAVSIDGGLITPVLEQADKLDIYLLSQKWKELVKKARAKQLQPNEYNSGTFTLSNLGMFGVDRFDAILPPGQGAIMAVGASKPTVAADKDGFFSVKSKMMVNVTADHRIVYGADLAAFLQTFAKIIEDPESLTL

SEQ ID NO: 14061 - protein, 170 aa, Oryza sativa
LNLNYLQVNNVGFFFLKPAVNVTPEELSSVMAGNLESCFHLSQLVHPLLKASGKGNIVNISGISTVTNINRQIMLLLISGAMNQITKSLAVEWASDKIRVNCIAPGIIDTPLGDDGVSGTDFIQDDIARTPMRRVGKPEEVSSLVAFLCMPAAAYITGQIICVDGGRTLS

SEQ ID NO: 14062 - protein, 203 aa, Vibrio angustum S14
MQTIFFDFDGTLVDSERFHAVNWSQYLANHGVELSTDTFMSQYAGVTWPQIAEHFISQYNIPVTEMVMIEEMEALTETMIIEKGIPPMPGVDELLKTLSGKVPMAVVTGAPKDYVQGVLAQHGWLSLFEHVFSGYEVASNKPAPDVYLQACKTMNVLPENTVAVEDSRTGLMSALSANIHAVFVNSHNMKLPAHAQYSFTSMK

SEQ ID NO: 14063 - protein, 192 aa, Staphylococcus epidermidis ATCC 12228
MNYQIKRNTEETQLNISLANNGTQSHINTGVGFLDHMLTLFTFHSGLTLSIEATGDTYVDDHHITEDIGIVIGQLLLELVKTQQSFTRYGCSYVPMDETLARTVVDISGRPYFSFNSKLSAQKVGTFDTELVEEFFRALVINARLTVHIDLLRGGNTHHEIEAIFKSFARALKISLAQNEDGRIPSSKGVIE

SEQ ID NO: 14064 - protein, 793 aa, Pseudomonas putida GB-1
MKFSEQWLRGWVNPQVSRDELVARLSMAGLEVDSVTPAAGQFSGIVVGEILATEQHPDADKLRVCQVTNGQETFQVVCGAPNARPGIKIPFAMIGAELSGDFKIKKAKLRGVESFGMLCSAAELEISEENDGLLELAADAPVGEDIRKYLSLDDASIEIGLTPNRGDCLSIAGLARDVSALYDTPVTRPVVPAVAAAHDEVRPVEVSAPAACPRYLGRVIRNVDLSKPTPLWMVERLRRSDVRSIDAAVDITNYVMLELGQPMHAFDLAEINGGIRVRMAEEGEKLVLLDGQEVALRADTLVIADHTRALAIAGVMGGEHSGVNTEKTRDLFLESAFFEPISVAGKARSYGLHTDASHRYERGVDSQLAREAMERATQLLLDIVGGEAGPIVEAVSEQHLPQVAPVTLRAERITQMLGMEMDPAQVEQLLNALELTTTRNGEGQWTVNVPSHRFDISLEVDLIEELARLYGYNNLPVRYPQARLAPQGKPETRGDLPTLRRLLVARGYQEAITYSFIDPKLFELFSPGVEPLLLANPISSDMAAMRASLWPGLVKALQHNLNRQQDRVRLFESGLRFVGQLGDLQQQPMIAGVITGSRLPEGWANGRDGVDFFDVKADVEALLGYSGALSDFTFSAGKHPALHPGQTAAIERDGKLVGYLGAIHPELAKALDLDRPVFLFELVLGDVVEGRLPKFSELSKFPETRRDLALIAGRDVASSAVLELIRDNAGEWLTDLRLFDVYQGKGIDPDRKSLAVGLTWQHPSRTLNDDEVNTTLQNILTSLEQRLNTTLRK

SEQ ID NO: 14065 - protein, 211 aa, Staphylococcus epidermidis ATCC 12228
MNKLIDFSKGLVPVILQHAQTDSVLMLGYMNEEAYQKTLKEKKVTFFSRSKQRLWTKGETSGHFQHVESIHLDCDQDAILIKVMPQGPTCHTGSLSCFNSEIESRFKIQALAQTIHQSAKSNQSNSYTQYLLKEGIEKISKKFGEEAFEVVIGAIKHNREEVINETADVMYHLFVLLHSLDIPFSEVEQVLAHRHQKRNNFKGERKKVQEW

SEQ ID NO: 14066 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINDGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 14067 - protein, 282 aa, Zea mays
  misc_feature (152)..(152): Xaa can be any naturally occurring amino acid
MSHFGRTGPPDIRDTFSLLVLNISFRTTADDLFPLFERCGKVVDVFIPRDRRTGDSRGFAFVRYKYADEAQKAIDRLDGRNVDGRNIMVQFAKYGPNAVPIHKGRVKEGVEKSRDRSRSRSPRPRHRDRDDRRRSRSRSRSRERHVHDRDRXYRRRSRSRSRSMSSSPDHKSHRRARDDVKRKSRSKSRSRSRSRSRSYHRDDVKRKSRSKSRSKSRSRSRSRSYHSSSPARRSASPPKSPPPQRSPTPEKHANGKDSPLSRSVSPSPKRASSRSPGSDSKE

SEQ ID NO: 14068 - protein, 48 aa, Glomerella acutata
VIYEETRGVLKSFLEGVIRDAVTYTEHAKRKTVTSLDVVYALKRQGRT

SEQ ID NO: 14069 - protein, 50 aa, Glomerella cingulata
AIRRLARRGGVKRISAVIYEETRGVLKSFLEGVIRDAVTYTEHAKRKKVT

SEQ ID NO: 14070 - protein, 668 aa, Bacillus clausii KSM-K16
MTKTINVSQLSINTIRTLTLDAVEKAQHGHPGMPMGAAPMAYSLWKHFLNVNPENPNWFNRDRFVLSAGHGSTLIYSLLHLTGFDVTIEDLKNFRRLGSKTPGHPEYGVTPGIEATTGPLGQGIPASVGLAMAERHLAASYNREGFPVVDHYTYTICGDGDLMEGVSYEAASLAGHLKLGRLIVLYDSNDICLDGGLELAFSENIQQRFESMNWQYMKVEDGNDVDAIAKAIEEAKADETRPTIIEIKTVIGYGSSLQGTNNAHSDPMGKEEVAKTKKFYNWNYEEAFYVPEEVYADYATIRERGKQKEQEWNQLFSQYEAHYPELAQELKRIMEGQLPENWDEHLSSYEEGSSLATRVAGSEVLNAFVKRIPEFVGGSADLDSSTKTRLKEEIDFGNDRYGGRNIRFGVREFAMGAIANGLALHSLRPFVSTFFVFSDYLRPAIRLAALMGLPVTYVFTHDSVAVGQDGPTHEPVEQLASFRAMPGLTVIRPADANETKAAWKVAVEQTDRPTMLVLGRQNVPTLKDSDTLAEEGVRRGAYVISKAEGAPVGILVAAGSEVSLAINAQKELAKEGIYVNVVSMPSWDLFEKQSQKYKEGVLPSNLQTRLTIEMGSKLGWREYASTNGAVMSIDSFGESGPGEEVIAKFGFTVENVVDNFKQLLANVR

SEQ ID NO: 14071 - protein, 64 aa, Glomerella acutata
AIRRLARRGGVKRISAVIYEETRGVLKSFLEGVIRDAVTYTEHAKRKTVTSLDVVYALKRQGRT

SEQ ID NO: 14072 - protein, 202 aa, Prochlorococcus marinus str. MIT 9303
MSIFVGNLPFRAEQEDVIELFAPFGEVANCALPLERDTGRKRGFAFVEMADESAEPAAIEALQGAEMMGRPLRINKAEPRGSAPRRGGGGGYGGGGGGYGGGGGGYGGGGGGYGGGGGGYGGGGGGYGGGGGGGGGGGYGGGGGGGGGDRGSGARGWEDRSYGGAAPETSSYDDGRTRRRRGGAAPEGEGGDSYSGYGGAEG

SEQ ID NO: 14073 - protein, 365 aa, Dehalococcoides sp. CBDB1
MDFKLTVLPGDGIGPEVMDEGLKVLNAVAKKYKHTFKYQYGLIGGCCIDKEGVALSPAALAMCKKSDAVLLAAVGDPRFDDPKLPVHPEDGLLALRKGLGLFANIRPVKVAPSLVNSTPIKAEIVKGTDFIFIRELTGGVYFAKPKKRWTTPAGIRKATDSMTYSENEIERIVRVGFELAKNRKKKLVSVDKANVLLSSRLWRQIVIEVAKDYPEVKVEHVLVDACAMKLILAPTYFDVIVTENLFGDILTDEASMLAGSMGMLPSASLAGIPAKGTKIFGLYEPIHGSAPTIAKQNIANPIATILSIAMMLRYSCGLETEAVEIESAVDKVLAAGYATIDIFKEGNTKLGTAEMGNQITKMIGG

SEQ ID NO: 14074 - protein, 193 aa, Oryza sativa
  misc_feature (38)..(38): Xaa can be any naturally occurring amino acid
  misc_feature (50)..(50): Xaa can be any naturally occurring amino acid
  misc_feature (111)..(111): Xaa can be any naturally occurring amino acid
  misc_feature (129)..(129): Xaa can be any naturally occurring amino acid
  misc_feature (141)..(141): Xaa can be any naturally occurring amino acid
  misc_feature (166)..(166): Xaa can be any naturally occurring amino acid
  misc_feature (181)..(181): Xaa can be any naturally occurring amino acid
VDVGSRNFLIDHAVGSTSYGIDIMWAEAMGKLEGMDSXDRERLCAQLVQXGFKDLSYRLKVFFHYKFIYYPTSGSNLDFFLWEVTLNKMLQDGVLVSDSDSLSMTRDNVKXLQRHFQADTYPWIQRLKXRNELVIERRLLXRIMRIVEALENRGYRIPLTQEEADXLYERLAVIAKQLKGXNGDLHHETLSHF

SEQ ID NO: 14075 - protein, 451 aa, Streptomyces avermitilis MA-4680
MTPQPNPQVGAAVKAADRAHVFHSWSAQELIDPLAVAGAEGSYFWDYDGRRYLDFTSGLVFTNIGYQHPKVVAAIQEQAASLTTFAPAFAVEARSEAARLIAERTPGDLDKIFFTNGGADAIEHAVRMARIHTGRPKVLSAYRSYHGGTQQAVNITGDPRRWASDSASAGVVHFWAPYLYRSRFYAETEQQECERALEHLETTIAFEGPGTIAAIVLETVPGTAGIMVPPPGYLAGVRELCDKYGIVFVLDEVMAGFGRTGEWFAADLFDVTPDLMTFAKGVNSGYVPLGGVAISGKIAETFGKRAYPGGLTYSGHPLACAAAVATINVMAEEGVVENAANLGARVIEPGLRELAERHPSVGEVRGVGMFWALELVKDRETREPLVPYNAAGEANAPMAAFGAAAKANGLWPFINMNRTHVVPPCNVTEAEAKEGLAALDAALSVADEYTV

SEQ ID NO: 14076 - protein, 317 aa, Zizania latifolia
MRSSEVKNRTSTADITSLRLITAVKTPYLPDGRFDLEAYDSLINMQVDGGAEGVIVGGTTGEGHLMSWDEHIMLIGHTVNCFGTKIKVIGNTGSNSTREAIHATEQGFAVGMHAALHINPYYGKTSIEGLISHFEAVLPMGPTIIYNVPSRTGQDIPPAVIEAVSSFSNMAGVKECVGHERVKCYTDKGITIWSGNDDECHDSRWKHGATGVISVASNLVPGLMHNLMYEEQTAVLNEKLLPLMKWLFCQPNPIALNTALAQLGVVRPVFRLPYVPLPREKRVEFVRIVESIGRENFVGQKEARVLDDDDFVLVSRY

SEQ ID NO: 14077 - protein, 968 aa, Vibrio angustum S14
MSTLFNFGDTDLSTTVPVVNGLYDLTLDELLLSQEHYESDVRSYPRRLPLAIAKAAGVLVEDTRGQLFVDCLAGAGTLALGYNHPEINKAIVDQLESGLPYQTLDITTVAKDKFIKQLLSFLPESFANNACVQFCGPTGADAVEAAIKLAKQTTGRNTMAAFHGAYHGMTNGTMAMMGNLNTKSRRQGLMADVHFLPFPYSLRCPYGLSGDDGAKQSLRYIERMLSDDESGVQKPAAIIVEPVQGEGGVIPAPAFWLRELRRITQEQGILLIFDEIQCGIGKTGHNFAFEESGITPDILCLSKAVGGGLPMSVLVFNKEIDSWNPGEHTGTFRGNQLAMATGAKTLEIIERDGLIEHAQKAGMYLRRGLEKVAAQTSCIAEVRGKGLMLGIEIVQSDGSKNKFGEPVADPELTAAIQRSALERGLIIEKGGRQGSVLRFLPPLIISFEQLDFVINTIKEAIEVHVEPIEQGLVLESDNKANWKDHFIQTGKGGSESFETALNQTTQVLKKVFEQTNQPYSGMDPQLLKTLINGIDLNQPQSSLDAVIDQTGDLIAKHSIMVQHPHCIAHLHTPPLVPAIAAEAFIAALNQSMDSWDQASAATFVEQKIVDWLCDVYQLGQQADGVFTSGGTQSNLMGLLLARDWAADTISGHNIQQQGLPSYADKLRILCSKKSHFTVQKSASLMGLGEQSVVCVDTNPDGTIQLASLITTIEALKVDDLIPFAVVGTAGTTDHGAIDDLTGLADISARHNLWFHVDGAYGGALILSRHQSRLHGIEKADSLSVDFHKLFFQPISCGAVLVKDKAHFKYLLHHADYLNREDDLLPNLVDKSIATTKRFDALKVLMTMQSVGADALGEMYDHLINQTQHVADLVNQQPQFELLADPALSTVLFRFVGEGANLNEQQLNQLNKQLRIDALVQGQAVLGETVVDDKVALKFTILNPCLTINDFKTLLNKVSQLGQSLLSST

SEQ ID NO: 14078 - protein, 142 aa, Brassica napus
YCLLLQPERRRKSSEYSREQQDRTYEADTRSNASPFHPFKSPSPSPYHTPDRCREHNADHYEAMYEPEANTMFQNRAPGSPFHQAGNRSPSPYRTPDRHSNEQFEDMYERDGDVTPRNSSPPSPFHPAANRSPPPQSYRTVP

SEQ ID NO: 14079 - protein, 421 aa, Brucella melitensis 16M
MNHFEYRNGVLHAENVSLPEIAKAVGTPFYVYSRATIERHFRVFHDAFADMDTLVTYALKANSNQAVLTALAKLGAGADTVSQGEIRRALAAGIPANRIVFSGVGKTPREMDFALEAGIYCFNVESEPELEILSARAVAAGKVAPVSLRINPDVDAKTHAKISTGKSENKFGIPRDKARAAYARAASLPGLNVVGIDMHIGSQIIDLEPFDNAFALMAELVKELQADGHNIRHVDVGGGLGIPYRTPNTPPPPPVAYAQIVAKHIKPLGLKTVFEPGRLIVGNAGLLVTEVIFVKEGDAKNFVIVDAAMNDLIRPTLYDAFHDIRPVIMPNDNAPRIRADFVGPVCETGDYLGLDREVAKPAPGDLIAICTTGAYGAVLSSTYNSRLLIPEVLGDGERYHVVRPRRTYEELLALDSVPDWL

SEQ ID NO: 14080 - protein, 390 aa, Zea mays
MASTGAGAVLAVVVLACALGARADGSDHKYKEGDHVPLYANKWSFHPFVYHSKRFYTVLLWRRVLAFLVASQFLRIMTFYSTQLPGPNYHCREGSKLATLPPPNNALEVLLINFPRGVLFGCGDLIFSSHMIFTLVFVRTYHKYGSNRLIKLLSWFMAVIQSLLIIASRKHYTVDVVVAWYTVNLVVFFVDKKLPEMPDRTNGLSLLPVNTKDKDGRMKEELHKLEKDGRMMDEFHKLLNGNTVDATDWFITSLPCAFGESAMKKEIACCASVSERLLRKKRGVEVVVETIIESGSLRFSKRPQLQFCILQTFQKRRCMTVAHGKKLSHFYQTSSSFNRAKLHVTGRSPTFGYLELTCSTSMLPFGYADPSLTGRSNHSGYPNSQLPYNV

SEQ ID NO: 14081 - protein, 385 aa, Bacillus subtilis subsp. subtilis str. 168
MSSLFQTYGRWDIDIKKAKGTYVEDQNGKTYLDFIQGIAVSNLGHCHEAVTEAVKKQLDSVWHVSNLFQNSLQEQAAQKLAGHSAGDLVFFCNSGGQANEGAYKLARKATGKTKIITFLQSFHGRTYAGMAATGQDKIKTGFGPMLGGFHYLPYNDPSAFKALGEEGDIAAVMLETVQGEGGVNPASAEFLSAVQSFCKEKQALLIIDEIQTGIGRTGKGFAYEHFGLSPDIITVAKGLGNGFPVGAVIGKKQLGEAFTPGSHGTTFGGNMLAMAAVNATLQIVFQPDFLQEAADKGAFLKEQLEAELKSPFVKQIRGKGLMLGIECDGPVADIIAELQTLGLLVLPAGPERDSAAAPLTVTKDEIAEAVSKLKQAIAHHSAVNQ

SEQ ID NO: 14082 - protein, 725 aa, Streptomyces griseus subsp. griseus
MTDTGQIPGEGLPENAGMVEQPGIPAPDAYTFLDPSEHTPEDDDLLLMPTSQGAWSESQAAPAPAQGRPATQTAVAQPAAPEHAAPQPQPQVPAQQGQAAPAAAPAETHSTHESGGRDSGSVDLNGVRVTAPGPAPVGAHPAPAPAPAAARRPLHRGPSADAPAYGGTQGGVVRSLADRGPAGATRTAAPARHAGPPTAGPETVDVPPAQDPATLPGPQLGEIPPQAGAPWGAQPPEQTPAGQAVVAEVPAEQPVVDQVPAGQAAAGEVPAEQPVVDQVPAEQAAAATAQQPEPVVEAAPVAAEQPVTEEVAADPAAVAQPVAEEAAVDAQAEVQAAEQVQPAPPVQEARSAEPVAVSAPADLSAAPVEQPVQPAAEAQPEPAPQAVEAPQAVETPQTVETSQAVPAETVPGPVAVEMPAAAGPVVVPEPGAAPPEAPGQAPAEETAAPGTPEQVEGQAAAAVAPEPEARAVPVEAAAPASSAPAQDTQVVEPVAQPEPVQPEAAVRPEQEQLVAPSPEPVPAAAAAEGPEAAAAPEAVATPQTVVAEPVAEPSAEPVQPQPEPVVAEPVAHVASAEPVTEAEEGAEEAAVPEPTAGQLPVADHEASQAPAPVAEHGGATESGAADVLPPDAEDGTGPEVIETPEIPDPAQQEQAADRPARAEAPQHPEAAQQPEGPAEPAESAEESEPFTPPAPGYDDAEREAVLRVMRERRDIRNGFRGDPGS

SEQ ID NO: 14083 - protein, 275 aa, Brassica napus
KALFFMALRSALSMLKHDEEGREFIEKIVKRLHALSFHMRNYFWLDFQQLNDIYRYKTEEYSHTAVNKFNVMPDSIPDWVFDFMPLRGGYFVGNVSPARMDFRWFSLGNCVAILSSLATPDQSMAIMDLLEHRWEELVGEMPLKICYPCIESHEWRIVTGCDPKNTRWSYHNGGSWPVLLWMLTAACIKTGRPQIARRAIDLIESRLHRDCWPEYYDGKLGRYVGKQARKYQTWSIAGYLVAKMMLEDPSHIGMISLEEDKQMKPVLKRSASWTC

SEQ ID NO: 14084 - protein, 567 aa, Cryptococcus neoformans var. neoformans JEC21
MSAGPAQPNIYAPIRTSHSGYPSPTHSGSSTPASLEFSDGRLPESNVERDMSKVAERVALLGEVDDGAVIVEGEDKITKFVWTLVLAAAISGLLFGYDTAAISGMLVIIKDDLGTILSSWQKEAITSATTLGALLGGLAAGCISDFTGRRLVIVFANVAFIGGSICQAACHTVAVMIAGRFIVGLGVGLASCIVPLYIGELAPTMIRGRLVTINCVAITLGQVVAYAIGASFQNAHNGWRWIVGLGAMPSFVQLASIGFLPESPRILLLRSDVAGARAITAKIYPLAKVEQVDRKVEIMKAAVDQSIEYNANSTWFERLKSLVMVGTNRRALIIGCGLQAAQQLCGFNTLMYYSATIFAMLGFKNATAVGLIVATVNVLFTLVALKIVDPVGRRRTMLFTLPIMTLALVLAAIFFYYLTLSTNGILIEDHDYPRSLSIPVLLSMLLYVAGYATGLGNIPWQQGELFRLEVRGIGTSICTAVNWSCNMLIASTFLSLMDAATPSGAFGIYAGFCVIGWLFCWMLYPETSGLSLEEVYFVFEEGFGIEKSQQLRKQKLEESAKLKAIFE

SEQ ID NO: 14085 - protein, 876 aa, Cryptococcus neoformans var. neoformans JEC21
MNNSLLHHPSISSFIPRTLTMADQQLSQGNLPVFIDDLIADRTRQFVEFLDDETQAAYNYRESIKRMLDDEQVRLIVDINHIRSYERSYADGLLLQPMEYVPALDAALMQLVQSLHNPTKHKIEDKQFYVGLIGSFGQQHCNPRTLRSHQIGKMVSLEGIVTRCSLVRPKMLRSVHWSPRTQKFHARTYNDSTIIAPSANLTGTTTVIPKDDGDGHPLLMEYGLSTFRDYQTIGIQEMPERAPAGQLPRSIEVVLADDLVDCCKPGDRIQLVGVYKSSGGGAGARGFITSIIANNIILLSSKQGGGIAQTPLTDTDIRNINTQARRKNVFQLLSQSLAPSIFGHDYIKKAVLLLLLGGEEKNLDNGGHIRGDINILMVGDPSTAKSQMLRFVLNTAPLAIATTGRGSSGVGLTAAVTTDKDTGERRLEAGAMVLADRGVVCIDEFDKMSEIDRVAIHEVMEQQTVTIAKAGIHTSLNARCSVVAAANPIYGQYDVHKDPHRNIALPDSLLSRFDLLFVVTDDTDEQRDRMISEHVLRMHRYIQPGAEEGAPPIENLEQNLDVGGDAVESRISETPVFEKFNPLLHSGVTTTSGRGANKKKEVLSIAFVKKYIQYAKSRIHPVLTKGAADWIVNVYSSLRNDDMAANQKRTSPLTARTLETLIRLSTAHAKSRLSTRVDERDAMAAEEILRFALFKEVVRPERRKRRKINHAGQSVEVDSDEDEEGEEELQAGVERMSMNGDVGVTESQRERAREKNRRVERQAAGPVPEDDEDFEMREAEESLALQEAPRSPPTAPEVAVELSNERLDLFRSKLSHVFEESLDDNGAIEFVELMPKINEGMAEGEVFSVGEMKQALVRMDEKSEVMFGEDQTIYKI

SEQ ID NO: 14086 - protein, 230 aa, Oryza sativa (japonica cultivar-group)
MMVCGSVLHPDFQSSSQAHDFVGVKMQRAIQAIGSHGSLLKSAVLRHISAPKPSILPAVYSRSMSVSSAQIEESGFETATVADILKSKGKSADGSWLWCTTDDSVYDAVKSMTQHNVGALVVVKPGQDKSIAGIVTERDYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 14087 - protein, 323 aa, Zea mays
MHEMMPPHLDFEGQKTEEGRAVGPVMDTSFKDNDFEYLQIIKNEDLEELRELGSGAFGTVYHGKWRGSDVAIKRIKKSCFTGRSSELERLAHEFWREAEILSKLHHPNVVAFYGVVKDGPGGTLATVTEFMVNGSLRHVLQRKDKYLDRRKRLIIAMDAAFGLEYLHSKNIVHVDLKCDNLLVNLKDQSRPICKVGDFGLSKIKRNTLASGGVRGTLPWMAPELLNGSSNKVSEKVDVFSFGIVMWEILTGEEPYANMHYGAIIGGIVNNTLRPHVPASCDPEWRRLMEQCWAPDPAQRPAFTEIAGRLRSMSVAANQAKATK

SEQ ID NO: 14088 - protein, 167 aa, Zea mays
MDCFCEKTWSHTPQYKIGYCQQSPDRVAWPEQELDLPPQPPPLYFNAGMFVHEPSLRTARALLDALAATPPTPFAEQDFLNLFFRDAYAPLPPTYNLVLAMLWRHPDKVALHEVKVVHYCAAGAKPWRYTGKEPNMEREDVRALVAKWWDIFDDESLDYDKQQGAAP

SEQ ID NO: 14089 - protein, 665 aa, Listeria monocytogenes str. 1/2a F6854
MSRIDEQMVNSIRVLSMDMIEKANSGHPGLPMGAAPMAFSLWKNHLKFNPEHPTWFNRDRFVLSAGHGSAMLYSLLHLFGYDLPMSELKNFRQTGSKTPGHPEFGHTVGVDATTGPLGQGFAMGVGMAMAEAHLGAKFNQPEFPVVDHNTYVLCGDGCLMEGISYEAASLAGHLKLGKLVVLYDSNDISLDGDLNESFSEDIELRFRAAGWQTLRVDDGNDLDALDAAIHLAKTEKSRPTLIEVKTVIGYGSPGKAGKSAAHGSPLGEKELKLAKEAYDWQMPPFELPKTVENQKEFYHSKGRASESSWLRTFNAYKQKYPALAESLQQLMDDNLDTDWDAELPVFDENADKPVATREVSGIVLQELEKKLPNLFGGAADLASSNKTHLKASERFAPGNYAAKNISFGVREFAMGAAINGMTLHGGVQAFGATFFVFSDYLRSAIRSAALMGIPSTFIMTHDSIAVGEDGPTHEPIEHLASFRAMPGLHVIRPADGNETVEAYRFAFTQKEQPTMLVLSRQNLPILPNSAAKAKTGLAKGAYILADSPLDKLDIILLASGSEVHLMTAVRDNLAKKGFGARVVSMPSFDLFDKQSPEYKESILPKAVKKRFAAEMGASYGWHKYLGDTGEILAIDSFGMSGPGDELAERFGFTVENLTELALKQL

SEQ ID NO: 14090 - protein, 276 aa, Arabidopsis thaliana
MDSQMLVALGLSLVGGLSTSLGALFVVLSETPNMKMLGLLQGFASGLMLSISFLDLAHNAINSIGFFKANLWFFGGVIFFACITKFIPEPTLGPSTDGKRRKKNGDEGGKDMMKKHRKQVLYSGLITAIGISLHNFPEGMAVFLGSIKGMRVGVNLALAIALHNIPEGVAVALPIYFATESKWQAFKLATLSGLAEPLGVIIVAYLFPRSLSPEILEGLLGAVGGIMAFLTLHEMLPLAFDYAGQKQAVKAVFFGMACMSASLYFLELSLPETMSL

SEQ ID NO: 14091 - protein, 173 aa, Arabidopsis thaliana
MALRSVKTPTLITPVAVVSSSVTNKPHSIRFSLKPTSALVVHNHQLSFYGSNLKLKPTKFRCSASALTPQLKDTLEKLVNSEKVVLFMKGTRDFPMCGFSNTVVQILKNLNVPFEDVNILENEMLRQGLKEYSNWPTFPQLYIGGEFFGGCDITLEAFKTGELQEEVEKAMCS

SEQ ID NO: 14092 - protein, 265 aa, Zea mays
MAEEYKNNVPEHETPTVATEESPATTTEVTDRGLFDFLGKKEEEVKPQETTTLESEFDHKAQISEPELAAEHEEVKENKITLLEELQEKTEEDEENKTSVIEKLHRSNSSSSSSSDEEGEEKKEKKKKIVEGEEDKKGLVEKIKEKLPGHHDKTAEDDVPVSTTIPVPVSESVVEHDHPEEEKKGLVEKIKEKLPGHHDEKAEDSPAVTSTPLVVTEHPVEPTTELPVEHPEEKKGILEKIKEKLPGYHAKTTEEEVKKEKESDD

SEQ ID NO: 14093 - protein, 301 aa, Bacillus clausii KSM-K16
MQGIIPPLVTFFDENGSVDKETNFRLIDILIEKEVDGLLLLGSSGEFTSMTHQQKSDYIVHVIPYINKRVKCMVNVGSNVVEEAVDLAIKAEKAGADAVLIVNPFYWPLSEAQLIDYFSEIIQSIKIDAYLYNVPMLSSQEIPVNIIPELLERHDNLKGIKETVSDIGRYRKLIENVRPKNTEFVILTGFDDHLLPGMMIGTNGSINSTAVVFPEISVKLKKAMEQQHFEAVNRFQNLIAEAMQLYDINNSFFSTIKEAVSYRWFNGERVYHKKPFHLINANTRSEVERIVDNINRKWKED

SEQ ID NO: 14094 - protein, 552 aa, Chlamydophila abortus S26/3
MQSNSNDLNDVVIPGTPPLPRELQKFPSLIPTNDLRFSPKFDADVAKLFPNTYDSPYLKFTSGTPDQPVRPLKVGVMLSGGPAPGGHNVIWGLLHSLKKIHPDSSLIGFLNNGQGILNNHTIEITEEFMECFKNSGGFNCIGTGRTNIITEENKAVCLKTVQALDLDGLVIIGGDGSNTATAILAEYFSQHHPKTCVVGVPKTIDGDLQHLFLDLTFGFDSATKFYSSIISNISRDTLSCKAHYHVIKLMGRSASHIALECTLQTHPNITLIGEEIAEKNVPLNTIIHKVCSIIADRAAMGKYYGIILIPEGIIEFIPEINNLVKEIERIPEHADKFSSLSRESQKLLKSFPETIAKQLLNDRDAHGNVYVSKISVDKLLIHLVDNHLKKHFKNVPFNAISHFLGYEGRSCLPTKFDNTYSYALGYGAGVLTYNRCNGYLTVIESLINIVDKWRLRAMPIVKMFTTKKKSDGTIKPLIKKSLIDISSPAFVKFKLYRKIWALEDSYRVLGPLQIDTPPNSHSDHFPPLTLLLNHNEWQKRCSICMEIPDCDY

SEQ ID NO: 14095 - protein, 402 aa, Vibrio vulnificus CMCP6
MTIEILVPDLPESVADATVATWHKKPGDRVERDEVLVDIETDKVVLEVPASEAGILEAIVEEEGATVLSKQLIGRIKLAAVAGEPTADTTEESEPSPDKRHTASLSEESNDALSPAVRRLLAEHSLEASQVKGTGVGGRITREDIEAHLAAAKQAPAVAEAPAAVAPVAARSEKRVPMTRLRKTVANRLLEAKNSTAMLTTFNEVNMKPIMDLRKQYGDQFEARHGIRLGFMSFYVKAVTEALKRYPEINASIDGDDIVYHNYFDISMAVSTPRGLVTPVLKDCDTLGFADVEKGIKELAIKGRDGKLTVDELIGGNFTITNGGVFGSLMSTPIINPPQSAILGMHKIQDRPMAVDGKVEILPMMYLALSYDHRLIDGRESVGFLVTVKELLEDPARLLLDV

SEQ ID NO: 14096 - protein, 541 aa, Chlamydophila abortus S26/3
MELLSVNKSYFELQRLHYRPETLRFLQGITSLHIVDSVSTASPQVPKDLQEHIPYLCNIPEVTIEKGKAKPSQPLKIGVLLSGGQAPGGHNVVIGLFEGLRAFNPKTKLFGFIQGPLGLTRGLYKDLDISVIYDYYNVGGFDMLSSSKEKIKTKEQKSTILTTVKKLKLDGLLIIGGNDSNTDTAMLAEYFLKNNCHIPIIGVPKTIDGDLKNFWIETPLGFHTSCRIYSEMIGNLEKDALSIKKYHHFVRLMGQKASYTTLECGLQTLPNITLISEHLAMRKISLQKLSEHLAMGLVNRYRSGKNYSTILIPEGLLEHIFDTKKLINELNVLLLDNTLNFDNVNKQLSPESLKTFSALPTEIAQQLLIARDSYGNVRVSKIATEELLAALIKKEIQKIEPKMEFQSVNHFFGYESRAGFPSNFDANYGLALGIVSALFLVRQRTGYMVTINNLALPYSEWSGGATPLYKMMQLEQRLGEEIPVIKTDSVNPNAPEVQYLLNQSDTCLMKDMYSFPGPLQYFGEERLIDQRPLTLLWGNKT

SEQ ID NO: 14097 - protein, 297 aa, Zea mays
MESSKSPQSSKNSRIVVPSDSNRSRFDNDGFSSETASNQMVVFNSEAADELGENRLQKSVITKGISPSIGAFTVQCAKCFKWRLIPTKEKYEEIRERIIQEPFVCKRAREWRPDITCNDPEDISQDGSRLWAIDKPNIAQPPHGWERQIRIRGEGGTKFADVYYTSPTGRKLRSLVEVDRFLQENPEHVAQGVTLAQFSFQIPRPLRQDYVKKKPKLINASDEASTITSKSYEPEEVNPIAWAVPTKHEGDASEEASFADETLASEVVLTRKRKIGSSLSVEPNHLSDELEPKLEDA

SEQ ID NO: 14098 - protein, 143 aa, Glycine max
  misc_feature (23)..(23): Xaa can be any naturally occurring amino acid
  misc_feature (25)..(25): Xaa can be any naturally occurring amino acid
ALNLALGSLPQFTICNRAGAGGXVXFTVPLFTAGLPTRKTNNDITNIVSNGGRVRCMQVWAPVGKKKHETLSYLPDLDDAQLAKEVEYLPRKGWIPCLESEREHGLVYREHIRLPGYYDGRYWTMWKLLMIGCTDASQVLKEL

SEQ ID NO: 14099 - protein, 378 aa, Prochlorococcus marinus str. MIT 9303
MADYYDLLGVSKDADGDTLKRAYRRLARQYHPDINKDPGAEDRFKEIGRAYEVLSDPQTRGRYDQFGEAGLGGAGGMPDVGDMGGFADLFETFFSGFGGAGGSGGGRPRRRGPQQGDDLRYDLKIDFEQAVFGQEREIKIPHLETCDTCNGTGAKVGSGPTTCSTCGGVGQVRRATRTPFGSFTQVAECPSCEGTGQVISDPCGACAGQGVRQVRKKLRINIPAGVDTGTRLRVAGEGNAGLRGGPSGDLYVFLTVKSHPQLRRDGITVLSEVNVSYLQAILGDIIEVDTVDGNTSLEIPAGTQPNAVLTLENKGIPKLGNPVARGNQRISINVKLPLRLSDEERGLLEDLAGHHSAKGRQHHHHNSGLFARLFGQKG

SEQ ID NO: 14100 - protein, 494 aa, Gibberella zeae PH-1
MAISPASSGLDNDTRGWIMCVVSGIACVVGASILFSALYSMLPESKEYFEQAKWSKQAAGLTMMACFVGGFIGIQGVSRLLHQFMPTHVVECDHSHDENATKDTSCQHDRRQSRARRGSSRPPSSQAPIDKSLPKLVTSQSPNIATESTPLLESSLDSPTSTLKRQASTRDELRRPASPIRSRTTTDAFPERRKSIREVHKRVMSFVQDTKCNCDESNSCYGFSDPCGQECFKHLNNRVSLPSRPGRQTQVLRTTTGSFLRGNEHSHAHHDHPHGEECEESIEPFARPTYRISRAKSREPIEPTVPEEVSDHDASCSSAADDEDVEAQHHHHVPTNAFLSIGLQTSIAIALHKFPEGFITYATNHVNPSLGFNVFMALFVHNITEGFAMCLPLYMALGSRWRAMAWSAFLGGLSQPLGAGIAALWFKVADGTNMQPNAVAYACLFAVTSGIMVSVALQLFVESLSLNHSRNLCIFFGFLGMALLGFSNALVGSH

SEQ ID NO: 14101 - protein, 533 aa, Dehalococcoides sp. CBDB1
MEIAREKSGAKSECIDSGEETLRESIVIFDFGSQYSLLIARRIREMHVYCELVSHDTPWEKIAHLNPRGFILSGGPSSVYEPEAPLAPAYIFESKLPVLGICYGMQAITQQLGGVVEHSDKREYGHALLHSNVINTELLADMPEPSPVWMSHGDRIEKLPAGFKSLAYTENCPVAVMGNESDIYGLQFHPEVVHSPHGKIILKNFVFNICKCHANWTMGNYIQESIQNIREQVGDGQVICALSGGVDSAVVASLIHKAIGDQLTCIYVNNGLLRREEADRTLHVFKNHMGMKIIYVDAIDRFLESLGGITDPEQKRKVIGSEFIKVFEDEACKLGQIDFLAQGTLYPDVIESVSSVSKASAKIKSHHNVGGLPAHMKLKLIEPLRYLFKDEVRLLGKELGLPDEMIWRQPFPGPGLAIRIIGEVTREKLEILRSADWIVMSEIKKAKMYHQVWQSFAILTDVKSVGVMGDFRTYGYLVAIRAVTSEDAMTADWAKLPYDLLSIISNRIVNEVKEVNRVVYDISSKPPSTIEWE

SEQ ID NO: 14102 - protein, 638 aa, Oryza sativa
MATTTTVKPLLPVKQPVPSDIEIAQSIKPRHISQIAELGLGLLPEEYELYGPTKAKVKLSVRDRLKDAPNGKYVVVGGISPTPLGEGKSTTTVGLCQALGAYLKKKVLTNIRQPSQGTTFGIKGGAAGGGYSQVIPMEELNLHLTGDIHAISASNNLLAVAIDARMFHEAAQKDEALFRRLCPTDKQGKRHFAPVMLGRLQRLGIDKTNPDDPTPEEVSRFVRLDIDPEQVMWRRVVDINDRFLRGITVGQGPEERGQERKTGFDISVASEIMAVLALATDLADMRSRLGRMVVAQARQGQPVTADDLGVGGALTVMLKDAIEPTIMQTLEATPVLVHAGPFANIAHGNSSVIADQIGLKLVGPDGYVITEAGFGADIGLEKFMNIKCRASGLAPDAAVIVATVRALKMHGGGPPVVAGTPLAHAYLAPDVDLVKAGCSNLVRHIQNTRKYGVPVVVAINAFASDSQEELEAVRAAALDAGAFDAVVTTHHALGGAGAVELAQAVIKACSQPAEFQFLYDVDLPIKGKIEAIACGTYGAASVSYSPEAEAAIEKFTAMGFDKLPICMAKTQYSFSHDATLKGAPSGFTLPIRDVRASAGAGFLYPLVGNMMTMPGLPTRPCFYDIDIDLATGRIVGLS

SEQ ID NO: 14103 - protein, 196 aa, Dehalococcoides sp. CBDB1
MTKRTASIKRQTTETTISLSLNLDGTGQADMCTGVRLFDHMLSQLAKHGLFDINISANGDDIHHLVEDVALTLGKAFNEALGERKGIVRMADATVPMDDSLASVALDLSGRGYAVMDLSFAKNDLTGFPTDLVRHFLETFAIEGRLNLHARILYGSNDHHKAEALFKALARALDKATSIDPRREGVAPSTKGMLEN

SEQ ID NO: 14104 - protein, 572 aa, Oryza sativa (japonica cultivar-group)
MDLKERIRRSPTPPTQGEELLAASPAGPRGGRKGRAVVLPLSAAALVACAVVLLLLAGGSAARRGQFVGADPTVLPSRGGGVGDLHLSQSKSNDGENVTIASSEVVNDKLLGGLLTTGFDEQSCLSRYQSVLYRKASSHFPSAYLLERLREHEALQKKCGPHTESYKKAIEQLKAGQGAKVMECNYLVWVAYSGLGNRILTMASAFLYAILTRRVLLVDSDKGTADLFCEPFPETSWLLPPKFPIKQFKNFSNGSPESYGNMLKNKAIRSNPAFLYLHMAHDYSDYDKLFFCEDNQQYLRNIPWLILKSDNYFVPSLFLIPAYQEELTRLFPQRDSVFHHLGRYLFHPSNVVWGMVTRYYDSYLARADERLGIQIRVFDPEPGPFQHVLDQVLACTLKENLLPAINSKQPIVSTRHSRLKSVLITSLNSGYYEKIRSMYWEHPTTNGEMISFHQPSHEEHQNSDKKMHNMKAWAEIYLLSLSDVMVTSAWSTFGYVAQGLSGLRPWLLFKPENRIAPDPPCRQVLSMEPCFHAPPFYDCKAKRGADTGKFVPYVSHCEDMSWGLKLVDQSEW

SEQ ID NO: 14105 - protein, 289 aa, Lactobacillus acidophilus NCFM
MTAFTYFKDEWTPVIDNYLAKHLASEIDDQKISQIMSYSVMAGGKRLRPLLFLATLNALGKKIEESEIRLACGIELIHTYSLIHDDLPAMDNDDYRRGKLTSHKKWGEAEAILAGDALLPLGVQWIAEGSNSSELVIMITKAIGANGMVGGQYLDIDSTNNASVADDEKFINKMEWLKTGCLIQASVEMAAVYAKASDIEQVKLVDFAKTFGRSYQIYDDLVDVVETSEEAGKATHKDEEEGKNNTLTLLGIEKSRKELKDLISQAKADLHGINNEVLLGFLDLYHKVL

SEQ ID NO: 14106 - protein, 366 aa, Zea mays
MAPLHAALPPPSSAAAHHHAAAPHVFLARSPYHPRRAAASCPLAVAAAPSSRKDEKKVASDFLPRRAARPAFLSCPLLGHWTTAAPPRAIPSSSSSSTPALIASVQDLYDFICCGPLVDRIGYTSEKITESIDRWLLAGARVARLFRLNELQLSDAEKARIYHFYIPVFLWCEDEVMVHRARYNDGDDIPPLVIGVSAPQGSGKTTLVFALDYLFRVAGRNSATLSIDDFYLTAKEQNELRDRNPANALLEFRGNAGSHDLQLSVETLESLIKLTKEGMKMKVPRYDKSAFGGRGDRADPSVWPEVEGPLELEVVNKNLEAYSDAWDRFIQSWIVIKIREPGSVYQWRLQFLSLAEVAMRADGKPG

SEQ ID NO: 14107 - protein, 432 aa, Zea mays
MDEDAGGASPPPVPLAHVPPLQQPTTAAPSHRDMAASPTSSRSVTETVNGSHRFVIQGYSLAKGMGVGKHIASETFSVGGYQWAVYFYPDGKNPEDNSVYVSVFIALASDGTDVRALFELTLLDQSGKGKHKVHSHFDRSMESGPYTLKYRGSMWGYKRFFRRTALELSDYLKDDCLKINCTVGVVVSTIDYSIPHSIHVPDSDIGYDFGSLLDSQEGADVILNVGGERFHAHKLVLAARSHVFGSQFFDDESDGEKSEVNETDELKEFSIDDMEPNVFKAMLHFIYRDTLVDDDELGASSSDGSIFDTPAAKLLAAADKYHLARLKSLCESYLCKGISVASVASTLALADRHHAMELKAVCLKFAAENLSAVMRSEGFIYLKDNCPSLQSEILKTVAGCEDQCSSVGKSQSVCGQLSDGGDSSCRRVRQRT

SEQ ID NO: 14108 - protein, 384 aa, Arabidopsis thaliana
MALQATTTTFCFSGPTFRSTPHSLTSKRPISIKATTSSPSRLSNSRSNLKGRALSSDGSTQESPYVVCFGEMLIDFVPTTSGLSLADAPAFKKAPGGAPANVAVGIARLGGSSAFIGKVGEDEFGYMLANILKDNNVNNDGMRFDPGARTALAFVTLTNEGEREFMFYRNPSADMLLEESELDFDLIKKAKIFHYGSISLITEPCKSAHISAAKAAKEAGVILSYDPNLRLPLWPSADNAREEILSIWETADIIKISEEEIVFLTKGEDPYDDNVVRKLFHPKLKLLLVTEGPEGCRYYTKDFSGRVHGLKVDVVDTTGAGDAFVAGILSQLANDLSLLQDEERLREALMFANACGALTVKVRGAIPALPTKEAVHEALLKAVV

SEQ ID NO: 14109 - protein, 429 aa, Vibrio vulnificus CMCP6
MADKKATLHVEGKAPIELPIMEGSLGTPVIDVRKLGANGYFTFDPGFLATASCESQITYIDGGKGILLHRGYPIDQLANNADYLEVCYILLYGEAPTREQYEKFKTTVTRHTMVHEQIASFFHGFRRDAHPMAVMCGVVGALAAFYHDSLDINNDLHREITAYRLLSKMPTLAAMCYKYSTGQPFIYPRNDLSYAENFLHMMFATPCEEYEVNPVVARAMDKIFTLHADHEQNASTSTVRLAGSSGANPFACIAAGIASLWGPAHGGANEACLKMLEEIGSVDNIPEYVDRAKDKDDPFRLMGFGHRVYKNYDPRATVMRETCHEVLKELNIQDPLLDVAMELERIALSDEYFVSKKLYPNVDFYSGIILKAIGIPVSMFTVIFAISRTIGWIAHWNEMHSDPLNRIGRPRQLYTGEVQRDFQPMHERE

SEQ ID NO: 14110 - protein, 376 aa, Prochlorococcus marinus str. MIT 9303
MTLCQVWAASSSGTAESATYFCMIGGHFPCGFPVFVMTLRVAINGFGRIGRNFMRCWLSRGVNTGIEVVGVNVTSDPKTNAHLLKYDSILGQIKDAEIDYTDDTFVINGKPIKCFSDRNPLNLPWKEWGIDLVIESTGVFNTDVGASKHIEAGAKKVILTAPGKGDGVGTYVVGVNADQYRHGDFNVLSNASCTTNCLAPIVKVLDQNFGMEWGLMTTIHSYTGDQRILDNSHRDLRRARAAALNMVPTTTGAAQAVALVYPEVKGKLTGFAMRVPTPNVSAVDLTFGTSKGPSVDDVKAVMKSASENGMKGIIKYSDLPLVSTDYAGTNESSIFDADLTYAMGDKAVKILAWYDNEWGYSQRVVDLAEIVAKNWK

SEQ ID NO: 14111 - protein, 113 aa, Brassica napus
  misc_feature (70)..(70): Xaa can be any naturally occurring amino acid
  misc_feature (79)..(79): Xaa can be any naturally occurring amino acid
  misc_feature (81)..(82): Xaa can be any naturally occurring amino acid
  misc_feature (86)..(86): Xaa can be any naturally occurring amino acid
MSYSAAGFGKPGSGKRRIRELLTQSDNRFCADCGAPDPKWASANIGVFICLKCCGVHRSLGTHISKVLSXVTLDEWQMXKXXPCPXIAGNDLPLRGLYDGPPPRHLMLTHPPP

SEQ ID NO: 14112 - protein, 634 aa, Rhodopirellula baltica SH 1
MCGFTGGLWQRDDQAINADLLSRMTNEIAHRGPDDSQIWMDPEHRDATGRPMGVGLGFRRLSIIDVEGARQPLSNEDGRVRMVFNGEIYNYEVLRKRLQGAGHQFATQGDGESIVHLYEDIGTDCFSSLNGMFAIAIWDARRNRIVLARDRIGQKPLYYSYKNGRLVFASELKALRLVPGVCEEVDPNAIDEFLTYQYIPHPGTIFKGVHKLPPGHFAVLDERGLRVERYWNFDPSIERPLGREEAIEKVRDLLADSVRLRMRSDVPLGSFLSGGIDSSLITALAGDHTDTPLRTFSIGFPVADFDETRYAAQVAEHLQTDHTRFEVQPSGIDILEKLVWHYDEPYGDSSAVPTWYLSKLTRESVKVALSGDGGDELFAGYERYRALWMSQKIARLFPLNKFPGIGLIQRLPDSNRRRSVVRRAKRFLEAIDQPVVRRYMNWLQIFPESMRASMYNDEFVQALPGHDPVDFLESVWARSEGRDVVTRASTSDIQSYLPCDLCTKVDIASMAHGLEVRQPMLDYRFVELAASMPVEHKFRGRRGKLILQDAFGDRIPSSIFTRPKMGFGIPIGQWFREDFKPLVHDTMLASDARINAYFRPEAIADLVRSHETGEQNHGYRLWNLLVLETWLRQL

SEQ ID NO: 14113 - protein, 496 aa, Arabidopsis thaliana
MEIIIISLCLATILAFLLLKPLLNRTAAKDNLPPSPWRVPVIGNLHQLSLHPHRSLRSLSHRYGPLMLLHFGRVPILVVSSSDVAHDLMKTHDLKVANRPRLKVIETILNGGREVVFSPYGDYWRQIKTVCVVHLLNKKMVQSFAKVREEERSVMMERVEKASSDSSPLNLSKLLITLTSDVASRVSLGRKYSKEESMSDFKIQMRKITELVGGFPVGEYIPCLAWIDKLRGVDEKAEEVSKAFGDLMEKVLQEHLDATDKPTLDFVDVLLSLERHERNGVQIRRSDIKFLILDMFLAGTATTYALLEWTMTELIRHPECMKKLQDEIRAEATNLTLYRSHEDVEDMKYLKAVVKEGLRLHPPFPLLVPRLLTQDVKLKGYDIAAGTQVITNAWAIQRDTVTWGIDAEEFRPERHLDSPLDFRGTNFEFIPFGSGRRICPGIGFAMALVEVTLANLVNRFNWRMDARLSGDEYDLAEATGLDVCRKFPLIVFPSPA

SEQ ID NO: 14114 - protein, 1753 aa, Arabidopsis thaliana
MASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEVTSKSLKLVFSLVFFCCINKQKLKLISRLEMLNNFLPCEKDFISSILATSSTSFYSHCASISTSHFTMIPNGELRLPALKVREDRVSPSAPIPVTRTLVADTDVTSDDDMSTNSEDVSLDSSPENSRVSSAVGRSYGRNSSYYTYSEVSSSRETLVGAREQTGPRFDGDTEEDESTDSASSTQFSPPPAAGRINDGVSQVEQTHFPKTDRRATVEKEFDETFSSEEVSDIPSAPPFSGAAEESEEIKPATSSVQVSEVKTGDCVESRKTGHFTRPSAASESSGPPDQHPARLPTFHARLQQLLLQSEEELLAKRSSQAPHEGVAPKPKKNIGKMKVQVRRVKTVMDGPTGCSISSLKPSLIKFEKIRIHFSNMSTRLFSGWRALRKIHVRVPANGSSLPRQSLAYVHASTQYLKQVSGLLKTGVTSLRNNSTSYDIVQETYSCKLRLKSLAEDNAIMMQPGSGESHVFFPDSHGDDLIVEILDPMGKDFGRVLVQLANISEDSYVSSDSNEETIQAEKLRWWSVFREPEHQHVGKLQLYIDYSASFDDNSHLKCASVAETVAYDLVLEVALKMQRFQQRNLLLYGSWKWLLEEFATYYGISDVYTKLRYLSYVMDVATPTSDCLHLVHDLLTPVIMKGNGKSALSHQENRILNEIKDQIEQILKLVFENYKSLDESSFSGMIDVVNSASGVPAPALIPAVKLYTLLHDVLSPEDQTHLCHYFQAAAKKRSRRHMGETDEFVANNSEPNFWDMSAMSAAYQKMTMACKNVKNEIYTDIEIQNEDILPSFLDLPNLSASIYSTDLCNRLRAFLVACPPSGPSPTVAELVIATADFQRDLSSWNISPIQGGVDAKELFHLYIMIWIQDKRLSLLESCKLDKVKWSGVRTQHSTTPFVDEMYKRLNETIQDYQVIISRWPEYIFVLESAIADVEKATVEALEKQYADVLSPLKENLAPKKLSFKYVQKLTKRSVIPYVVPDELGILLNSMKRMLDVLRPNIEAKFKAWSSCIPDGGNAAPGDRLSEVTVMLRAKFRSYLQAVVEKLVENSKLQKTTMLKKILQDSKESVGESDIRSKMNNLKEQLTNTVNHLHSVCETHVFIALSRGYWDRMGQIVLSFLENRKENRAWYKGSRVAVSILDDTFAAQMQQLLGNSLREQDLEPPRSIMEVRSILCKDPADNKAKSFYY

SEQ ID NO: 14115 - protein, 341 aa, Lactobacillus acidophilus NCFM
MAKTRPEDLDWNNLGFKYHDLPFRWVDKFQDGKWQGGQLTSDSTITFNEAAEELHYGQEIFEGLKAYRRKDGGINLFRPDQNAKRMTKSAERLLMEPYPEDKFIEAVKQVVLANQEFVPPYGSGGTLYLRPFMMGTQSIVGVAPSETYEFRIYATPVGAYVKGLNPMPYVISDYDRAAPYGTGQAKTAGNYASSLMPSLLAKKAGFADALYLDPKEHKYIDEFGGANFFGITKDGQFQTPKSDSILPSITKHSILKIAADLGLDPIETKIPIDNIDQFAEAGAMGTAAVISPVGSLTYQDKKYSFGNEKEAGPITQKLYDTLTGIQFGDLEDKYNWTIKLS

SEQ ID NO: 14116 - protein, 229 aa, Methylobacillus flagellatus KT
MGNLVLFDLDGTLVDTAPDLGLALNLQRKRHGLPFLDQDIIRPYASHGSKGLLAIGFNITPEDANFAAMRDEYLALYEEVYTRTPMLFEGMETLLQRMESAGLRWGIVTNKPRRFSAPLLAALKLEQRMACLVCADDVPRAKPHPDSLLAACEQAGVLPEVCIYIGDAQRDIAAGIAAGMPTVAALYGYLDQADRPLEWGADYVVHEVAEIETCLVAWQQRLADRCEEH

SEQ ID NO: 14117 - protein, 127 aa, Vibrio vulnificus CMCP6
MKEIISTPAAPAAIGPYSQGTIYGEVVYTSGQLPLVPETMQFVEGGIKEQAKQSLDNLKAVLEASGAGLDSVLKTTCFLSDMENFAAFNEVYTEVFGTENAPARSCVEAARLPKDALVEIEAIAYKK

SEQ ID NO: 14118 - protein, 549 aa, Vibrio vulnificus CMCP6
MAMHPRAGQKALQEDLHNIPALVANYFLLQPDPTNPAHKVEFGTSGHRGCADKSTFNEHHILAIAQAVAEVRAEQGTTGPLFVGKDTHALSEPAFSTVVEVLIANGVTVIVQEQNGYTPTPGISHAILTYNLQHEEKADGIVITPSHNPPQDGGIKYNPTHGGPAEGELTQRIENRANVLIAEGLQGVKRMPLAQAKASSLFVEQDLVKPYVDDLVNVIDMAAIQKAGLKLGVDPLGGSGIDYWRQIGKAYNLDLTLVSEAIDPSFQFMSLDKDGVVRMDCSSPYAMAGLLALKDQYDLAFGNDPDYDRHGIVTPTKGLMNPNHFLAVCIDYLYRHRQGWAADVAVGKTLVSSAMIDRVVADLGRELCEVPVGFKWFVDGLYNGKFGFGGEESAGASFLRQDGTPWSTDKDGIILCLLAAEITAVTGKNPQQYYDELAAKHGESQYSRIQAVANGPQKEVLKKLSAEMVKAETLAGDEITARLTHAPGNGAAIGGLKVTTANGWFAARPSGTEDIYKIYCESFKGAEHLKQIELEAQEIVNQVFAEAGL

SEQ ID NO: 14119 - protein, 476 aa, Rhodopseudomonas palustris CGA009
MVNRMQFYIDGAWVDPVVKKSTPVVNPATEEAMYEVALGSKADVDKAVAAAKRAFETFSVTSREERIALLEKVVAIYKSRMKEIGAAISDEMGAPLPMAEKMQAGAGLGHIMSTLDVLKNYQFEEPLGSAMIVREPIGVVGMITPWNWPLNQIACKVAPAIAAGCTMVLKPSEFTPTSALLFAEILHEAGVPKGVFNLVNGLGPEVGAAMSEHPDIDMISFTGSTRAGIDVAQRAAPTVKRVSQELGGKSPNVILEDADLTKAVTGGVMHMFNNSGQSCNAPSRMIVPLSKMKEVAAIAKGVAEKTKAGDPRGEGTTIGPVVNRIQWDKIQTLINKGIEEGATLVAGGPGLPEGVNKGFYVRPTVFADVTKDMTIAREEIFGPVLVIMGAKDENEAVELANDTPYGLAGYVSAGSVDRARAVGRKIRAGNVNLQGVPNERTAPFGGYKQSGNGREWGKFGLEEYLEVKAIAGFNAA

SEQ ID NO: 14120 - protein, 543 aa, Malus x domestica
MGCYSSKENAPKPGSKGFGSSQPYQQPQTAAQPQKVSSQQPHNPPPPPRPQPQQRAQPAPQPRAQYQQPSPPPAKPAPQPNSILGKPFDDIKQYYTLGKELGRGQFGITYLCTENSTGHSYACKSILKRKLVSKNDRDDIKREIQIMQHLSGQPNIVEIKGAYEDRYSVHLVMELCAGGELFDRIIAQGQYSERAAAAILRDIVNVVHICHFMGVLHRDLKPENFLLSSKDEKAMLKATDFGLSVFIEEGKVYRDIVGSAYYVAPEVLRRSYGKEIDIWSAGVILYILLSGVPPFWAETERGIFDAILEGVIDFDSQPWPSISDSAKDLVRKMLTQDPRKRITSAEVLEHPWLRVGGVASDKPLDSAVLSRMKQSRAMNKLKQLALKVIAENLSEEEIKGLKTMFTNMDTDKSGTITYEELKTGLARIGSRLSEAEVRQLMDAADVDGNGSIDYIEFISATMHRQRLERDEHLYKAFQYFDKDSSGYITRDELEAAMKEHGMGDDNTIREIISEVDADNDGRINYSEFCAMMRSGAQQPAKLF

SEQ ID NO: 14121 - protein, 325 aa, Bradyrhizobium japonicum USDA 110
MEGPAMAAPLDPVIAQIIPLLPLRDPTTMTPQSARDSLRALAAARAAVPPPPVDTVQDIKVKGGAGPLDARLYRIGSDPAPTVVFFHGGGWVAGDLETHDRQARNLAIETGAVVVSVDYRRPPETRFPGAFEDAFAAARDIFNRVAEFGGDAKRLGVAGDSAGGNLAAATAIACRDAGIKLAAQLLVYPVTDVAGHYADARENARFPSRAENADGYFLSRAVMEWFCGHYLADPGHGADWRVSPLRAASLAGLAPAIVATASFDPLRDEGAAYARALEAAGVRVKHHEGPGLIHGYFGLGDASDVARAEAQRARADFKALLARGI

SEQ ID NO: 14122 - protein, 516 aa, Escherichia coli O157:H7 EDL933
MFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETAS

SEQ ID NO: 14123 - protein, 633 aa, Gibberella zeae PH-1
MAQELKAGGGASEVTRSIPKLDPVVTGHLVKLFGSLADRADNTWSKERVSSFIKDTQKDGPSPAVDDLLARDSLDLDGFITWMTSSHAAATTPPKPQDLTYPLASYFISSSHNTYLTGNQLSSDSSTKPYTETLLRGGRCIEIDVWDGDESEPEGTSSPSSSDEERGVKKVVRKKRSTFGKLKDKLKKTSISDKKDSASASTTDPVSREPGAVTNAEPESTEPEAAIVEPRVLHGYTLTKEISFRAVCEAIRDSAFVVSDLPVIVSLEVHCNAEQQLAMVRIMKQVWEGLLVAEPENDPENLPSPDELRHKLIVKVKYAPPDTDSTQEESEEDDRAPHPGAESGDPPKKKPSKVIQELSKMGFHCRGVSFKSLSQPEAGMPTHIFSLSEKKVIDVHEEQADALFNHNRHFLMRTYPWGLRIGSSNLDPSVFWRKGIQVVALNWQRWDEGMMLNEGMFAGTGGYVLKPLGYRPNRNDEVVSNTIPRQTLHLTITVIAAQNIPLPPGDKSARGFEPYVKVELHVEGPDEFHGGPIPNDGHEREGEYKARTRTQKGDVVDFGSEPLEFPPIPHVVDELSWVRFTIRDDEIGRDDMAAWACMRVDRLGHGYRFVHLMDCEGCLTDGAILIKVDKRLE

SEQ ID NO: 14124 - protein, 586 aa, Glycine max
  misc_feature (379)..(379): Xaa can be any naturally occurring amino acid
MKEKMSWTVADAVDYKGFPADRSKTGGWVPAALILGIEIVERLSTMGIAVNLVTYMISIMHLPSSTAANTVTDFMGTSFLLCLLGGFLADSFLGRYKTIGIFASIQTLGTATLAISTKLPGLRPPPCHANSDSCKQANGFQMGILYLSLYLIALGTGGLKSSVSGFGSDQFDEKDEKEKSQMAYFFNRFFFFISFGTLAAVTVLVYLQDEVSRSLAYGICSVSMIIAIIVFLSGTKRYRYKRSLGSPIVHIFQVIAASIKKRKMQLPYNVGSLYEDTPEASRIEHTEQFRFLEKAAIVAEDDFETNLCGSGPNPWKLCSLTRVEEVKMMVRLLPVWATTIIFWTIYAQLITFSVEQASTMERNIGSFQIPAGSVTVFFXVAAILITLAVYDRLIMPLWKKWNGKPGFTDLQRIAIGLVFSIFGMAAASVCERKRLSVAKSVSGGNQATTTLPISVFLLIPQFFLVGSGEAFIYTGQLDFFITRSPKGMKTMSTGLFLTTLSLGFFFSSFLVSVVKKVTGTRDGQGWLADSINKGRLDLFYALLTILSFVNFAAFAVCAVWFKPKKPKQPAAMQMGPVNGSTAEEKC

SEQ ID NO: 14125 - protein, 146 aa, Bartonella henselae str. Houston-1
MNIIAQLEAEQCAKIAAKRQLPAFQPGDTVRVMVRVTEGTRTRVQAYEGVCIARSGGGLNETFTVRKISYGEGVERVFPVYSPLIEGVELVRRGKVRRAKLYYLRNLRGKAARITEKKDQRKKSAKIVEKEQEALVRVEAPAHATE

SEQ ID NO: 14126 - protein, 81 aa, Glycine max
DNPPPLPANDSSGKSFIDLVLKSSEEDMKGWPHSFEFRLRVSLTTDGDLTLISRVRNINGKPFSFSFAYHTYLMVSDIRYG

SEQ ID NO: 14127 - protein, 376 aa, Escherichia coli O157:H7 EDL933
MLQRGGDGCKQNQSCEPATIDGFMPKAQESIMGQQKQRNRRWVLASRPHGAPVPENFRLEEDDVATPGEGQVLLRTVYLSLDPYMRGRMSDEPSYSPPVDIGGVMVGGTVSRVVESNHPDYQSGDWVLGYSGWQDYDISSGDDLVKLGDHPQNPSWSLGVLGMPGFTAYMGLLDIGQPKEGETLVVAAATGPVGATVGQIGKLKGCRVVGVAGGAEKCRHATEVLGFDVCLDHHADDFAEQLAKACPKGIDIYYENVGGKVFDAVLPLLNTSARIPVCGLVSSYNATELPPGPDRLPLLMATVLKKRIRLQGFIIAQDYGHRIHEFQREMGQWVKEDKIHYREEITDGLENAPQTFIGLLKGKNFGKVVIRVAGDD

SEQ ID NO: 14128 - protein, 947 aa, Zea mays
MAASVSRAICVQKPGSKCTRDREATSFARRSVAAPRPPHAKARRRHPLRLRRGTGPHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARWWGKCCVSGCSGIRVNDAEKLVTIGSHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLTYQRSDFEGIFRAMDGLPVTIRLLDHPSYEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVHLAQGILQHDPFEVLDQRGVGELVKFATERGRKARPNLKVGICGEHGGEPSSVAFFAKAGLDFVSCSPFRVPIARLAAAQVLV

SEQ ID NO: 14129 - protein, 605 aa, Dehalococcoides sp. CBDB1
MSQSSVRNFCIIAHIDHGKSTLADRLIEMTGTLRHDEMCEQVMDSMELERERGITIKAKAIRLRYISKDKQEYRLNLIDTPGHVDFSYEVSRTIAACEGAILVIDATQGIQAQTLANVYLAIEYNLEIIPVINKIDLPGADIPRVMGEIKSVLGYDEDSVLQISAKLGLGVPELLEAIVNKVPAPKGNANQPLRALIFDSHYDPYKGVVAYLRVADGNINKGDDLRLMGQGTEFRVLEAGYFAPAQVAALRLDVGDVGYIATGLKSVGECRVGDTVTLQHGGAIQPLIGYHPAKAMVFAGIYPTQTDDYHELREAMEKLSLNDASLSSEPESSPLLGHGFRCGFLGLLHLDIIVERLEREFNLSLVVTSPGVSLTVTRIGGEAFTVVNPNEMPLPHEIARIEEPWVSVVIITPSKYIGTVMDLVRENYGVYKNTEYLGQLAMSELGQRVQLHYDMPLRSILTTFHDQLKSRTQGYASLDYEFIGYRDANLSKIDVLVNDVPVDAFSRIIPPDKAHEIGEALVKKLKEMIPRQLYQVTLQAAIGSKIVARADISAKRKDVIAKCYGGDITRKRKLLDKQKEGKKKMRQIGKVEVPKEAFLSVLKLQ

SEQ ID NO: 14130 - protein, 475 aa, Glycine max
MESIAAQLKRGISRQFSSGSLRRNLSWQFTRQASLDPRRNNQRFSFGRQSSLDPIRRSPCSGNAELTVPENLDSTMQLLFMACRGDVKGVEDLLNEGIDVNSIDLDGRTALHVAACEGHVEVARLLLSRKANLDARDRWGSTAAADAKYYGNTEIYYMLKARGAKVPKTRKTPMTVANPREVPEYELNPVELQVRKSDGISKGTYQVAKWNGTKVAVKILDKDSYSDPDTINAFKHELTLLERVRHPNVVQFVGAVTQNIPMMIVREYHSKGDLASYLQKKGRLSPSKVLRFALDIARGMNYLHECKPDPVIHCDLKPKNILLDSGGQLKIAGFGTVRFSLISPDEAQLVQPEPNIDLSSLYVAPEIYKDEVFDRSVDAYSFGLILYEMIEGTQPFHPKSSEEAVRLMCLEGKRPAFKIKTKHYPPELKELIEECWDPTPVVRPTFSQVIVRLDKIVANCSKQGWWKDTFKLPWK

SEQ ID NO: 14131 - protein, 474 aa, Escherichia coli O157:H7 EDL933
MQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINVLFGRGKTVGDPLTGHPKVRMVSLTGSIATGEHIISHTAPSIKRTHMELGGKAPVIVFDDADIEAVVEGVRTFGYYNAGQDCTVACRIYAQKGIYDTLVEKLGAAVATLKSGAPDDESTELGPLSSLAHLERVSKAVEEAKATGHIKVITGGEKRKGNGYYYAPTLLAGALQDDAIVQKEVFGPVVSVTLFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 14132 - protein, 631 aa, Triticum aestivum
MSPNLEGTLKSQVPALLLRRLFGAGARRDEAAAKQHHGRQAPSPSPPAPAGRRRVFVQTESGCVPSADAWGGDNAHTVKRRLQLALNVPTGGTSLTFGDRVLENDLSSVRHDSPLLLTRNSIHRSCSTPCLCPVSEDFEQKDCGGLVEILGSSSGSVRRLVDDVASGIMGGLDPVPIDSGLGGSYYFRNDEGDRVAIVKPTDEEPFAPNNPKGFTGRALGQPGLKKSVRVRETGFREVAAYLLDHENFANVPATALVKITHSVFNINRPMNGGTPAHDHKPQVTSKIASFQQFIAHDFDASDHGTSSFPVAAVHRIGILDIRIFNTDRHGGNVLVRKLDGGTGRFGCQTELFPIDHGLCLPENLEDPYFEWIHWAQASIPFSEEELEYISKLDPMRDAAMLRGELPMIREACLRVLILCTIFLKEAAAFGLCLAEIGEMMTREFRGMEEEPSKLEVVCMEARRKVDEWEPFSPSVEQGEDMDFQFSMDVLGGYSDVIRSPRFNCSGLKGSFRNPLTKLVESMNEDGDDEEDRKEPSMHSSDRFSSAEFSTPSLHRTTSSKTSSNSSVHAPNRSADEQLPSSLCFVRLSDMSAEEWHVFVEKFQELLKEALEECKAAAGQRMKQRLGTSCKF

SEQ ID NO: 14133 - protein, 647 aa, Desulfitobacterium hafniense Y51
MKYYITTPIFYPNASPHIGTAYTTVAADAFARYHRLKGHDVYFLTGTDENAQKIVRTAESQGMEPLAYVDGVVERFKALWEELDISYDDFIRTTEERHHEVVKKIFTKLYEQGDIYKSEYEGWYCTPCETFWTENKLIDGKCPNPDCGRDVELLKEESYFFKLSKYQDALLRHIKDHPDFIQPASRRNEMIKFIEGGLEDLCVSRTTFQWGIQVPFNPKHVVYVWLDALINYISALGYPDGELYQRYWPAEVHLMGKDIVRFHAVIWPIILMALDVPLPKVVYGHGWYLSKEGGKISKSRGNVQDSFKLIRRYGSDAIRYFLLREMQVGTDGAYSEDSLVERLNSDLANDLGNFVSRSLAMIVKYRGGVIPKAGEPTELEAELRALGQEVVAKVEERLEAHDPAGALENLWRLVSRMNKYVDETAPWTLAKQEGQQERLDTVLHTFAEAIRVLGILCAPFMPKLTGKMFRQCGISDELLAWEAAKEWDVLGEGIQVQRGEALFPRIDLAQFSIEEEKASVNEIKETPAVEENKVEFEPIKEEISIDDFAKIDLRVAKVLHAEKVEKTDKLLKLEIEVAGKPRTIVSGIAQHYAPEDLVGKHVVIVANLKPAKLRGITSEGMILAASHEGVLEVLVLDKELPAGARVK

SEQ ID NO: 14134 - protein, 408 aa, Vibrio angustum S14
MSRIVIVGGGAAGLELSTLLAKTVRKEDEIILVEPETHHFWKPRLHEIAAGTFDSDLDTVCYFTHGARHGYQHYQAAMTDIDRDNKMLSVRRPDGTEAALKYDYLVIAIGAVSNDFNTTGAKDHCLFLDSASQARQAWHQVSLILRASEDRSVNIVGAGATGVELAAELARVSQKLQRYNGAPLHINLIEAAGRVLPNSPEKMSEKVQKELERNNVNVLLDTRIREVTEKGMLTVDNRELNADVQFWAAGVKAPDWLNGIGGLSYNRMNQIQVNANLTTTVDDSIFSLGDCASIPQADGSFVPPKAQAANRAAVHLAKSLGGMLRGKPLTDFEFKDGGMVVAVGHHFAVGSFAPGSKMEGKMVLQGRLIRRLYDTIFRLHQRTVTGMFTVSRLMIAKRLKAVFKPSGI

SEQ ID NO: 14135 - protein, 366 aa, Oryza sativa (indica cultivar-group)
MATDGTGVVTVYGSGTNGAALLEPSNHKSATFSVKVGLAQMLRGGVIMDVVTPEQARIAEEAGACAVMALERVPADIRAQGGVARMSDPGLIRDIKRAVTIPVMAKARIGHFVEAQILEAIGVDYVDESEVLTLADDAHHINKHNFRVPFVCGCRDLGEALRRIREGAAMIRTKGEAGTGNVVEAVRHVRSVMGDIRALRNMDDDEVFSYAKRIAAPYDLVMQTKQLGRLPVVQFAAGGVATPADAALMMQLGCDGVFVGSGIFKSGDPARRARAIVQAVTHYSDPRSWRRVAEEPAEVTMVYGGSRREARGKSRRWQDMPISASRRPCNLPLLHEVGSDEHEARSGELEAHELAQPMPRRGGSPS

SEQ ID NO: 14136 - protein, 307 aa, Triticum aestivum
MAGRFDLQGRHGKSRVRVSRVWRRPADAGGHLFVEWSVAVSVVSDCLPSYTSDDNSAIVATDSIKNTVYVKAKECTEVVSMEEFAVILGRHFTSLYPQVSEATVTIVERPWERVAVDGKPHSHGFKLGSEKHTTEVTVKKSGSLLINSGIQGYSLLKTTQSGFEGFVRDRYTLLPETRERIVATEVTAWWRYPFEHISQLPSKPFCFTQRYQDVKKVLADTFFGPPEVGVYSPSVQNTLYLMAREVLTRFPDIASVQLRMPNLHFLPVNLSGKENPGLVKFADDVYMPTDEPHGTIEATLSRANSKL

SEQ ID NO: 14137 - protein, 382 aa, Glycine max
  misc_feature (199)..(199): Xaa can be any naturally occurring amino acid
  misc_feature (211)..(211): Xaa can be any naturally occurring amino acid
PRNSARGHFGLKSFHKDNAFLLTTRAVSVAQEVVRCMLPQSIRNDPDKARGIRVTVSYLGGNVRHPVRVLVPSVARVSSPGGGGRVQKRNRKMHELCACTMVWNQASALREWVTYHAWLGVERWFIYDNNSDDDIENVVQDLDLQGFNVSRKSWPWIKTQEAGFSHCALRAREECKWVGFFDVDEFFYFPSEFQQPLGXGVFLGENYLRSXVANFSYSKSIAEIRTACHSFGPSGLKSPPKQGVTLGYTCRLQSPERHKSIVRPDLLDISLLNVVHHFQLRVGFRYHNMPEGTAIVNHYKYQVWETFKAKFFRRVATYVVDWQEDQNKGSKDRAPGLGTEAIEPPNWRRQFCEVWDTGLKDFLVSYFAEPATGLMPWEKSSL

SEQ ID NO: 14138 - protein, 376 aa, Vibrio angustum S14
MTDKFIKSKAAIAWGPKQPLSIEEVDVMLPRAGEVLVRIVATGVCHTDAFTLSGDDPEGIFPAILGHEGGGIVEMIGAGVTDLQVGDHVIPLYTAECGKCKYCLSGKTNLCQAVRETQGKGLMPDGTTRFYKDGQPIFHYMGCSTFSEYTVLPEISLAKISKEAPLEEVCLLGCGVTTGMGAVLNTAKVEEGSTVAVFGLGGIGLAAIIGATMAKASRIIAVDINEEKFELARKLGATDCINPMKFDKPIQEVIVELTDGGVDYSFECIGNVNVMRSALECCHKGWGESVIIGVAGAGQEISTRPFQLVTGRVWRGSAFGGVKGRSELPGIVDRYMAGEFQLDDFISFNMGLDKINEAFDLLHEGKSIRTIIHFDK

SEQ ID NO: 14139 - protein, 440 aa, Glycine max
FSHFCFFFFSSFFGSSLLLFSPKHKREREEEERIMEGEGAAVWQGAVLGGIIFWLVSASYLNVTRKLRSFLQPWVTHHVVTQTPIILKIQSYGFGFLDALFSGLSCVVSVPFYTAFLPLLFWSGHGKLARQMTLLMAFCDYLGNCIKDVVSAPRPASPPVKRVTATRDEEDNALEYGLPSSHTLNTVCLSGYLLHYVLTHTQIQGAYVTYLGVSLACMLVFFIGLGRIYLGMHSVVDVLAGLLIGLVVLAFWLTVDEYMDSFVISGQNVTSFWAALSFLLLFAYPTPELPTPSFEYHTAFDGVALGIVSGVQQTYHQFHHANVPRLFSSELTIPVFLGRMLLGIPTILIVKFCSKTLAKWTIPVVANTLGIPIKSTGYIPTLNGSVTGKMSDKLKQGYLQKLLSQHKAFDVDTGIRFVQYAGLAWSVVDLVPSLFSYMSL

SEQ ID NO: 14140 - protein, 151 aa, Trichodesmium erythraeum IMS101
MQNIAEIMDNYVLWVALVACLMAQFLKIVVELVQHRQINLRVLFTSGGMPSAHSAFVAALAVGVAQTKGWGSPEFALALVFAIIVMYDAAGVRQAAGLQARILNQIIDEFFQEDHHLNQDRLKELLGHTPMQVIVGFCLGVAVSWVASFNY

SEQ ID NO: 14141 - protein, 554 aa, Vibrio vulnificus CMCP6
MCSVFGILDIKSDAAALRPIALEMSKKLRHRGPDWSGIYASDRAILAHERLAIVGLNSGAQPLYSPDKKLILAVNGEIYNHKEIRARYEGKYDFQTDSDCEVILALYQEMGADLLEELNGIFAFVLYDEEKDQYLIGRDHIGIIPLYQGYDEHGNYYVASEMKALVPVCKTISEFPPGSYYSSTDAGPQRYYIRDWNEYAAVQGNTSSKEELTAALEAAVKRQLMTDVPYGVLLSGGLDSSITSAVAKRYAAMRIEDDEQTEAWWPQLHSFAIGLDGAPDLKAAREVAAKIGTVHHEMTYTIQEGLDAIRDVIYHIETYDVTTIRASTPMYLMGRKIKAMGIKMVLSGEGADEIFGGYLYFHKAPNAQEFHEETVRKLLALNMFDCARANKSLAAWGVEGRVPFLDKEFIDVAMRLNPADKMCGNGKMEKHILRECFEHYLPDSIAWRQKEQFSDGVGYGWIDTLKAVAEEKVTDQQMEAAKFRFPYNTPTTKEGYVYREIFEELFPLTSAAECVPGGPSVACSSAKAIEWDESFKNCIDPSGRAVKAVHNEAY

SEQ ID NO: 14142 - protein, 536 aa, Hyphomonas neptunium ATCC 15444
MTLPPNQPVRSFAPGSPERASLIAELARQRANPRRVLPVINGKKVDTGTSTDMREPHAHANSLGTYASAGAPEAQAAITAAIDARHDWSRMDTAARRAVFLRAAELLAGPFNDRLLAATMLAQSKTAFQSEIDASCELIDFLRFNVAFAEQIEAMQPLSSPAERNRLEHRPLDGFVFAAAPFNFTAIAGNLAIAPALMGNTVVWKPSERAVYSAAFLMDLFEAAGLPPGVINMLPAETPAAIGDTVFSSPHLAGVHFTGSTAAFDRIWQTVGSNVSRYRSYPRLVGETGGKDFVFAHVSADVDALVTALVRGAFDYQGQKCSAASRAYIPLSLWKPVTERLAEIVSSLTMGNVSDLTNFMGAVIDQRAYTQISAFLDHAASAPGHRKIAGAAPSDETGWFIPPTVIACTDPKSRIMTEEIFGPVLGLYAYPDGKLAETLALVDQSTPYALTGAIFAQDQAVINQLSLALRDSAGNFYINDKPTGAVVGRQPFGGGRRSGTNDKAGSPFNLLRWSSPRTVKETFVPPVSHLYPHMAG

SEQ ID NO: 14143 - protein, 528 aa, Prochlorococcus marinus str. MIT 9303
MSNSQSEGQRQPAIVILDFGSQYSELIARRVRETEVYSLVMSYSTSADELRQLAPKGIILSGGPSSVYAERAPLCDPNIWDLGIPVLGVCYGMQLMVQQLGGRVEMATGKAEYGKAPLEIDDPTDLLTNVENGSTMWMSHGDSVRALPEGFVRLAHTANTPDAAVAYHTRSLYGVQFHPEVVHSTDGMSLIRNFVYHICGCEPDWTTTAFIEEAVSQVRSQVGDKRVLLALSGGVDSSTLAFLLKKAIGDQLTCMFIDQGFMRKGEPEFLMDFFDRKFNINVEYINARQRFISKLNGIVDPEEKRKIIGTEFIRVFEEESNRLGPFDYLAQGTLYPDVIESAGTNIDPKTGERVAVKIKSHHNVGGLPKDLQFKLVEPLRRLFKDEVRKVGRSLGLPEEIVRRHPFPGPGLAIRILGEVTDEKLNCLRDADLIVREEIREAGLYHEIWQAFAVLLPVRSVGVMGDQRTYAWPIVLRCVSSEDGMTADWSRLPDELLERISNRIVNEVRGVNRVVLDITSKPPGTIEWE

SEQ ID NO: 14144 - protein, 438 aa, Kineococcus radiotolerans SRS30216
MGAPAVPLLLLALVLVVAAGLVAAAESAIAGTSRRRARELEADGRRGAAELDRVLGSATSVLTVATLLRVVFETLAAVCVAVVVASWVDSWWLVLLLAGLGMSALDFVLVGVGPRTLGRLHAETVARRAAPVLGPLTTVLGPLARALVAVGNAVTPGRGMRQGPFGSEAELREIVELAGETSVIEAGERRMINSVFELGDTLVREVMVPRTDVVSARRGAGLHEVEALLLRSGFSRMPVIGEDADEVLGIVYLKDVARRFHTDPVAARAERVETVARQTVFVPDSLPVDELLRQMQRDTTHVAIVVDEYGGTAGLVTIEDVIEEIVGDIADEYDRAAPDVEPLPDGGFRVSSRLHVEDLGELFEKEIEDEDVDTVGGLLAKTLGEVLVPGAVAEVHGLRLEADARVGRRNQVRTVLVHRLPEHEPELVDDHAGGHQHD

SEQ ID NO: 14145 - protein, 282 aa, Medicago truncatula
MFFVNLLLLLCRFLWNCISCSVDVAVKVFSKQEYSEDVIQSFRQEVRSPVSLMKRLRHPNILLFMGAVTSPQRLCIVTEFLPRGSLFRLLQRNTSKPDWRRRVHMAVDIARGVNYLHHCNPPIIHRDLKTSNLLVDKNWTVKVGDFGLSRIKHETYLETKTGKGTPQWMAPEVLRNEPSNEKSDVYSFGVIMWELATEKIPWDTLNAMQVIGAVGFMNHRLEIPEDIDPQWASIIESCWHTDPALRPTFQELLERLKELQRRYAIQFQAARSAGGEKTQKES

SEQ ID NO: 14146 - protein, 247 aa, Gibberella zeae PH-1
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQAQEVHKAIRDLLRSISDKVADETRILYGGSVNEKNCGELSKQADIDGFLVGGASLKPAFVDIINATKQ

SEQ ID NO: 14147 - protein, 102 aa, Oryza sativa
MVRMNSLADALKTLYNAEKRHKRQVLLRPCSKVIVKFLTVMMKHGYLGEFEIIDDHRAGKIVVNLNGRLNKCGVISPRFDCSINDIETWTKNLLPSRQFGYV

SEQ ID NO: 14148 - protein, 83 aa, Triticum aestivum
MAMNNCCITMKFPNTPPMPGLGVLSCPEDGQDRNASLTCSRPNAVSATDQSTPEPAIPHHTKHTHDSDAPYYVALPKFEDCFL

SEQ ID NO: 14149 - protein, 203 aa, Cryptococcus neoformans var. neoformans JEC21
MVLVLVIGDLHIPNLVHDLPAKFKKLLVPGKIGQIICTGNVCDKETYDYLRTTAPEVHVVRGEFDENPHFPLSLIIQHQSLRIGVVHGQQVVPAGDPDMLAALARQMDVDVLISGGTHRFESFEFEGRFFVNPGSATGAWSSLWNGEVTPSFALMDIQGPVIVTYVYQLVDGEVKVDKVEYRKPDPTSEIQSQSTRSEVAARW

SEQ ID NO: 14150 - protein, 379 aa, Coprinopsis cinerea okayama7#130
MSDTAGKTIKCKAAVCWGAGEPLKIEEVEVAPPRAHEVRIRILYTGICHTDEYTRSGKDPEGLFPVILGHEGGGIVESVGEGVTSVAVGDHVIPLYTAECRECKFCKSGKTNLCGKVRATQGKGLMPDNTSRFSINGKPIHHFMGTSTFSQYTVVADVSVVAVNKKAPLDKVCLLGCGITTAWGAVVKQPGIKDSTVAVFGCGAIGLGCISTASVVGASRIIAIDTNPKKESWAKQFGATEFINPLDLPEGKKIQDHLVEITDGGLDFTFDCTGNVQVMRAALEACHKGWGVSTVIGVAAAGQEISTRPFQLVTGRVWRGSAFGGVKGRTEIPGLVEDYLNGKLKVDEYVTHHRKLEELNEGFHDMHSGECIRCVVDMQ

SEQ ID NO: 14151 - protein, 677 aa, Oryza sativa
MGARWGPRRATVGPHLRDALRHLLFVFLVLLQAQAGRGGATLNGEGMALLELRERVEADPHGALRDWDPADATPCRWSGVHCFDGKVEILNLTGRELVGTLAPEIGRLQLLKSLILRNNNFRGKIPKEFGGLTALEVLDLSSNNLDGTIPEELMAMPLLKQLSLHDNQFQDDISSLHIQDISDEQAGCLSRKLGCWAGFKDWTSFSDLREKYSTNLASLGEPHIMQNLQSFASAVGRRLLGEVGNLPALSGNYAKSSGPVNSEEIQRAIDVLSLGSGSFSAFPNSEAEVLESAVNTDAAAMQSGAANQSTDEVSGSKHSKWAYFMIIPAAILLISLIVAPILVWRKRGRAAIGPWKTGLSGPLQKAFVTGVPKLNRPELEAACEDFSNIINTFPSCTVFKGTLSSGVEISVVSTAILSLKEWPKSSETCFRKQIDTLSRVNHKNFINLLGYCLENQPFMRMMVFEYAPNGTLSEHLHLKEFEHLDWAARMRIIMGVAYCLQYMHHDLNPPVAITDMRSDTIFMTDDYAAKIADVGIWKEVAIKAKTAKEDSSSRSECPPDIASNVYCFGTLLIEIISGKLPEADDQKSMCNWAAEYLKGKSYSKLVDASLKEHNANELEAVCEVIQECIDPDSDQRPTMRDATRKLRQALNISPEAATPRLSPLWWAELEILSAEAT

SEQ ID NO: 14152 - protein, 170 aa, Glycine max
  misc_feature (64)..(64): Xaa can be any naturally occurring amino acid
  misc_feature (95)..(95): Xaa can be any naturally occurring amino acid
HASGETRGTIAGGKELSSSEKDFVSCCGSTNFAKEKAPAFPFCSLRDAGSVARHVWINGVDVHXCVRAFFLHPLIGQRHAPSVGYEATAQWCKGXQSTALTTGTVSSLQELYEWIAPDREKLAFVFLISAAGRKPAVILAELEIRYTDRPSVAFDIAARQQMNITELRLA

SEQ ID NO: 14153 - protein, 496 aa, Lactobacillus acidophilus NCFM
MFYKKLDNFPKDFLWGASSAAYQIEGAANEDGKGPSIWDKYTHEKGNTYKDTNGDVAIDHYHHYKEDVELMAKMGLKAYRFSVAWSRIIPDGKGKVNPKGIEFYHNLIKDLRDHNIEPVLTMYHWDLPLNLQEKYQGWESRETIKAFRKYAQVLYREFGDEVKYWVTINEQNVFTSMGYRWGTHPPKKHDIKAMFLANHHVNIANALVVKDFHQMVPDGLIGPSFGYGPVYPKTCDPNDVLAALNAQDFNDNWWLDVYCRGKYPFFTKKQLTDLGIMPEVTAEDQKILEDPEAYPDYLGINYYHGGTVQQNRLEKQVDDQKDERKFNKVDPYLMQPKGDKAQNPEVPMFNNVENQYVDKTKWGWEIDPTGMRIALREIYEKYQLPIMITENGLGALDIVKDGKINDTYRINYLKDHVKAMKEAITDGVDLIGYCAWSFTDLLSWLNGYSKRYGFVYVDQNDNENGSLKRIPKASFSWYKQVIASDGNDENLLEHKE

SEQ ID NO: 14154 - protein, 447 aa, Bartonella henselae str. Houston-1
MSEKNVPGLAVRQVSVRLLGVVLDKKTSLSGLTDNEYGHPQYLGLSQRDRLLCRAILAAALRHRGQITDALRRFLKRPLPSQALSLQHLLHISAAQILYLDIPDHAAIDLAVRVAKLDPRMCRFSGGVNALLRNVAREAVFLRQKAPHIEGIPVWFGQLLVSTYGKEKTEQILEIQSAPPPLDLTVKSDSRGWAERLGGVVLPNGSVRLSRLEGSVSELPGYMEGAWWIQDFAASLPACLLGNIHGKQVADLCASPGGKTAQLALQGADVTAIELSANRLKRLKENMERLHFSVRCCEGDVKNFHPKQLFDAVLLDAPCSSTGTIRRHPDILWTKSMNDVIKLAALQYDLLVAAIALLKKGGRIVFSNCSLAKEEGEDLITRILSERGDIVLEPILAEEMGVMAHLLSVEGILRTTPADFCHENFDAEKNIFLGMDGFFAARLRKVA

SEQ ID NO: 14155 - protein, 220 aa, Striga asiatica
MGMAAAEAQFHVLAVDDSLIDRKLIERLLKTSSYQVTTVDSGNKALEFLGWSKDESGNSNAFDSPKNHQVVEVNLVITDYCMPGMTGYELLKKVKESTFLRDIPVVIMSSENVPSRINRCLEEGAEEFFLKPVRLSDVNKLRPHMMKAKCCKDIQKPEKEEEKQENKVSSETKLGSLTQMPLSNNNNNNNSNKRKSMDDDGPSPDKARPRYNNGCTVMSN

SEQ ID NO: 14156 - protein, 1152 aa, Medicago truncatula
MASTSRGEKTEPNTSSSSSQRRHQLQITTTKEPEQQNNNNNKSMKKAIAQYTEDARLHAVFEQSGDSFDYSQSIRLTTAAHSQSVPEQQITAYLAKIQRGGFIQPFGSMIAVDEPSFRVLAYSENARDMLGITPQSVPSLEDDDESSSSGFNIGTDVRSLFTHSSGVLLEKAFAAREISLMNPIWIHSRSTGKPFYGILHRIDVGVVIDLEPARSEDPALSIAGAVQSQKLAVRAISQLQSLPGGDVKVLCDAVVESVRELTGYDRVMVYKFHEDEHGEVVAESKRIDLEPYIGLHYPATDIPQASRFLFKQNRVRMIVDCNASPVRVFQDEALVQPVCLVGSTLRAPHGCHAQYMANMGSIASLAMAVIINGNDEDGVGIGGTGRNSMRLWGLVVCHHTSARCIPFPLRYACEFLMQAFGLQLNMELQLAAQSLEKRVLRTQTLLCDMLLRDSPTGIVTQSPSIMDLVKCNGAALFYQGNYYPLGVTPTESQIRDIIEWLLAFHGDSTGLSTDSLADAGYPGAASLGDAVCGMAVAYITEKDFLFWFRSHTAKEIKWGGAKHHPEDKDDGQRMHPRSSFKAFLEVVKSRSMQWDNAEMDAIHSLQLILRDSFKEAENNDSKAVVHTHMAELELQGVDELSSVAREMVRLIETATAPIFAVDVNGRINGWNAKVSELTGLLVEDAMGKSLLHDLVYKESQETVDKLLSHALKGEEDKNVEIKMRTFGPGNQNKAVFIVVNACSSKDYTNNIVGVCFVGQDVTGQKVVMDKFINIQGDYKAIVHSPNALIPPIFASDDNTCCLEWNNAMEKLSGWSRTDVIGKLLVGEVFGSFCQLKGSDAMTKFMIVLHNALGGQDTDKFPFSFVDRHGKFVQTFLTANKRVNMDGQIIGAFCFLQIVSPELQQALTVQRQQDSSCFARMKELAYICQEVKNPLSGIRFTNSLLESTCLTDEQKQLLETSVACEKQMLKIIRDIDLDIIDNGSLELEKREFLLENVINAVVSQVMLLLRERNLQLIRDIPEEIKALAVYGDQLRIQQVLADFLMNVVRYAPSPDGWVEIHVFPRIKQISDGLTLLHAEFRMVCPGEGLPPELIQDMFHNSKWVTQEGLGLSMSRKIIKLMNGEVQYVREAERCYFLVVLELPVTRRSLKNVN

SEQ ID NO: 14157 - protein, 223 aa, Striga asiatica
MDVAKMETDGSSDVVAQELCVLAVDDSLVDRKVIERLLKISRCKAISVESGTRALQYLGLDEEKNSSGFDDLKVNLIMTDYSMPGMTGFELLQKIKGSAKLKGIPVVILSSENIMTRIDRCLEEGAEEYLVKPVKLSDVERVRDCILRGEGKTGNSLNPKRKIGVEPPPPALDCETDPVGPTSSEPISHESPTSPCPGPELQPELHDQPLAKRQSLVAAADRL

SEQ ID NO: 14158 - protein, 301 aa, Methanosarcina mazei Go1
MTFMEFEKLRHGTELIKRGFARMQKGGVIMDVTTPEQARIAEEAGAVAVMALQAVPADLRKAGGVARMADPEIVQQIIDTVTIPVMAKARIGHFVEAEILEALGVDMVDESEVLTPADPFYHIDKTQFTVPFVCGARNLGEALRRINEGAAMIRTKGEAGTGDVSQAVKHMKQIQGEIRALAGKTKEELIMVAREIEAPIELVVETAKMQRLPVVNFAAGGVATPADAALMMRLGADGVFVGSGIFKAENPEKMAKAVVEAVNNYDNPAKLAEISKGVGAGMKGISADMIPVQEALQERGW

SEQ ID NO: 14159 - protein, 158 aa, Striga asiatica
MSGLGQEMRFHVLAVDDSIIDRKLIERLLKTSSYQVTVVDSGVKALEFLGLLDNDDTNSKSVSQPRSNHIVDLIITDYSMPALTGYDLLRKIKESEILKDIPVVIMSSENIPSRINSCLEQGAQEFFVKPVQQSDVNKLRPHLMRCQKEFIMPEVRVH

SEQ ID NO: 14160 - protein, 218 aa, Bartonella henselae str. Houston-1
MTRLPERLLSGYRSFIKNHFFYKTAHYQQLAIEGQKPEILVIACCDSRAIPETIFDAKPGEIFTLRNVANLVPPFSPDNQYHATSAAIEYAVQLLEVKHIVVFGHAHCGGVNTALEGTCKSLSSNDFIGQWISLLIPAAQTIIENKSLTPSEQQTALEKLSIRHSLKNLETFPWIKARKDQGILTLHGVWFDISSGELWSMEQETGHFMRVEVGNFEE

SEQ ID NO: 14161 - protein, 238 aa, Striga asiatica
MGMATEDSQFHVLAVDDSLIDRKLIEKLLKNSSFQVTTVDSGSKALEFLGWHRDERSNSKGTSVSPKTHQEVEVNLVITDYCMPGMTGYDLLKKMKESSSLKNIPVVIVSSENVPSRITRCLEEGAEEFFLKPMKLTDVNKLWPYMLRTKGQNNVLKPENMEKQESNQEDEITPIPIQIQLQTAQSLQQQQLEQTPQTNDGDNNKNNNVANNKRKSIDDGLSTDTPRPRYNGLTVVFN

SEQ ID NO: 14162 - protein, 549 aa, Leifsonia xyli subsp. xyli str. CTCB07
MDPRAGIPAQPSDLIDVDALRRAYYELKPDVSVPGQRVVFGTSGHRGSSLNTAFNEDHIAATTQAIVEYRTSQGIAGPLFIGADTHLLSEFATTTALAVLAGNEVRALVDEFGDWVPTPALSHAIVAYNRAGHPDRADGIVVTPSHNPPADGGFKYNPPHGGPADTDATGWIAKRANEIIANGMREVRMAEPSGVETYDFRRKYVDDLESVIDIAAIRDSGIRIGADPLGGASVSYWQAIAETYDLNLEVVNPAVDPAWGFMTLDWDGKIRMDPSSPSAMASVVARSRDFDILTGNDADADRHGIVTPDGGLMNPNHYLAVAIDYLFRTRTGWRKDAAVGKTLVSSSIIDRVAESLGRRLWEVPVGFKWFVPGLIDGTVGFGGEESAGASFLRFDGSAWTTDKDGILLSLLASEIRAVTGKSPSQLYRELTERFGDPVYRRVDAPASPEQKAAMSKLDSDAIAATELAGEPIAAKLSHAPGNDAPLGGVKVETATAWFAARPSGTENVYKIYAESFAGEESLREVQEQAKRIVGEALGGEARRLVAGPA

SEQ ID NO: 14163 - protein, 228 aa, Fusobacterium nucleatum subsp. nucleatum ATCC 25586
MKLVLIRHGESAWNLENRFTGWKDVDLSPKGMEEAKSAGKILKEMNLVFDVAYTSYLKRAIKTLNIVLEEMDELYIPVYKSWRLNERHYGALQGLNKAETAKKYGDEQVHIWRRSFDVAPPSIDKNSEYYPKSDRRYADLADSDIPLGESLKDTIARVLPYWHSDISKSLQEEKNVIVAAHGNSLRALIKYLLNISNEDILNLNLVTGKPMVFEIDKDLKVLSSPELF

SEQ ID NO: 14164 - protein, 452 aa, Silicibacter sp. TM1040
MTLRPPKPPVRPDRVSLWRYLKLFRADILSAQPQRLYRAWMAEFRTPFFRSFLVNQPALLDVILKERPDDFPKSNRVGEGLRPLLGNSVFLTNGETWKRQRRIIDPAFEGGRLKESFPAMRAAAEAGVARLRPHADGSELEIEAEASHIAADVIFRTLFSIPIEHEVAAEVFSRFRAYQQAQPILNLAAFVPVPRWMPRFYPKGTRQNARHIRRLIADLTKARMAEIAAGTAPDDLATKIMTTLDPETGKGFGAEEMVDQVAIFFLAGHETSASALGWALYLLALYPEWQEKLAAEVAEHGAEEFADLSKLRLTRDVFRETLRLYPPVPMMVREAVQTERFRDREVLRGSQMVLSPWHLHRHERLWERPDEFDPGRWQSENGKACARNAYMPFSAGSRVCTGAGFAMVEGVLILAQILRHYRITPVEGRSPEPVAHLTVRSRTGIWLRFSHR

SEQ ID NO: 14165 - protein, 338 aa, Arabidopsis thaliana
VADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYDEIKKAIKEESEGKLKGILGYTEDDVVSTDFVGDNRSSIFDAKAGIALSDKFVKLVSWYDNEWGYSSRVVDLIVHMSKA

SEQ ID NO: 14166 - protein, 379 aa, Cryptococcus neoformans var. neoformans JEC21
MSTELNPDNTSFVLHGVEDVRFDQRPIPEVHNDQVLIKVVKTGICGSDVHYLQHGRIGSFVLEEPMCLGHESAGVVVKLGPNVREDLGVEVGTRVAMEPGVCCRSCANCKAGLYELCPYMSFAATPPTIFGTLCRYYVLPADLVHPLPESVSFEDGAMMEPLSVGVHSVATLGGCKSDQTVIVFGAGPVGLLCMAVAKALGARRIIAVDINKERLEFAKSYAATDVCIPGSKLDGEDGEAYTARIAGELRQELGIPERGKGAIDLAIEASGAPTCVQIGLAVLKPAGTYVQVGMGAKMTVPVPLFHIISKQLHVVGSFRYGSGDYPLAISLVERGLIDLKPLVTQRFKFENAKEAFETTKVGKDKNGKGVIKCIIDGPE

SEQ ID NO: 14167 - protein, 526 aa, Chlamydophila pneumoniae AR39
MERKRFIDCDSTKILQELALNPLDLTAPGVLSAERIKKFSWLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIVQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGFCWGINSFDQEGVSLGKALANRVLELLEGADASNFPEAASLLTLFNIKFR

SEQ ID NO: 14168 - protein, 341 aa, Hyphomonas neptunium ATCC 15444
MVNEKNLTWVLRKRPVGDLQQGDLELVESALTQLEDGQVRAKTIYLSLDPTNRIWMSDVDAYLPPVGIGDAMRGGGLSVITESRFDGLEPGDIVNTGLAGWAIYNTLPGASLAKLPKLPGVPLTAFMGPLGATGMTAYFGLMDIAKPKAGETVVVSAAAGAVGSMVGQIAKIQGCRVVGIAGGADKCRWLTETAGFDAAIDYKNEDVGKALDKHCPNGIDINFENVGGKIMDEVIARLNDFSRMPLCGLISTYNATDPVPGPYNFSNLLMRRTLVKGFIVIDYFPRFPEGMQQMAQWFMEGKLKYETDIVDGFEKAPASLSRLFEGKNLGKLVVQVSPEPV

SEQ ID NO: 14169 - protein, 393 aa, Sesleria insularis
EPARTEDPALSIAGAVQSQKLAVRAISRLQALPGGDVKLLCDTVVEHVRELTGYDRVMVYKFHDDEHGEVLAESRRADLEPYLGLHYPATDIPQASRFLFRQNRVRMIADCHAAPVRVIQDPAMPQPLCLVGSTLRSPHGCHAQYMANMGSIASLVMAVIISSGGEDNMSRGGAVPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGITPTGAQIKDIIEWLKVCHGDSTGLSTDSLADAGYPGATALGDAVCGMAVAYITPSDYLFWFRSHTAKEIKWGGAKHHPEDKDDGQRMHPRSSFKAFLEVVKSRSLPWENAEMDAIH

SEQ ID NO: 14170 - protein, 389 aa, Arthrobacter sp.
MSIKKDYDVIVVGAGSMGMAAGYYLSKQGVKTLLVDSFDPPHTNGSHHGDTRIIRHAYGEGREYVPFALRAQELWYELEKETHHKIFTKTGVLVFGPKGEAPFVAETMEAAKEHSLDVDLLEGSEINKRWPGVTVPENYNAIFEKNSGVLFSENCIRAYRELAEANGAKVLTYTPVEDFEIAEDFVKIQTAYGSFTASKLIVSMGAWNSKLLSKLNIEIPLQPYRQVVGFFECDEKKYSNTHGYPAFMVEVPTGIYYGFPSFGGCGLKIGYHTYGQKIDPDTINREFGIYPEDEGNIRKFLETYMPGATGELKSGAVCMYTKTPDEHFVIDLHPQFSNVAIAAGFSGHGFKFSSVVGETLSQLAVTGKTEHDISIFSINRPALKQKETI

SEQ ID NO: 14171 - protein, 211 aa, Striga asiatica
MGMAAAEAQFHVFAVDDSLIDRKLIERLLKTSSYQVTTVDSGSKALEFLGESCDSPKNQQEIEVNLVITDYCMPGMTGYDLLKKMKESSFLRDIPVVILSSENVPSRINRCLEEGTEEFFLKPVRLSDVNKLRPHMMKAKCCKDIQKPEKEEEKQENKVSSETKLGSLTQMPLSNNNNNNNSNKRKSMDDDGPSPDKARPRYNNGCTVMSN

SEQ ID NO: 14172 - protein, 393 aa, Sporobolus giganteus
EPARTEDPALSVAGAVQSQKLAVRAISRLQALPGGDVKLLCDTVVEHVRELTGYDRVMVYRFHEDEHGEVVAESRRDDLEPYLGLHYPATDIPQASRFLFRQNRVRMIADCHATPVRVIQDPGLSQPLCLVGSTLRAPHGCHAQYMANMGSIASLVMAMIIIVVVMTKQTSRSGISSAMKLWGLVVCHHTSPRFIPFPLRYACEFLMQAFGLQLNMELQLAHQLSEKHILRTQTLLCDLLLRDSPTGIVTQSPSIMDLVKCDGAALYYHGKYYPLGVTPTESQIKDIIEWLTVCHGDSTGLSTDSLADAGYHGAAALGDAVCGMAVAYITPSDYLFWFRSHTAKEIKWGGAKPHPEDKDDGQRMHPRSSFKAFLEVVKSRSLPWENAEMDAIH

SEQ ID NO: 14173 - protein, 394 aa, Streptochaeta angustifolia
EPASTEDPALSIAGAVQSQKLAVRAISRLQALPGGDVKLLCDTVVEHVRELSGYDRVMVYRFHDDEHGEVVAENRRADLEPYLGLHYPAMDIPQASRFLFRQNRVRMIADCHAAPVRVIQDPSLKQPLCLVGSTLRAPHECHAQYMANMGSIASLVMAVIISSGGDDENSVGRSGISSATKLWGLVVCHHTSPRCIPFPLRYACEFLMQAFGLQLNMELQLAHQLSEKHILRTQTLLCDMLLRDSPTGIVMQSPSIMDLVKCDGAALYYHRKYYPLGITPTEAQIKDIIDWLAMCHGDSTGLSTDSLADAGYPGAAALGDAVCGMAVAYITPNDYLFWFRSHTAKEIKWGGAKHHPEDKDDGQRMHPRSSFKAFLEVVKSRSLPWENAEMDAIH

SEQ ID NO: 14174 - protein, 397 aa, Streptogyna americana
TGYDRVMVYRFHDDEHGEVVAESRRADLEPYLGLHYPATDIPQASRFLFRQNRVRMIADCHAAPVKVIQDPALPQPLCLVGSTLRAPHGCHAQYMANMGSIASLVMAVIISSGGDDEHNMMRGGIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEAQIKDIIEWLTLCHGDSTGLSTDSLADAGYPSAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAIVNGQVQLGELELRGIDELSSVAREMVRLIET

SEQ ID NO: 14175 - protein, 394 aa, Triticum aestivum
EPARTEDPALSIAGAVQSQKLAVRAISRLQALPGGDVKLLCDTVVEHVRELTGYDRVMVYKFHDDEHGEVLAESRRGDLEPYLGLHYPATDIPQASRFLFRQNRVRMIADCHAAAVRVIQDPAMPQPLCLVGSTLRSPHGCHAQYMANMGSIASLVMAVIISSGGEDEHNMTRGVIPSAMKLWGLVVCHHTSPRCIPFPLRYACEFLMQAFGLQLNMELQLAHQLSEKHILRTQTLLCDMLLRDSPTGIVTQSPSIMDLVKCDGAALFYHGKYYPLGVTPTEAQIKDIIEWLTVCHGDSTGLSTDSLADAGYPGATALGDAVCGMAVAYITPSDYLFWFRSHTAKEIKWGGAKHHPEDKDDGQRMHPRSSFKAFLEVVKSRSLPWENAEMDAIH

SEQ ID NO: 14176 - protein, 394 aa, Zizania aquatica
EPARTEDPALSIAGAVQSQKLAVRAISRLQALPGGDVKLLCETVVEHVRELTGYDRVMVYRFHEDEHGEVVAESRRNDLEPYLGLHYPSTDIPQASRFLFRQNRVRMIADCHSAPVRVIQDPALPQPLCLVGSTLRAPHGCHAQYMANMGSIASLVMAVIISSAGDDEHNMARGGIPSAMKLWGLVVCHHTSPRCIPFPLRYACEFLMQAFGLQLNMELQLAHQLSEKHILRTQTLLCDMLLRDSPTGIVTQSPSIMDLVKCDGAALFYHGKYCRLGVTPTEAQIKDIIEWLTVCHGDSTGLSTDSLADAGYPGAATLGDAVSGMAVAYITPSDYLFWFRSHTAKEIKWGGAKHHPEDKDDGQRMHPRSSFQAFLEVVKSKSLPWENAEMDAIH

SEQ ID NO: 14177 - protein, 302 aa, Prochlorococcus marinus str. MIT 9303
MSSAAESSPTPFGRLLTAMVTPFDADGCVDLALAGRLARYLVDEGSDGLVVCGTTGESPTLSWQEQHQLLGVVRQAVGPGVKVLAGTGSNSTAEAIEATTQAAAVGADGALVVVPYYNKPPQEGLEAHFRAIAQAAPELPLMLYNIPGRTGCSLAPATVARLMECPNVVSFKAASGTTDEVTQLRLQCGSKLAVYSGDDGLLLPMMSVGAVGVVSVASHLVGRRLKAMIEAYLNGQGALALSYHEQLQPLFKALFVTTNPIPVKAALELSGWPVGSPRLPLLPLDPVMRDALSNTLTALCQT

SEQ ID NO: 14178 - protein, 136 aa, Triticum aestivum
  misc_feature (93)..(93): Xaa can be any naturally occurring amino acid
  misc_feature (95)..(95): Xaa can be any naturally occurring amino acid
  misc_feature (101)..(101): Xaa can be any naturally occurring amino acid
  misc_feature (103)..(103): Xaa can be any naturally occurring amino acid
  misc_feature (107)..(107): Xaa can be any naturally occurring amino acid
  misc_feature (124)..(124): Xaa can be any naturally occurring amino acid
IICAFCSSGGNGICRAPPLEALLFDIDGTMCVSDPFHHRAFSELLQGLGYNGGAPITPEFGMAHMAGRSNEQIGRFLFPDWPQARLGAFFAEXEXLFARYXAXGLRXVPGLAELCRLARERGLXRAAVTSAARKPN

SEQ ID NO: 14179 - protein, 615 aa, Oryza sativa
  misc_feature (341)..(341): Xaa can be any naturally occurring amino acid
MIPPLASLPKNFSISLAHINHLPHEANEQKSHFIIIHTNPLGFFRVPGFSFLLLSPPLDPSSSSPRSSALAVARRRPPTMEAAGVEVNGGGGGDVVVVVPQQHEVAAKQAAAAAAAKGKSVESKGVRVVGGRIYDPENGKTCHQCRQKTMDFAASCHKIKKNNKQCTIQYCRKCLFNRYGQEAEKVANDGTWTCPKCKDICNCSFCMKKKGLPPTGILAHAAKASGCASVHHLLKKGKEAVAAAQRSTQKVRSTPVKKSPKRAIQPDAAADEPLAEGDENVCIDFNAAPVKKQKRSRKVGNGVALTKDESPDAPKEQVVLPKGTPVTSVAGAEWEPEDVGXHLQFFEFCRTFAEIFQVRKGQPERILRDIAGGRGLRVVSSVIADFHITLLSIIQEGRGIKPITYSRDNDAWIVDTGKCISESIFVPEGLPLDSLSQGVSGYKNLSPSCKLSVLNFLCDESLSTEKLRSCILSETKNPSREKAHSAKEKEEPKEETIKNTDEAVLLKTEGAAVAIEEDKNGISQQKDVKEVKNADTNEKKHGGFLRTNPFMVDKKVIYWKLDDYCNNTTMMLQEVDADDLMGNKDKWFMLNEDEKKIVENYLSTRPKRRGRKAAQ

SEQ ID NO: 14180 - protein, 421 aa, Bartonella henselae str. Houston-1
MRFFSYNQGVLHAEGLSLSALAQDVGTPFYCYSASAVVTNFKDYQNAFLDMPSLIAYAVKANSNQAVLRLLAANGAGADVVSEGELRRALAAGIPAHRIVYSGVGKTVKEIDFALAHDIYCFNVESEPELEQLSVCAVALSKTARVSLRINPDVDARTHRKITTGKSENKFGIPLSLAWDVYKKAAQLPGIQVCGVDMHIGSQICDLKPFEDAFLIVADFVRQLRSHGYALTHIDIGGGLGIDYGNEHHSVPSLSDYAALVRKHIAPLGIHIILEPGRSIVGDAGVLVTSVLYLKRGNGRNFVIVDAAMNDLMRPTLYDAWQNVLLVEQASKDALLMKADIVGAVCETGDYLALDRRVPTLATGDLLAIMEAGAYGAVMASTYNSRLLVPEVLVQDTRYAVIRPRLDYAQLIGCDYVPDWI

SEQ ID NO: 14181 - protein, 181 aa, Colwellia psychrerythraea 34H
MNKTQQQLLINAIHTIPDYPVEGIMFRDVTSLLEDAEAFKLVMELLENKYKGRGFTKIVGTEARGFLFGAPLALALNIGFIPVRKPGKLPRPTYSQAYQLEYGEDILEIHQDALTPEDNVLIIDDLLATGGTIEATTKLIRRLGAQVQEAGFVISLPDLGGEERLAELNITPYSLIQYQGE

SEQ ID NO: 14182 - protein, 327 aa, Colwellia psychrerythraea 34H
MRGIISPKLVPLLEQANIAIAAAKATGQGFSAELVRQGLDNLSALMGAGPNIAIVKDSFLATSSHNIPVRIYNPAPNDMLPVLLHFHGGGHMCGSADLYDPISRKLALATQAIVICVDYRLAPEYPYPAGLDDCQQVLERYQSLLTEMKYSDELYIAGDSAGGAICTSLVMNNLINEKTSNSIKIDKQILVYPSVDYTMASASIDENGQGFLLEKDKMHWYFQQYFQVSSLEQDEITQAKIVKASPLLGKFSANMPTTLVITAGCDPLRDEGVAYAKSLDEVGVNVEHHSFDGMTHAYMLLNDLVSDECQQTYQLIGQFVKAGINDQ

SEQ ID NO: 14183 - protein, 453 aa, Rickettsia prowazekii str. Madrid E
MVIGSGPAGYTGSIRAAQLGLKVACIEKNDTLGGTCLNIGCIPSKALLNTSKKYEEAIRHFDSIGIIADIKLDLQKMLSNKDKIVLDLTKGIESLFIKNKITKIKGEAKIISNNIVEVNKEQIKAKNILITTGSSVIEIPNITIDEEFIVSSTGALKLSKVPKHLIVVGGGYIGLELGSVWRRLGAKVTVVEYASSIVPMLDKEIAKQFMTIQQKQGIEFKLNTKVIASEVKSGKVNLTIEEWDKRSIITSDVVLIAVGRKAYTKNLGFESVGITTDNKGRIEINERFQTAVSNIYAVGDVVKGAMLAHKAEEEAIAAVEIMVGQAGHVNYNLIPSVIYTYPEVASVGATEEQLQEQGINYKVGKFPFLANSRARAIGSTEGMVKILADSKTDRVLGAHIIGSDAGTLIAELIAYMEFGASSEDIARTCHAHPTLSEAIKEAALNVDKRTINI

SEQ ID NO: 14184 - protein, 367 aa, Dehalococcoides sp. CBDB1
MAIKTENFILNIGPQHPSTHGVFRLRIVLDGEVITDLEPVFGYLHRGIEKLAEGRTYLQDIPFTDRLDYLGSMTNNHAYVMAVEKLAGITVPERAEYIRVILDELQRIASHLAGLGFFLNDLGALQTPLLYMFREREKIVELFDMCSGQRLNYNYYRFGGFVQDLPEEFLPALKILLDTLPGFIDEYEQLISTNEIVLIRTKGVGVLKRDLAINSSAAGPVLRASGINWDIRRNDPYSIYNRFEFDIPIAKNGDTYDRYMIRILEMRQSVWILRQAVKDLPEGEIMGKAPKLLKPPAGEVYSRIEGPKGELGFYLVSDGTDKPYRWRVRPPCLLNLSALKDMVVGWKVADLMAIFGSIDIVMGEVDR

SEQ ID NO: 14185 - protein, 210 aa, Medicago truncatula
MTTQATQFLTIVTLLFVFVIKIKGDSISSIPSDEINKNSTNTSVVVEADRVDQVSPNCGATPWICSTGEFPPRALCCRNRCVDVTNDLNNCGFCGVICPLIGNWKCCNGVCTNINFNPFSCGDCGRTCPFGFPCIFGRCPFEPVAPPPLRPIEPITPPPLRPIEPVTPPPLRPIEPVAPPPLLSPGLPEQNSPNIPNYQHKRPHPIMPTE

SEQ ID NO: 14186 - protein, 428 aa, Pseudomonas syringae pv. tomato str. DC3000 [sequence omitted]

SEQ ID NO: 14187 - protein, 1062 aa, Lactobacillus acidophilus NCFM
MPKRKDIHKIMVIGSGPIIIGQAAEFDYSGTQACLALREEGYQVVLVNSNPATIMTDTTIADKVYIEPLTVDSISRIIRQEYPDAILPTLGGQVGLNMALALAKTGILDELNIELLGTKLKSIEQAEDREQFKNLCKELGEPVPPSKTVNTVEAAVEFGDEIGYPIIVRPAFTMGGTGGGICHNRKELAEIAKNGLELSPVTECLIEKSIAGYKEIEFEVMRDHDDNAMIVCCMENFDPVGIHTGDSIVFSPSQTLSDKEYQMLRDCSLKLIRALKIEGGCNVQLALDPNSFDYDVIEVNPRVSRSSALASKATGYPIAKMAAKIAVGMTLDEIKNPVTGTTYAEFEPALDYVVCKIPRWPFDKFQKADRTLGTQMKATGEVMAIGRTAEEAMQKAVRSLEIDEKDLYSEEAHRASDDKLEQKLVKAQDDRLFYLAEAFRRGYSLEDVHELTKINFYFLDIVKHMIEMEKELKENKDEVDILRLAKKYGFSDPTIANLWGETADEVRDFRKAHGIIPVYKMVDTCAAEFESQTPYFYSTYDAENESHRSGKKSVIVIGSGPIRIGQGVEFDYATVHCVKALQKMGYEAIVINSNPETVSTDFSVSDKLYFEPLTLEDVLNVCDLEEPEGVIVQFGGQTSINLAAGLEAHGVKILGTTVKDVNRAEDRKLFDDIIKELKLNQPQGLTATTHEGVIEAAEKLGYPVLVRPSYVLGGKAMEIVYNKKELEEYLQDHVDIAADHPILVDDYLDGRECDVDAISDGYDVLLPGIMEHIEHAGVHSGDSMAVYPPQTFTDEIKEKITEVTKKLALTLNCVGIMNIQFIVRDGEVYVIEVNPRASRTVPFLSKITGIEMAQVATRVIMGESLKEQGYGDGLASEPDMISVKAPVFSFSKLADVDSYLGPEMKSTGEVMGSDHTFAKALYKAFAGAKMQLPENGNVLLTIEDRDKDKILPIAKRFARIGYRIFATKGTADFLKKNDLHVDLVTKVHEDEQADDNILNELRNNKIDLVINTMGHDIEKNSDGFIIRQMAIQQNVPLLTALDTADALLTALENRSFATDALQ

SEQ ID NO: 14188 - protein, 211 aa, Vibrio angustum S14
MSDFALTHRETTKFSERLAYKITQLLKYSLNIFYGKKYAKRAVILETIAAVPGMVAGMFNHLKALRRMKDDEGWIKELLSEADNERMHLMIFLDIAKPSWVERALVLLGQAVFICVYSIIYLTSSKIAHRVVGYFEEEACKSYTEFLEKIDSGELENVAAPQIAINYYELHDDAKLRDVVLRIREDEAKHRDRNHNFADCYQNKDLPAHQA

SEQ ID NO: 14189 - protein, 370 aa, Pseudomonas syringae pv. tomato str. DC3000; identical to SEQ ID NO: 1184

SEQ ID NO: 14190 - protein, 817 aa, Proteus mirabilis
EFQCLHGMGEPLYAQVVGKIADGKLGRPCRIYAPVGTHETLLAYLVRRLLENGANTSFVNRIADTTISLDELVADPVKEINKIAQAEGQIGLSHPKIPLPMQLYGDERKNSPGIDMSNEHRLASLSSALLTSAMEKIHSHPLIGGECNSAEEVIAPQSILNPANHTDVVGTVRETTAAEANFALDIAQENGEIWFATPPAERAAFLVRTAELMEQQMGPLMGVLVREAGKTYSNAIAEVREAIDFLYYYSAQVANDFDNNTHRPLGPVVCISPWNFPLAIFSGQIAAALAAGNTVLAKPAEQTPLIAFKAVELFYQAGVPRSALQLLPGQGETIGAQLVADERVRGVMFTGSTEVAHILQKTLAGRLDSEGRPVPLIAETGGLNAMIVDSSALTEQVVTDVMASAYDSAGQRCSALRILCIQEEVADSTIEMLKGAMAQAIIGDPSLLSTDIGPVIDKEAKAGIEKHIQTMRTAGFDVYQATYNQLAKQTENNSTFVPPTLIELDKISSLKKEIFGPVLHVVRYSSQDLPALLAEINATGYGLTMGVHTRIDETIAYVATHAKVGNLYVNRNMVGAVVGVQPFGGEGLSGTGPKAGGPAYLYRLLSKRPENAITQTLARQDETLPLDASMRQNLLQTYHHYMTWLANKTEPAHYQALEEYANTSQAGTLRVLPGPTGERNTYQLVPCGKVLCLSDNEQDIFTQLAGVFASGCHAIVHNAVFSQKTYRELPDMIRKAITLTDNWHDESLSINAVIYHGDSDQLKETCQQIAQRKGAIISVQGFSRGETALLLERLLHERALSVNTAAAGGNASLMTIS

SEQ ID NO: 14191 - protein, 397 aa, Rickettsia conorii str. Malish 7
MLSKLNKPALFALIFYPIFIISLVVKYSFDYGIGLTEVIFIIASYYINNITVGIGLHRLWSHNAYKINKYAEFVLIMLSAGTLQGPALSWASNHYKHHRYTDQDQDPHTPLKFDNKFLGFMWSHIGWMLVGSGSYKSIDRITWAKHGKNNLLKWQLKYYWQIAAFMNIVVPLFIGYLVGGTMQSAYAGFLFMGLGRFLQQQATFCVNSLCHFAGSKKYYKGTAGDIWWMALFLLGENWHNYHHAFPSDYRNGAKWYHLDVHKWIIFLMSKIGLASELERTTKVRIQAKMQETLNYLSEKQKQKLTLMQTKIDHLLENLCLKIKELEESSITIKEQFKKSFVEIQESLKNLAEQVSAATQITEKSSEKLLKIVNKKIIDAEQSIYKLYNQLNTLKVSH

SEQ ID NO: 14192 - protein, 530 aa, Glycine max
MNNGVSQESSVLLDLASHVNRFAFDSFRSDNNKTLLSNFLHFNGNTRTGAAAAKRGVSLGGKVGGASVRFGNILNDFNRAVRFHCEKIPIGFASLRVGDGGDGADGNGNGEGNGVRVDECGGVENEGFRGNGVEGEKPKKVLILMSDTGGGHRASAEAIKAAFYQEFGDDYQVFVTDLWADHTPWPFNQLPRSYSFLVKHGPLWKMTYYGTAPRVVHQSNFAATGTFIAREVAKGLMKYQPDIIISVHPLMQHVPLRILRSKGLLKKIVFTTVITDLSTCHPTWFHKLVTRCYCPTTDVAQRALKAGLQQSQIKIFGLPVRPSFVKPVRPKDELRRELGMDEDLPAVLLMGGGEGMGPIEATARALGDSLYDENIGAPVGQILVICGRNKKLANKLSSISWKVPVQVKGFVTKMEECMGACDCIITKAGPGTIAEAQIRGLPIILNDYIAGQEAGNVPYVVENGCGKFSKSPKEIAKIVAEWFGPKAYELQQMSQNALRLARPDAVFKIVHDLHELVRQRSYLPEYSCTT

SEQ ID NO: 14193 - protein, 401 aa, Solanum tuberosum
MAFSAGKSYAFSTNFDPLQQNLWGSKPPISSLSIKDIDFKQCDKHNILSKKPLYISAVLSGFGHADESKEFKSRDPLVQCNAYEASQPQSIPIDIEFGQEAQAAATQKLKIGLYFATWWALNVVFNIYNKKVLNAFPFPWLTSTLSLAAGSLMMLVSWATKIAETPKTDFDFWKALFPVAVAHTIGHVAATVSMSKVAVSFTHIIKSGEPAFSVLVSRLLGETFPLPVYLSLLPIIGGCGLAAITELNFNLIGFMGAMISNLAFVFRNIFSKKGMKGKSVGGMNYYACLSMMSLLILIPFAIAVEGPQVWALGWQNAVSQIGPNFIWWVVAQSVFYHLYNQVSYMSLNEISPLTFSIGNTMKRISVIVSSIIIFQIPIQPINALGAAIAILGTFLYSQAKQ

SEQ ID NO: 14194 - protein, 574 aa, Vibrio vulnificus CMCP6
MISGILASPGIAIGKALLLQEDEIVLNTNTITKAQVEAEVQRFYDARSKSSAQLETIKQKALETFGEEKEAIFEGHIMLLEDEELEEEILALIKKEKMTADNAIYTVIEEQATALESLDDEYLKERATDIRDIGSRFVKNALGINIVSLSDINEQVILVAYDLTPSETAQINLDYVLGFACDIGGRTSHTSIMARSLELPAIVGTNDITKKVKNGDMLILDAMNNKIIVNPSEAQIEEAKAVKASFLAEKEELAKLKDLHAETLDGHRVEVCGNIGTVKDCDGIIRNGGEGVGLYRTEFLFMDRDALPTEEEQYQAYKEVAEAMEGQAVIIRTMDIGGDKDLPYMDLPKEMNPFLGWRAVRISLDRREILRDQLRGILRASAHGKLRIMFPMIISVEEIRALKEAIEEYKAELRAEGLAFDENIEIGVMVETPAAAAIAHHLAKEVSFFSIGTNDLTQYTLAVDRGNEMISHLYNPLSPAVLTVIKQVIDASHAEGKWTGMCGELAGDERATLLLLGMGLDEFSMSGISIPKVKKVIRNANFAAVKAMAEEALSLPTAAEIEACVEKFIAEHSK

SEQ ID NO: 14195 - protein, 131 aa, Zea mays
  misc_feature (82)..(82): Xaa can be any naturally occurring amino acid
  misc_feature (92)..(92): Xaa can be any naturally occurring amino acid
  misc_feature (102)..(102): Xaa can be any naturally occurring amino acid
MVRISVLNDALKSMYNAEKRGKRQVMIRPSSKVIIKFLIVMQKHGYIGEFEYVDDHRSGKIVVELNGRLNKCGVISPRFDVXGVKEIEGWTXRLLPSRQFGXIVLTTSAGIMDHEEARRKNVGGKVLGFFY

SEQ ID NO: 14196 - protein, 160 aa, Glycine max
FIDLPYTVKGMDVSFSGILSYIEATAAENVRNNECTPADLCYSLQETLFAMLVEITERAMAHCDTKDVLIVGGVGCNERLQEMMRIMCSERGGRLFATDDRYCIDNGAMIAYTGLLEFAHGASTPLEDSTFTQRFRTDEVKAIWREANLENLNGLAEKSI

SEQ ID NO: 14197 - protein, 901 aa, Bordetella bronchiseptica RB50
MSSFAQAGALAAANDEDTLETQEWLEALAAVLDREGPQRAHYLLERLIDEARRSGAHIPFSPNTAYVNTIPPGLEPAHPGNLELEARIRSYVRWNAMAMVVRANKHNPPDGGDLGGHIASFASLATMIGCGQNHFWHGETEEHGGDLVYFQGHTSPGMYGRAYLEGRLTEDQLNHFRQEVDGKGLSSYPHPKLMPDFWQFPTVSMGLGPLMAIYQARFLKYLHARGIADTSNRKVWVFCGDGEMDEPESLGAIALAAREKLDNLIFVINCNLQRLDGPVRGNGKIIQELEGDFRGSGWNVIKLIWGGYWDPLLAHDKEGILRRIMEEAVDGEYQAYKANDGKYVREHFFGKHPKLLEMVARMSDEDIWRLNRGGHDPHKVYAAFDAASKHAGQPTVILAKTIKGYGMGHVGQAKNPTHQQKKLELDSIREFRDRFGIPIPDDKLEELPYYKPAEDSPEMQYLHERRKALGGYLPKRRAKADEQLKAPALDAFKAVLEPTAEGREISTTQAFVRVLNQILRDKDLGPRVVPILADESRTFGMEGLFRQIGIYAPEGQKYTPVDKDQVMYYKESADGQLLQEGINEAGAMSSWMAAATSYSTNNRIMVPFYIYYSMFGFQRVGDLAWAAGDMQARGFLLGGTAGRTTLNGEGLQHEDGHSHLLASTIPNCVSYDPTFAHELAVIIQHGLKRMVEDQENVYYYLTVMNENYPQPGLTAGDEEGIIRGMYKLKSHGKGKQRVQLMGSGTILREVMAAQELLEADWGVASDIWSVTSFTELRRDGLDAERHNLLHPEGKQQVPYVTTQLAKSEGPIIASTDYMKLFADQIRPFVPKDRTYKVLGTDGFGRSDFRYKLREHFEVDRHFVVLASLRALADEGKIPAAKVAEAIKKYGINPNKANPHHA

SEQ ID NO: 14198 - protein, 479 aa, Bacillus cereus G9241
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVGLLKAQVAELSVGSPEQDSTIVPLIDDKSADFVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 14199 - protein, 277 aa, Ricinus communis
TNNNELFLNLVMEYVPESMYRVLKHYSNAKQTMPLVYVKLYMYQIFRGLAYIHTVPGVCHRDLKPQNILVDPLTHQVKLCDFGSAKVLVKGEANISYICSRFYRAPELIFGATEYTTSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALEACAHPFFDELREPNARLPNGRPLPPLFNFKQELNGASPELVNKLIPDHMKRQMGLNFLHLAGT

SEQ ID NO: 14200 - protein, 551 aa, Bordetella bronchiseptica RB50
MSNIVEIKVPDIGDFKEVEVIEVLVSAGDTIKAEQSLITVESDKASMEIPASAAGVVKSVKVKVGDKIAEGTVILEVEAAGEAAAAPKAEQAPEAAEAPKADAAKAEAPQAEAPAAAGPIEVKVPDIGDFKEVEVIEVLVAEGDTIKAEQSLITVESDKASMEIPASAGGVVQSLKVKVGDKVAMGTVIAVVQGQGAAAPAAKAEAPAAAPAAAEPAAPASPAAPAPAPAQRPAPAAALQDEDLKPGQLPHASPSVRKFARELGVNLSRVTGSAAKGRITADDVRAYVKQALSAGAPAGASGGGDGAALGLLPWPKIDFTKFGPIEAKPLSRIKKISGANLHRNWVMIPHVTNNDEADITDLEALRVALNKENEKSGVKVTMLAFLIKAVVAALKKFPEFNASLDGDNLVLKQYYHIGFAADTPNGLVVPVVRDADKKGILELARETSELARKAREGKVSPAEMQGGCFSISSLGGIGGTHFTPIINAPEVAILGVSRSAHKPVWDGKQFVPRLTLPLSLSYDHRVIDGASAARFNAYLGQLLADFRRIAL

SEQ ID NO: 14201 - protein, 591 aa, Bordetella bronchiseptica RB50
MSNIVEIKVPDIGDFKEVEVIEVLVAAGDTIKAEQSLITVESDKASMEIPASSAGVVKSVKVKVGDKVAEGTVILDVEAAGEAAAAPKAEAPKTEAPKAEAPKAPAAKASAPAAAAYSGSADLECDMLVLGAGPGGYSAAFRAADLGMDTVMVERYATLGGVCLNVGCIPSKALLHNAAVIDEARALAAHGISFGEPKVDLDKLRGYKDSVVAKLTGGLAGMARARKVRVVTGTGEFADPHHLTVTDGEGKKQTIRFKQAIIAAGSQSVKLPFLPDDERIVDSTGALQLRAIPKKMLIIGGGIIGLEMGTVYSTLGARLDVVEMLDGLMQGADRDLVKVWQKMNAPRFDNIMLKTKTVGAEARKDGIYVSFEGEGAPKEPQRYDLVLQAVGRSPNGKKIGAERAGVAVTERGFIEVDRQMRTNVPHIYAIGDVVGQPMLAHKAVHEGHVAAEAAHGEKSFFDARVIPSVAYTDPEVAWVGLTEDEAKKQGVKVEKGLFPWAASGRAIANGRDEGFTKLLFDAETHRIVGGGIVGTHAGDLISEIALAIEMGADMVDIGKTIHPHPTLGESVGMAAEVAEGVCTDLPPMRKK

SEQ ID NO: 14202 - protein, 266 aa, Oryza sativa (japonica cultivar-group)
MARRLWHVVRAVLFMLRKGMSKRKLAMDLHLLLHRGKIAGNKALGKIMNTTTATASHGHGHAADAASTAAGEAAAAAPFSCGRALDPALAVYDPRGAGLEVEFSCSNTPSYPSSFHLIPTKRRRRNNNGSNGRRRGGGGRGANGGEPGWYNYDAADIARVFEILNSSDQLLGDGGAAVAATPSPALWRTSFGGRSPAPVRQLRITDSPFPIRDDGGEDAGAGLVDLEAEEFINKFYEQLRTQQQSLATATPDYYAGYSRPVTGVAY

SEQ ID NO: 14203 - protein, 213 aa, Pinus thunbergii
QAQAAGARIIVTLAAYVEKLADLQSHDVLVITIDDAPKEGCQHISVLTEADETQCPAVKIHPDDVVALPYSSGTTGLPKGVMLTHKGLVSSVAQQVDGENPNLYFHSEDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQ

SEQ ID NO: 14204 - protein, 405 aa, Zea mays
MQRNGVVECSVCRSRVVVPSPRSVSRAYDKHRNKMSSKFRALNVFLVVGDCILVGLQPILVFMSKVDGKFQFSPISVNFLTEVMKVIFAVVMLIIQSRKQKVGEKPLLARSTFIQAARNNVLLAVPALLYAINNYLKFIMQLYFNPATVKMLSNLKVLVIAFLLKFIMRRRFSVIQWEALALLLIGISINQLRTVPVGNTAFGLPVTAIAYIYTLIFVTVPSVASVYNEYALKSQYDTSIYLQNLFLYGYGAIFNLLGILGTVLFQGPESFNILRGHSRATIFLICNNAAQGILSSFFFKYADTILKKYSSTVATIFTGLASAAFLGHSLTINFLLGISVVFISMHQFFSPLAKVKDDKPADSIELEDTQNDRPSESSFVNMTAGAADDASHRIGTDERQPLLPI

SEQ ID NO: 14205 - protein, 94 aa, Triticum aestivum
  misc_feature (8)..(8): Xaa can be any naturally occurring amino acid
  misc_feature (32)..(32): Xaa can be any naturally occurring amino acid
MGFWQKRXFFFWGKWGTLLPLESVRSASCPLXGFKRDPKEIEGKEIQYTMSAEDIRRGLKTQTEDVVGQRPVTNKACPKCDHPKAEFYNIQVSN

SEQ ID NO: 14206 - protein, 226 aa, Glycine max
  misc_feature (55)..(55): Xaa can be any naturally occurring amino acid
LRYDKLRIIITFTEGRALGAAAAVSLSSKVPLFYGKNGSGYGSASSSSSSSWISXTLALPAAAYMFQDQEVRAAELARPFIAIKPDGVQRGPISEIISRFERKGYKLVGIKVVIPSKEFAQKHYHDLKERPFFDGLCDFLSSGPVIAMVWEGQGVISYGRKLIGATDPQKSEPGTIRGDLAVVVGRNIIHGSDGPETAKDEIKLWFKPEELVSFTSNAEKWIYGAN

SEQ ID NO: 14207 - protein, 338 aa, Hordeum vulgare subsp. vulgare
MAKVMNLTPVHASSIPDSFLLPADRLHPATTDVSLPIIDMSRGRDEVRQAILDSGKEYGFIQVVNHGISEPMLHEMYAVCHEFFDMPAEDKAEFFSEDRSERNKLFCGSAFETLGEKYWIDVLELLYPLPSGDTKDWPHKPQMLREVVGNYTSLARGVAMEILRLLCEGLGLRPDFFVGDISGGRVVVDINYYPPSPNPSRTLGLPPHCDRDLMTVLLPGAVPGLEIAYKGGWIKVQPVPNSLVINFGLQLEVVTNGYLKAVEHRAATNFAEPRLSVASFIVPADDCVVGPAEEFVSEDNPPRYRTLTVGEFKRKHNVVNLDSSINQIININNNQKGI

SEQ ID NO: 14208 - protein, 308 aa, Escherichia coli
INGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 14209 - protein, 141 aa, Methylobacillus flagellatus KT
MAVERTLSIIKPDAVAKNVIGKIYTRFEDAGLKIIASKMVQLSQADAEGFYAVHKERPFFNDLVKFMISGPVVVQVLEGENAVLKHRELMGATDPKKAEPGTIRADFADSIDANAVHGSDSLENAAVEIAYFFAQSNIYSR

SEQ ID NO: 14210 - protein, 462 aa, Zymomonas mobilis subsp. mobilis ZM4
MAIELKMPALSPTMEEGTLTRWLVKEGDSIKAGEILAEIETDKAIMEFEAVDEGVITKILIPEGSENVKVGTAIAYLGTDANDVTLDGASAETKAEESAPVASPAKTEAAAVEEAATPSLGKVINSAPEIPEGTEFFQQTLREALRDAMAEEMRRDDRVFVMGEEVAEYQGAYKVTQGLLQEFGARRVVDTPISEYGFSGIGVGAAMEGLRPVIEFMTMNFSMQAIDHIINSAAKTHYMSGGQVRCPIVFRGPNGAAPRVGAQHTQNFGPWYAAVPGLVVLAPYDAIDAKGLLKAAIRSDDPVVFLECELLYGKTFDVPKMDDFVLPIGKARIIREGKDVTIVSYSIGVSFALTAAEALAKEGIDAEVIDLRTLRPLDKETILQSLAKTNRIVTVEDGWPVCSISSEIAAIAMEEGFDNLDAPVLRVTNADTPTPYAENLEKKGLVNPEAIIEAVRKVCYRK

SEQ ID NO: 14211 - protein, 429 aa, Zymomonas mobilis subsp. mobilis ZM4
MTAIVSIHGRQVVDSRGNPTVEVDVTLEDGSFGRAAVPSGASTGVHEAVELRDGDKTRWGGKGVTKAVHAVNNEIANAIIGLEAEDQELIDQTMIKLDGTPNKGKFGANAILGVSLAVAKAAAEARGLPLYRYVGGTAAHVLPVPMMNIVNGGMHADNPIDFQEFMIAPVGASSINEAVRIGTEVFHTLKKELSAKGMNTNVGDEGGFAPSLDSASSALDFIVDSISKAGYKPGEDVFIALDAASSEFYNKDQNIYDLKGEGRKLTSAQLVDYYVELCGKYPIYSIEDGLAEDDFEGWKILTEKLGDKVQLVGDDLFVTNVKRLSDGIERGIANSLLVKFNQIGSLSETLAAVNMANDASYTAVMSHRSGETEDTTIADLAVATNCGQIKTGSLCRSERIAKYNQLMRIEEELGSVAKYAGRSVLRKAK

SEQ ID NO: 14212 - protein, 341 aa, Rhodopseudomonas palustris CGA009
MPKGQRIVLASRPVGEPTPQNFRLEEFDVPAPGEGQVLLRTIWLSLDPYMRGRMSDGPSYAQPVPVGGVMEGGTVCEVIDSKSPGFAKGDIVLAHSGWATHAIADAKPLRKIDPALGPISTAVGVLGMPGMTAYTGLLDIGQPKEGETVVVAAASGAVGSAVGQIAKVKGARAIGIAGGKDKCDYVKQELGFDDCLDHRDPDLAAKLKAACPNGIDVYFENVGGEVFEAVFPLLNAFARIPVCGLIAQYNAFETPPTPKWATALMRHVLTKRLTIRGFIVSDFAGRRQEFLREMSGWVRDGKVKYREHVTDGLENAPEAFMGLLKGANFGKQLVRVGPERA

SEQ ID NO: 14213 - protein, 540 aa, Rhodopseudomonas palustris CGA009
MTAPSTSSASSVVPSGADTSPHVAAIHEKILIVDFGSQVTQLIARRVREEGVYSEIVPFQKAEAAFAEMKPKAVILSGGPASVLDDNAPSAPMTILEAGVPVLGICYGEQTLAKQLGGTVEGGHHREFGRAQIEITDDCALFDGIWQKGGKYDVWMSHGDRVTKLPAGFRAVAQAPGSPISVIADDTRKFYAMQFHPEVVHTPDGAKLLSNFVRKVAGLTGDWTMRAFREEAIEKIRAQVGTGKVICGLSGGVDSAVAAVLIHEAIGDQLTCVFVDHGLLRKDEGKSVVDLFRHHYNIPLVHVDVSETFLGALKGVTDPEQKRKTIGKLFIDVFEAEARRVGGADFLAQGTLYPDVIESVSFTGGPSVTIKSHHNVGGLPERMNMKLVEPLRELFKDEVRALGRELGLPDVFVGRHPFPGPGLAIRCPGEITEEKLEILRNADAVYIDQIRKAGLYDVIWQAFAVLLPVRSVGVMGDGRTYDYVVGLRAVTSTDGMTADFYPFEMSFLGATATRIINEVKGVNRVVYDVTSKPPGTIEWE

SEQ ID NO: 14214 - protein, 583 aa, Oryza sativa (indica cultivar-group)
MASGQPQFRYTQPPSKVIHLRNLPWDCTEEELVELGSPFGKVVNTKCNVGANRNQAFVEFADQNQAIAMISYFASSAEPAQVRGKNVYLQYSNRQEIVNSKSSGEAAGNVLLVSMEGVLPDAVSIDVLHLAIVTEFHGILAGYCIRNTCYQTCGRVNGEWKVAWVFSAFGFVQKIATFEKASGYQALIQFCDTETASSAKAALDVIGFQKFDVPCLLRINYSAHTVLNVKFQSHRSRDYTNPYLPVAPSAIDGSGPDGKKQEAESNVLLASVENMQYVVTIDVLHEVFSAFGFVQKIAIFEKNSGFQALIQYPDIQTAVAAKEALEGHSIYEGGYCKLHLTFSRHTDLNVKVNNERGRDYTGGNTAPTSNQPSILGPQPVYSGAYNNAPSSATGAVVPPGTTLTPPGAPSHPYTSSEPLPQTPAVPSGGAPLYTSQGILQGPPGVPPAQFPGYGSPQFPPGSAQAQMHQQHPVQGSQQMPGQMNHQPPPGSFMQYPGDGGRPVQDAPGQQAMPFHGHGGGQHLPPGYGGQPQFQQGPRPPMPPQQFPMYGDQQFPPGTGPQMMMPFAGQGGGQQQPFRPYNSH

SEQ ID NO: 14215 - protein, 272 aa, Hyphomonas neptunium ATCC 15444
MGMNRRLCLITGASSGIGAEFAKQYAALGWDLALTARRADRLQVLAAELHARHGVLVEVIPEDLANPGAPPRIIAALEGKGREIDALVNNAGYGLPGTFLSTSWSDQADFLQVLYTAPVELTHRVLPGMAARGFGRIINVASLAGYTAGSAGHTLYGSVKSAMIKFSESVAAECETLGHKDVHCTALCPGFTWSEFHDVNGMRETTNKMPKWMWMEAAPVVKAGIEAVNRGQPVVVPGVFNKAVATLTRILPEPVGRALAHSQTARYRKLEG

SEQ ID NO: 14216 - protein, 427 aa, Geobacter sulfurreducens PCA
MLTARSKDLFTQAQEFIPGGVNSPVRAFKSVGADPLFIKKAFGCTITDADNNSYIDYVGSWGPMILGHCHPQVVEAVKRAVESGSSFGAPTELEITLARMVIDAVPSIEMVRMVSSGTEATMSAIRLARGYTGRDKIIKFSGCYHGHADALLVKAGSGAATFGVPDSPGVPVDVAKNTLTAQFNDLDSVSKLIDENKNEIACIIVEPIAGNMGTVPPGEGFLEGLRSICDSEGIVLIFDEVMTGFRVAYGGAQELYGVTPDMTTLGKIIGGGLPVGAFGGKKDIMKLLSPSGGVYQAGTLSGNPLAMTAGIETLKLLQADGFYEQLEQTSRRLAEGITEAAKSAGYPIYPTRVGSMFCTFFTSNEVKDWPTATTCDTKAFAAFFRMMLEKGIYLAPSQFETAFVSIAHTEVEIEKTIVAARSCFAAL

SEQ ID NO: 14217 - protein, 246 aa, Malus x domestica
QMKSESYISLLIASFFVLLLPAFSSAAEESSTPIGCGHTSHRNMATLGGVHESHGAQNSAEVEDLARFAVQEHNNKENALLEFVSVVKAKEQVVAGTLHHLTIEAIEAGKKKLYQAKVWVKPWMGFKEVQEFKHADEEETPSVTSSDLGVKQGGHPPGWQSVPPHDPQVQDAANHAVKSLQQRSNSLLPYELQEVVHAQAEVAEEHAKFNMLLKVKRGSKEEKFKAEVHKNMEGTFSLNQMEADHS

SEQ ID NO: 14218 - protein, 162 aa, Geobacter sulfurreducens PCA
MAENNRAVIKLKEKFAASILDVREFRGEVTVTVAREKVVDICRFLKESLQYNLCTDVTAVDYLGKQEPRFMVVYNLYSIPNKDRLRLKAGVPDADCSIDTVSCVWNSANWLEREVYDLMGVQFNNHPDLRRILMTDDWVGHPLRKDYPLQGPDREPYKGRLS

SEQ ID NO: 14219 - protein, 250 aa, Brassica napus
MNSVSTFSELLGSENESPVGGDYCPMLAASCPKKPAGRKKFRETRHPIYRGVRLRKSGKWVCEVREPNKKSRIWLGTFKTAEIAARAHDVAALALRGRGACLNFADSAWRLRIPETTCAKDIQKAAAEAALAFEAEKSDTTTNDHGMNMASQAEVNDTTDHGLDMEETMVEAVFTEEQRDGFYMAEETTVEGVVPEEQMSKGFYMDEEWMFGMPTLLADMAAGMLLPPPSVQWGHNDDFEGDVDMNLWNY

SEQ ID NO: 14220 - protein, 160 aa, Methanosarcina mazei Go1
MPVSSNTEGVHMEQTYVMVKPDGVQRGLVGEVISRIEKRGLKIVALRMNVIAEATAKEHYGEHAARPFFPSLIEFITSGPSVSMVVAGKDAIKVMRAINGATNPVDAAPGTIRGDFALDVGRNVVHASDSPEAAAREIAIHFKDSEIANYSRVDEVCLYE

SEQ ID NO: 14221 - protein, 377 aa, Glycine max
MADAEDIQPLVVDNGTGMVKAGFAGDDAPRAVFPSIIGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTEYLVKILTERGYSFSTSAEKEIVRDVKEKLAYVALDFEQEMETTKSSSAVEKSYELPDGQVITIGSERFRCPEVLFQPSLIGMEATGIHETTYNSIMKCDVDIRKDLYGNIVLSGGSTMFPGIADRMSKEIGALAPSSMKIKVVAPPERKYSVWIGGSILASLSTFQQMWISKGEYDESGPAIVHRKCF

SEQ ID NO: 14222 - protein, 190 aa, Gibberella zeae PH-1
MSSTAKAVALSPAPYHIITYGTLLGTTFFHSFVNGIVAFRAVDRASFSAIQQKLFPIYFGLQTVLPGVLALTFPGNSLIGLANGPAGLVSEFARWHSLLPISVMGITGAINLLVLLPMTVDIIKKRRGQVKRDGKEYYAEGPHSDQMKALNKKFGMLHGISSLLNLATFVAAVGYGFTLGGRVLSVADLA

SEQ ID NO: 14223 - protein, 327 aa, Rickettsia prowazekii str. Madrid E
MNIIVKIQQNLKDEVTQLNDLIISCLKSDAELIEKVGKYLVEAGGKRIRPLLTIITAKMFDYKGNNHIKLASAVEFIHAATLLHDDVVDNSTLRRFKPTANVIWGSKTSILVGDFLFSQSFKLMVASGCIKAMNVLAKASVIISEGEVVQLVKLNERRIITIDEYQQIVKSKTAELFGAACEVGAIIAEQVDRVSKDVQNFGRLLGTIFQVIDDLLDYLGSDKQVGKNIGDDFLEGKVTLPLIFLYHKLEQDKQLWLENMLKSDKRTKDDFVKIRDLMLKHAIYNETVNYLSSLENEANNLLNKIPVQNIYKYYLFSIIRFILYRSY

SEQ ID NO: 14224 - protein, 361 aa, Colwellia psychrerythraea 34H [sequence omitted]

SEQ ID NO: 14225 - protein, 223 aa, Oceanospirillum sp. MED92
MTQDEMKKAVAEAAVEYIKPKLTEDSIVGVGTGSTANFFIDALAEIKHMFEGAVASSEATAERLKGHGIEVFDMNSVSEMEVYVDGADEFDSGLNLVKGGGGALTREKIVAAVAKEFVCIVDSSKKVDVLGEFPLPVEVIPMARSQVARELVKLDGMPEWRQGFVTDNGNLILDVHDLEIMRPKELEKQLNNIVGVVTNGLFANRGADVVLMGTESGVETIKL

SEQ ID NO: 14226 - protein, 528 aa, Glycine max
  misc_feature (388)..(388): Xaa can be any naturally occurring amino acid
MADSTPLLSQPNPSSSSSPDTQEAPPSNQHHPSLGSTVELCIGEFNWSQFLQSILVSLAWIFDAQQTFISVFTDALPEWHCTERGANACKTATTVCSLPKGSWAWDVPTQASIVSEWGLECANSAITGLPASMFFLGCLIGGFVLASLADSSLGRKNMLFFSCLVMAITSLLVTLSPNVWIYSALKFLCGFARATIGTSALVLASELVGKRWRGQISVIGFFCFTIGFLSLPAMAYINRSSSWRNLYLWTSISTMFYCILVKLFVTESPRWLLVRGKTEEAVETLKCITSITQSNLNLAINNMSHKEETWNVDIFSALKILLQKKWSSRRLSLIMAMGIGIGLVYYGMPLGLQNLSFNLYLSVTFNALSELPSALIVLFFVDKFNRRXALLLFTILSGVFSVMSIMEMKTSSWTNNIQIVFELVSFFSACSSFNVYLIYTTELFPTCVRNSALSMARLAVVLGGTFSPLLVSAARGNKFMCYGVFGLVIGFSGVFGIFLPETKGRALCDTMDEEENKEKNMTCDMFLA

SEQ ID NO: 14227 - protein, 97 aa, Glycine max
MAALGGIRDVAGTQTSLEVDGLARFAVEEPHKNQIPLLEFEKVVSPKHQVVFGTLSPPPLEAKNGGQKKVYEPKVWEKAWFNFKEGQKFKLVGEAPP

SEQ ID NO: 14228 - protein, 242 aa, Triticum aestivum
MKEVVLHVYDVTNSDSEKTNNTILQINRIFKDRIGLGGIFHSAVQVYGEEEWSFGFCENGSGVFSCPVSKNPMYTYRERIVLGETECTIATVNRILRELSRDWPGHSYDLLSRNCNHFCDVLCDRLGVPKLPGWVNRFANAGDTAVVVAENTAVKFRQAKTEIVNASRVAYRFMAGLTSKNQASQESPGEQNRGSPTFQGTWFKNVVSAGAKPSTSGSTPSQEADDAPPLQRQQSAEQPTRL

SEQ ID NO: 14229 - protein, 122 aa, Coprinopsis cinerea okayama7#130
MSIQRPTSKLPPGANRILFVKNLNYTITGEDLYELFGRYGSIRQIRIGNEAKTKGTAFVVYDDVMDAKNALDHLNGFHLQERYIVVLYHMPAKQDAAAAKAELARREEELAALKKKHDIGDA

SEQ ID NO: 14230 - protein, 390 aa, Geobacter sulfurreducens PCA
MASTEIMTVNMGPQHPSTHGVLRMVIELDGEVIQKITPHIGYLHRGVEKLSEHRTYHQTIPLTDRLDYLAPMSNNLGYVLAVEKLLGIEIPERAQTIRVIMAELTRLKSHLVWIACHALDIGAMTVFIYAFREREMIMSLYEKISGARMTSNYFRVGGLSSDVYDGFEKDVREVIDTFPGHFDTYEGLLTKNTIWVNRTVGNGVISAEDAVDYGITGPALRGSGVDWDLRRDNPYSGYEKYSFKVPVGEKCDTFDRYKVRLIEMREAVNIIRQALDSLKPGPVLADNPQVTYPPKENVYNSIEGLIHHFKIASEGFPVPEGEVYQSVEAPKGELGYYIVSDGGPKPYRMRIRPPSFVNLGAIEKMAKGSMIADLVAVIGTLDIVLGEIDR

SEQ ID NO: 14231 - protein, 284 aa, Zymomonas mobilis subsp. mobilis ZM4
MPKRTDLQSIMIIGAGPIVIGQACEFDYSGTQACKALREEGYRVILVNSNPATIMTDPDMADATYIEPITPEVVARIIEKERPDALLPTMGGQTALNTALALASDGTLEKFNCEMIGADATAIDKAEDRLKFRQAMDKIGLESPRSSVAHSLEEALDGLDYVGLPAIIRPSFTMGGTGGGVAYNKEEFIDIVSGGLSASPTQEVLIEESVIGWKEYEMEVVRDRHDNCIIICSIENIDPMGVHTGDSITVAPALTMTDKEYQIMRNASIAVLREIGVETGNWRF

SEQ ID NO: 14232 - protein, 323 aa, Vibrio angustum S14
MSRSFDFCSHGKKVLDIEIQALQNISQYIDDSFNKACQLVLDCQGKVIVMGMGKSGHIGRKLAATLASTGTPAFFVHPGEASHGDLGMIKQEDVVIAISNSGEASEILALLPVIKRLGIPMISMTGKPMSSMAKMAVINLQITVEKEACPLNLAPTSSTTATLVMGDALAISVMEARGFTADDFALSHPGGALGRKLLMRIADVMHTGKMLPIIEETASIKDALLEISKKGLGMTAIVNNKQQLSGIFTDGDLRRLLDNHVDIHNTSIGDVMSCNPQTISPQLLAAEGLKIMEDRKINGLLVTENAQLVGALNMHDLLKAGVM

SEQ ID NO: 14233 - protein, 132 aa, Geobacter sulfurreducens PCA
MIMPLINGLKITLKHMFMKPVTLQYPDERPTPSPNFRGLHALKVSHDKAKCVACYLCPTVCPAKCITVEAGEDATHDKYAERYEIDMLRCIFCGYCVEACPVDALKMTGQFELANYKREDFIFVKERLLEKK

SEQ ID NO: 14234 - protein, 880 aa, Rickettsia prowazekii str. Madrid E
MNKLIYYFGNNGSDGNASMNNILGNKGAGLAEMSNLKLPIPNGFTITTELCNYFYKHNNNFPKNFQNELQQAISKLEVTTGKIFGSTTSNPLLLSVRSGSTVSMPGMMDTILNLGMNNEVCNALADACGNKLFALDSYRRFLEMYGSTVLSIPSDLFEQIYENHKIQADIYKDSDITVELLEKIIDDFKRLHIKYDKQLINDPYEQLESAIKAVLYSWKNNRAIIYRKLNNISEDFGTAINIQEMVFGNLGKTSATGVAFTRSPSTGEKKLFGEFLINAQGEDIVSGTRTPMPIIANDSNSMQAMMPEVFKELSQIAKKLEEHYLDMQDIEFTIENNKLYILQTRTAKRTAIAAINIAVQMVKEKLISKEQALMRIDPESLNQLLHTRIDYSKGLTSIAEGLPASPGAATGIVVFSPYDAEKLSHHHKVILVRHDTSPEDINGMHVSSGILTIRGGMTSHAAVVARGMGKPCVCGTNNLSIDEQKQILIAGDIVIKQGDIITIDGGSGKIFLGEMPLIQPTFSEESKLILDWADEISSLKVRANAETVNDALVSIKFGAQGIGLCRSEHMFFDKNKIPLVREMIIAPDIERRQCALQKLLPLQTEDFKSLFRVMKNKPVNIRLLDPPLHEFLPTTEEDKKNLANSLNLPLSMIHQRLHAMHEVNPMLGHRGCRLGICLPEIYQMQIEAIFTAIFELHKKEHIESNLELMIPLISNVAEIKKLKMYIYEVVQELEQRYSYKFSFTLGTMIELPRAALESKKIAKEVDYFSFGTNDLTQTTYGISRDDIASFLPYYLEEKIFESDPFTTLDEEGVGELIEIAIKRGKSSNANLKLGACGEHAGNPTSIAFFHKANLNYVSCSPYRIPIARIAAAQAKIKQGS

SEQ ID NO: 14235 - protein, 349 aa, Oryza sativa
  misc_feature (87)..(87): Xaa can be any naturally occurring amino acid
  misc_feature (125)..(125): Xaa can be any naturally occurring amino acid
MAQGQLDAESVVPTATGVRRRGRRFWLFRFRSCFLDRFRRRICLSLGCTANILASLPTREGWWTAFVLYHGCWMTQQAATSVSLPRXVHAQFARRPDDVLLATYPKCGTTWLKVLSFAIANRRRXGDHPLLTQSPHDLVPFIEVPFHHLHPLAALDALPSPRLLSTHMPPQLLPRRVAELGCRIVYLCREPKDVVVSLWHYMNKGLRAVCRWLLPVRQYGPIWDHCLGYWKKSMEEPDMVLFLKYDDMMADPAGHVKKLAEFLRAPFTDEEVGAGVVEEVVRLCSFEKLSRLPVNSSGVVDRSSGRPMENSVFFRKGEVGDWKNYLTEEMAKKLDAVIEEKLKGSGLTF

SEQ ID NO: 14236 - protein, 914 aa, Thermococcus kodakarensis KOD1
MSEDINFDFAWKFLIGLIQNGKTEMKVSTLPNSLQKVAKSIGYEDDDTVPLLTLKEYLEKTWGHISPNPQVPKSPQEGWGQLEPESPSPQEDSPVDESLGDSDESIISEITPYLEAIQRVVTDADRTEKRLAIYLLLKNGEMYDPDLRKELAPLGQYFSKNKEPYKVKTIKNVISFVRNSPHVWSSKDPTTGMFVYRLKDETVKAILQELQMVLQEREVLQKQEELKQADEEKLVRAFFDFFMNYVEDGKHVFLDQLRNLLVLGEDRGLRVDWHVLDAVNPSLAERLINEPDVVISAAEKAVLEVLNEPEFMLYEERPRIHVRFVNLPKTISPRAVRSEHIGRLVQARGVVSAIAEGEKSNGVKGFIEKAVFVCPKCGYEVSLLQKPYENFVVPKECPACGARLSADNLSVEKSTVIDMREIFVQDPSDALHAAGTASYVRVILLDDNARMDVNPGDEVLITGVVRGIMRKKNGKPALGWVLEANSLTKLTKDIEDLEITPEDVQKFQDMVKDPEFDSKLIRSLAPAITGREVEKKAVLLALFSGEDYDITGTHVRKRSHVLLFGDASTGKSEIIRHAAQIAPGGVHSTGTHSSGVGLTAAIDSMDGVRVLRAGVLVLADRGVAALDELDKMREEDYDKMLDALEQGWFPYNKAGFNTRLMARAVVIAAANPPGGEFDRHNYKPFDELKRLFDQPFYSRFDLIIPTFRNTEDSVLEEIADAVLDKHEGKIEPPYDSELLTKFIAYARREIPRVVLPQALRGVMKKYMVDLAKAIGSAAPRAMEAIIRLTEAHARMHLRKEATLADFLAAKELFDEMITRLAGSSDEEEKEEVMKGLAGVIWTEEKKRKVDKLWSILKYYEALDERGEGVHINDIIEEAEQQGIERSEVLVLLEDMERANMVEQSKPGFYRLRRR

SEQ ID NO: 14237 - protein, 308 aa, Escherichia coli
INGFGRIGRIVFRAAQKRSDIEIVAINDLLDADYMAIMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 14238 - protein, 308 aa, Escherichia coli
INGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGAMKGVLGYTEDDVVSTDFNGEVCTSVFDAKAGIALNDNFVKLVSWYDN

SEQ ID NO: 14239 - protein, 308 aa, Escherichia coli
INGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEDEMKGVLGYTEDDVVSTDFNGEVCTSVFDAKAGIALNDNFVKLVSWYDN

SEQ ID NO: 14240 - protein, 354 aa, Myxococcus xanthus DK 1622
MQTPSPALPAADERLNWLSSIPFFAVHLMCLFVFAVGAKPVDVAVCVGLYVVRMWGITAGFHRYFSHRAFKTGRVFQFILAFVGSMSAQKGVLWWAAHHRHHHRYSDQAEDIHSPLQKGFWWSHAGWILSDKYNDTRMEGIKDFARFPELVWLNRFHLVPSVLLAVALYFIGGFSMLVWGFFVSTTLLWHGTFTINSLSHIFGKRRYKTTDTSRNNWLLALLTLGEGWHNNHHFHQNTANQGWFWWEVDLSYYSLKVLSWFKVVEGLRLPSEATKFAFQKYTDEERAALAAPTRFWGASGARAQFVATKAAGDAARAASDAAKAAGDKVREALTTAADHLPTSAPPPSAMLKRR

SEQ ID NO: 14241 - protein, 212 aa, Zymomonas mobilis subsp. mobilis ZM4
MSPENDIRLEAGRKLFAGAVNFLKSAPALEFLPAPTAPEVAFAGRSNVGKSSLINALTNRNSLARASTTPGRTQELNFFDVGEPLQMRLVDMPGYGFAKAPKDVVKRWKWLINDYLRGRAVLRRSLILIDSRHGIKDVDRDLMKMLDDAAISYRVVLTKSDKIKAVELEKTVKAITEEMRKHPAAFPEIIATSSEKGTGIAELRAAVYDAII

SEQ ID NO: 14242 - protein, 249 aa, Solanum lycopersicum
FNKSSRFARLQGIQCAIAGKNLYMRFSCSTGDAMGMNMVSKGVQNVLDYLQSEYPDMDVIGISGNFCSDKKPAAVNWIEGRGKSVVCEAIIKEDVVKKVLKTEVAALVELNMLKNLTGSAMAGALGGFNAHASNIVSAVYLATGQDPAQNVESSHCITMMEAVNDGKDLHISVTMPSIEVGTVGGGTQLASQSACLNLLGVKGANRDAPGSNARLLATIVAGSVLAGELSLMSAISAGQLVKSHMKYNR

SEQ ID NO: 14243 - protein, 391 aa, Burkholderia pseudomallei K96243
MKALCWHGKHTVRYETVADPAVEDPRDAIVEVRACSIGGADLHLYDAVIPGLKDGDVLGRECVGEVVEIGAGVSRRRVGERVVVPFAIACGECDQCRRGNWSVCETTNPHRALADKVFGHATGGLLGCGHLAGGYPGGQAQYVRVPHADVAPATIPDGVDDERALFVGDSLATGWQAAAQCEIEPGNVVAVWGAGAVGLFAAMSARLLGAAEVIAIDRVPERLALAQKLGATPLDFERLGVADTLAERTRGKGPDKCIDAVGLEAQAGEALDAVTDRFRPTVAAGADQPHVLREMIYACRPGGVLSVPGVYGGLVDKLPMGALMHKGLTLRAGQTHVCRWTAGLLERIADGRLDPSCVITHRATLEEGPAMYETFGARRDGCIRPVLRPRH

SEQ ID NO: 14244 - protein, 177 aa, Methanosarcina mazei Go1
MGCPEVQDRPGSGYELEETPAPVPVEPCLGSRPWTLSGGLSMVLKNIKYALKNIPKERVTRLCPEVESPLSERFRGLQTLDKSKCIGCGICANTCPNSAIKIVKAPIAPGSEKKRWFPQIDIGHCLFCGLCIDQCPKGALSSGKEYCKGMVKWAHKDLLMTPEKLAREVDIQEGDER

SEQ ID NO: 14245 - protein, 319 aa, Rickettsia prowazekii str. Madrid E
MINTNNYRIIAKRVISSATSALETLSNNIPSDFNRIIEFLLSFKGRIILTGIGKSGYIARKIAASFSSTGMPSFYLHPAEASHGDLGMITRNDLVMMLSNSGETKELFNIIEYCNNSSIKIAAMTMNKNSTLAKRSDFLLKIPECQEASLIGTPTISSLIMLSLGDAIMTVIHEERGFTRDDFKIYHPGGTIGANLTKIKNIMRSGDEIPLVYEDTSFTETIIIMNKKRLGCTLVTDKEQNLIGIITDGDLRRNIHDQIHLKTASSIMTKNPHYISSEIFAQEALNLMKAKNITNIPIVDDNIIIGIIHIHDLLSMGVS

SEQ ID NO: 14246 - protein, 264 aa, Thermococcus kodakarensis KOD1
MVLYFIGLGLYDEKDITLKGLETARRCDKVFAEFYTSLLAGTTLEKIEELIGKPIVRLSREDVELNFERIVLPEAKDKDVAFLTAGDPMVATTHSDLRIRAKKAGVKSYVIHAPSIYSAVAITGLQIYKFGKSATVAYPEKNWFPTSHYDVIRDNKERGLHTLLFLDIKADQNRYMTANEAMEILLKVEEMKGEGVFTPETLVVVLARAGSLEPTLRAGYVRELINEDFGRQPHVLIVPGRLHIVEAEYLVEFAGAPEKILEEV

SEQ ID NO: 14247 - protein, 449 aa, Bacillus anthracis str. Ames
MFFTQFFKPAPHAERLPADRVDSEYRKLRLQVFLGIFIGYAGYYFVRKNFSLAMPYLIEQGFSKGELGVILSAVSIAYGLSKFLMGIVSDRCNPRYFLAAGLFLSGIINIIFGSFSFITTSIILMFVLQFLNGWVQGMGWPPCGRTMVHWFSISERGTKMSIWNVAHNVGGALMPSLVTLGLYFFANDWKSIFYFPGILSILVGVYVLITMKDTPQSCGLPSIEEHTGEYPPDEKIKDRERELSAKEILFKYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLKTGSVKQKQA

SEQ ID NO: 14248 - protein, 278 aa, Coprinopsis cinerea okayama7#130
MANDSSNQAKVAIPPLNLEEEDNIILTRITNDERPLRRVLKRFHGYVAAVCPPGPVTTSASSIEDAREAFLVELASYQLSLKKSAMVCEAETRQVEEYRRERQRIEQEHEVLRTQIEELKVALEHAQMLRRRKIEYDQVTERVNMLPPRDELEHQKAALDDIVTDLTNLRFIGKDKDATSIPTSPEDAPVDLPETGPEPTSESQSTPDNEKDNRSEATALDVSTSDKVPEEGAVEDDIEMGEVEEEPRDKTKKKPREEELEEGEASDQSSELSEPPDD

SEQ ID NO: 14249 - protein, 298 aa, Bacillus anthracis str. Ames
MPNIAVVGSISMDLVAVSKKRPKAGETVIGEAFHTIPGGKGANQAVAAARLGANVAMVGAVGDDNYGTVVKRNLENERVFIDYVVPVTDAATGIAHIVLAEEDNSIVVVQGANALVNESVVNRSKDLLIKADMVVLQLEIPLETVKYVLAICQEHKIPVMLNPAPAQVLSEDILEKATYITPNEHECRIVLDDFTSPIEDLLAKYPNKLLMTEGSNGVRFHNGTEIVHVPSIAVDVVDTTGAGDTFNGALAVALSEGETLQKAIRFANIAGGLSVTKLGAQGGMPTRDRVREVQVIVG

SEQ ID NO: 14250 - protein, 413 aa, Oryza sativa
  misc_feature (76)..(76): Xaa can be any naturally occurring amino acid
  misc_feature (304)..(304): Xaa can be any naturally occurring amino acid
MEYGAATRGALLAAAPLSGARRSWLPLSSPPSPPSIQIQNRLYSISSLPLKARGVRRCEASLASDYTKASEVADLXWENLGFGIVQTDYMYITKCGQDGNFSEGEMIPFGPIALNPSSGVLNYGQGLFEGLKAYRTTDDSILLFRPEENALRMRIGAERMCMPAPSVEQFVDAVKQTVLANKRWVPPTGKGSLYIRPLLMGSGAVLGLAPAPEYTFIIFVSPVGNYFKEGLAPINLIVEDKFHGAAPGGTGSVKTIGNYASVLMAQKIAKEKGYSDVLYLDAVHKKYLEEVSSCNIFVVKAFAXGNVISTPAVKGTILPGITRKSIIDVALSKGFQVEERLVSVDELLEADEVFCTGTAVVVSPVGSITYQGKRVEYAGNKGVGVVSQQLYTSLTSLQMGQAEDWLGWTVQLS

SEQ ID NO: 14251 - protein, 459 aa, Arabidopsis thaliana
MSTKRVDMGSRDYISSLPDEILGKILSLFCTNRAACTSVLSKRWRNLLELVDNLDLNDAYGNHQYFCDFVDRTLALLSNSTTVKRFSLNCAFHNDASRVNSWIRTVFDRGFLDLHLETAHMHRIDTEFFTSNTLLELTICGGFYAEGRLPPGRVFFPALKSLSLVSVEFTDTLMYQNFISGCPVLEELFLHYDNETQCPAWKGLVSSPSIKRLNIYDNPSELRYEAYKCCFQIPSLVYLDYSSYVAKQYAVDLVSLEEARLNIRYPERLVDQNEDIFGDVTDLLKGISNVKTLHLSSDSLEVFHLCCDTMPVFHNLLTLSFESDEEIGWQVVPLLLNKSPNLETLVIKSLVHQVTDMCGNACACISKRRKKKKKTTEDDECCLSTCQVKVLNISGYRGTCKELKQMRHFLENLKCLETVNVGVDVKRREYKNGNNKYQRITNAVMELPRFSSNCQIQFF

SEQ ID NO: 14252 - protein, 136 aa, Brassica napus
  misc_feature (134)..(134): Xaa can be any naturally occurring amino acid
MVSYPATTETISLALEANSSEAIQILYQVLEDPSSSPEALRVKEQAITNLCDRLTEEKRGEDLRTLLTKLRPFFSLIPKAKTAKIVRGIIDAVAKIPGTTDLQITLCKEMVQWTRAEKRTFLRQRVEARLAALXME

SEQ ID NO: 14253 - protein, 374 aa, Methanosarcina mazei Go1
MEEMLESNEMIVHLGPQHPMQPGPFRLNLKLKGETIMDAEVEMGYIHKGIEKILENRTYLQGITIVDRICYLVALTNEECYVGCVEKLLDIEPPERAQYIRVILEELSRLQSHLLGLGEYGEFIGFVSMFMYTIKEREDILTLIDMVTGARVTHSYLRFGGVRDDLPEGFKEKTIPVLNKLKKVIRDYEEMFYSDTIYRERTIGIGVLTADEAKSLGVSGPVLRATGVPFDIRKNEPYLVYRDLDFKVCTETAGDCFARVQVRLNEMRESIYIIEQCLDMIPNGPIFPEGTPYGKRTPVMRVPAGEVFHRVEDPRGEMGMYMVSDGSDRPYRVKVRGPYYPTLQALPPLIIGTTVADMVSISGSMDGCTSEVDR

SEQ ID NO: 14254 - protein, 571 aa, Nicotiana tabacum
MLTYERFWKKKVPLNRTMFGDYEVMHIIYPGLPSSPPSGIDSGNGPTGSAVNQQFPITADFVNKSQRMSPRVIFLIASSALVLLVVCCGALVVLLKCRRTGRPSNAVGPVFTPSMHKRSGKGIGSTISSSPTSSTSISLISAMPASILSVKTFTLAELERATDKFSLKRVLGEGGFGRVYHGILEDRTEVAVKVLTRDNQNGDREFIAEVEMLSRLHHRNLVKLIGICSEERTRSLVYELVRNGSVESHLHGRDGRKEPLDWDVRLKIALGAARGLAYLHEDSNPRVIHRDFKASNVLLEDDFTPKVADFGLAREATEGSHHISTRVMGTFGYVAPEYAMTGHLLVKSDVYSYGVVLLELLSGRKPVDMSQPPGEENLVTWARPLLTTREGLEQLVDPSLAGSYDFDDMAKVAAIASMCVHPEVTQRPFMGEVVQALKLIYNDNDETCADGCSQKESSLPDSDFKGVPSDSSWWNAGGVTPRLTYGQASTFMTMDYSSGPLEEFENRPFSASSFNLGGGAGLTISHGNRSGPLRTVRSKPALYRLRGSMSEHGALLPRHDWRDGTNYDASF

SEQ ID NO: 14255 - protein, 271 aa, Burkholderia pseudomallei K96243
MKCTLKPIGEQTIVITGATSGIGLVTARKAAKKGAKLVLVARNDTALEALCEEIRQHGGLAVAVAADVSRYEDVQRAAAKAVETFGGFDTWINNAGVTIFGSALSVPLDDQRRLFDTNYWGVVHGSLVASEHFRRQSDFRGGAIINMGSEASDAPVPLQSAYAASKHAIKGFTDSLRIELEADNVPVSVTLVKPAAVDTMFVMHAKNYMNVEAKLPPPIYDPDIVADAILFAAEHARRTLFVGGAAKLASSGAYHAPRLFDRLATSLFSRG

SEQ ID NO: 14256 - protein, 111 aa, Vibrio parahaemolyticus RIMD 2210633
METIDKIKQQISENSILLYMKGSPKLPSCGFSSQASQALMACGEKFAYVDILQNPDIRAELPKYAQWPTFPQLWVEGELIGGCDIILEMFQKGELQPLIKEAAARAEGQAE

SEQ ID NO: 14257 - protein, 350 aa, Pseudoalteromonas tunicata D2
MTTPVSQTATKNRQWLLASRPVGAPTISDFNFVATDIPTPKEGEVLLRTVYLSLDPYMRGRMSDAKSYAEPVAINDVMVGGAVCVVEKSHHSDYSEGEWVVAFAGWQDYSVSDGTNLLKLGKNPTMPSYALGVLGMPGLTAYMGLLDIGQPQAGETVVVGAATGAVGSLVGQIAKLQGCKVVGIAGGAEKCEFAVQTLGFDACLDHTRDDLAAQLAQVCDAGINVYFENVGGKVFDAVLPLLNSKARIPLCGLISQYNATQLPDGPDRLSLLMGNLLIKRIKMQGFIVFDDYGHRYQEFSQAMQAWLAEGKIHYREDRVEGFEQTAAAFIGLLTGQNFGKLVVRVGPDAL

SEQ ID NO: 14258 - protein, 246 aa, Oryza sativa (japonica cultivar-group)
MAAAAAAAAEEEEEKESGSSRMITLKSNDEKLVEVTEASARQSRAIANLIDDGCADVIPLPNVDSKTLAKVIPYCDEHGRANSGTDEERAALGRFDADFVGELDKDKASLIDVIMAANYLNIQGLLDITCQRVADTIGSATAEKIREAFDIEDDLTEAEKKEIREENAWAFDGIPCLLVGIWFDGGIPIQEIRLQICNISQWSVLDRSGNAFPAREFALGASLVLLAWIVVRIELRMGKKHRCDFI

SEQ ID NO: 14259 - protein, 768 aa, Zea mays
MEINEEAMAAHKRAFLDFLDQDVGKGVYMQAVRDMVQNKRHRLIIGMDDLRNHNLDLARRVIRTPGEYMQPASDAVSEVARNLDPKFLKEGERVMVGFSGPFGFHRVTPRDLMSSFIGTMVCVEGIVTKCSLVRPKVVKSVHFCPVTGDFLSREYRDITSFVGLPTGSVYPTRDDNGNLLVTEYGMCEYKDHQTLSMQEVPENSAPGQLPRTVDVIVEDDLVDCCKPGDRVSIVGVYKALPGKSKGSVSGVFRTVLIANNVSLLNKEANAPVYTREDLKRMKEISRRNDTFDLLGNSLAPSIYGHLWIKKAVVLLMLGGVEKNLKNGTHLRGDINMMMVGDPSVAKSQLLRAVMNIAPLAISTTGRGSSGVGLTAAVTSDQETGERRLEAGAMVLADRGVVCIDEFDKMNDQDRVAIHEVMEQQTVTIAKAGIHASLNARCSVIAAANPIYGTYDRSLTPTKNIGLPDSLLSRFDLLFIVLDQMDPEIDRQISEHVARMHRYCTDDGGARSLDKEGYAEEDDGDANAAIFVKYDRMLHGQDRRRGKKSKQDRLTVKFLKKYIHYAKNLIQPRLTDEASDHIATSYAELRDGSANAKSGGGTLPITARTLETIIRLSTAHAKMKLRHEVLKSDVEAALQVLNFAIYHKELTEMEEREQREMEMKQQADHDAGATGGTVDGHGSSGNDPMDVDVGSNDQNVSAERIEAFEALLGQHVLANHIDQMSIDDIEQMVNRESTAPYTRSQVEFILERMQDANRVMIRDGVVRII

SEQ ID NO: 14260 - protein, 209 aa, Azoarcus sp. BH72
MPLFRNAQFEISIAKPSGLPPPNGAEIAFAGRSNAGKSSAINTLAGHVRLAYVSKTPGRTQLINFFRLNCGALLVDLPGYGYAAVPEKIRRQWQGLIETYLRTRESLIGLVLMMDSRHPMTDLDRQMIDWFAPSGKPIHVLLTKSDKLSRGPANATLLAVRAELTARYGDQVSVQLFSSLKKTGVEEVEKVVAGWLVPAAAEGEAPAGA

SEQ ID NO: 14261 - protein, 512 aa, Oryza sativa (japonica cultivar-group)
MDKAYIAVFSIVILFLLVDYLRRLRGGGTSNGKNKGMRLPPGLPAVPIIGHLHLVKKPMHATLSRLAARHGPVFSLRLGSRRAVVVSSPGCARECFTEHDVAFANRPRFESQLLMSFDGTALAMASYGPHWRNLRRVAAVQLLSARRVGLMSGLIAGEVRAMVRSLCRRPAAAAPVQLKRRLFELSLSVLMETIAQSKATRPETTDTDTDMSMEAQEYKQVVEEILERIGTGNLCDYLPALRWFDVFGVRNRILAAVSRRDAFLRRLIYAARWRMDDGEKKSMIAVLLTLQKTQPEVYTDNMITALCSNLLGAGTETTSTTIEWAMSLLLNHPETLKKAQAEIDASVGNSRLITADDVPRITYLQCIVRETLRLYPAAPMLIPHESSADCEVGGYSVPRGTMLLVNAYAIHRDPAAWEEPERFVPERFEGGGCDGNLSMPFGMGRRRCPGETLALHTVGLVLGTLIQCFDWERVDGVEVDMAEGGGLTMPKVVPLEAVCRPRDAMGGVLREL

SEQ ID NO: 14262 - protein, 351 aa, Streptococcus agalactiae NEM316
MRAATYLSANELSLTDKAKPQVIKPTDAVVRLVKTTICGTDLHILGGDVPACKPGTTLGHEGIGIVEEVGSAVNHFKVGDKVIISCVTACNTCYYCKHQLPSHCEDGGWILGHLIEGTQAEYVHIPHADGSLYHAPEGVCDDALVMLSDILPTSYEIGVLPSHIKPGDTVCIVGAGAIGLSALLTAQFYSPAKIIMVDLSQKRLEASKKFGATHTILSTSTQEVKEEIDKITKGRGVDVVLECVGYPATFDICQNVVSIGGHIANVGVHGKPVEFNLQDLWIKNITLNTGLVNANTTEMLLEVLETGKIDATQLVTHHFKLSEIEEAYKVFKAAEENNTLKVIIENDITPA

SEQ ID NO: 14263 - protein, 222 aa, Azoarcus sp. BH72
MTQDELKKAAALAALDYVEDGMIVGVGTGSTVNHFIDGLAGIKHRIRGAVSSSEASSKRLAAHGIALLDLNDVDELPVYIDGADEIDHGFAMIKGGGGALTREKIVAAVARRFVCICDESKRVDVLGRFPLPIEVIPMARSQVMRAAAALGATPRLREGFVTDNGNLIIDLHGLSITDPCATEQALNAVVGVVTNGLFAARGADTLLLASAQGVRRFERSAT

SEQ ID NO: 14264 - protein, 537 aa, Isatis tinctoria
MGNCCGTAGSLAQNDNNKPKKGRKKQNPFSIDYGLHHGGGGGGALKLIVLSDPTGREIEQKYKLGRELGRGEFGVTYLCTDKETDEVLACKSILKKKLRTAVDIEDVRREVEIMRHMPVHPNVVTLKETYEDEHAVHLVMELCEGGELFDRIVARGHYTERAAAAVTKTIMEVVQVCHNNGVMHRDLKPENFLFANKKETAPLKAIDFGLSVFFKPGERFNEIVGSPYYMAPEVLKRNYGPEVDIWSAGVILYILLCGVPPFWAETEQGVAQAIIRSQLDFRRDPWPKVSENAKDLIRKMLDPDQKRRLTAQQVLDHPWLQNAKTAPNVSLGETVRARLKQFTVMNKLKKRALRVIAEHLSDEEASGIREGFQIMDTSQRGKINIDELKIGLQKLGHAIPQDDLQILMDAGDIDKDGYLDCDEFIAISVHLRKMGNDEHLKKAFAFFDQNDNGYIEIEELREALSDEVGTSEEVVDAIIRDVDTDKDGRISYEEFATMMKTGTDWRKASRQYSRERFNSISLKLMQDASLQVNGDAR

SEQ ID NO: 14265 - protein, 161 aa, Triticum aestivum
MARHHLLLFPPLLALAFSFVVAAPEGDAAAFIDGASHRYLRDQQEDQATSMSLDEVSAAVSVLLGFAPPAMLPAPSSAKLNKLLLPNPFDRPRSVFLMQLDGSHDYVDGFISDAGSIYKTKIDGAKSAAIELTDKDELIVIRSDESSGLDVLDNELANLPL

SEQ ID NO: 14266 - protein, 445 aa, Colwellia psychrerythraea 34H
MNNNQTKHGITQAQLDAHWMAFTGNREFKKDPRIIVSAQGNYYTDADGRKIFDGLSGLWCCGAGHSRPEITEAVSKQLKQLDYAPAFQFGHPKAFQLAEKIVEFMPKGINRVFYTGSGSEAAETSLKMARAYWRKKGLASKTKLIGRGLGYHGVNFGGISVGGIGANRSLFGPAVDADHLRHTMLDENKFVKGQPQTGVELANELLDLVALHDASNIAAVIVEPMAGSAGVIPPPVGYLNRLREICDQHNILLIFDEVICAFGRMGANTGAEAFGVTPDIINIAKQMTNGTIPMGAVIAKQEIYETFMEQGGPEYMVEFPHGYTYSAHPVACAAGLAALEILQTDKLIERVKDHSPYFEESVHNLKGCKHVTDIRSYGFAAGFTIDPVPGEPALRPYQIAMKMWQKGFYVRYGGATIQLGLPFTSEREEIDSLLSALGETFNEIA

SEQ ID NO: 14267 - protein, 311 aa, delta proteobacterium MLMS-1
MSTSREQAREVLRLEAEGIEAVRERIDDAFERAVELIMACPTRLIVSGIGKSGIIGQKIAATMNSTGTPALFLHPVEAMHGDLGIVDPRDVVLAISYSGETAELNLLLPTLKSRGARIIAMTGRPDSGLAAAADAVLNVAVPCEACPLGLAPTASTTATLALGDALAVVLLRRKNFAAGDFRRNHPGGSLGERLKIRVSEVMLTGAEIPTVAEDASLPEAVAELNRKNLGAVLVMAADGETMVGILTDGDLRRMVADGRQADFAELSLTAVMGRDPKCITPELLAADALSIMQRHEVTVLPVTDARRRLSD

SEQ ID NO: 14268 - protein, 350 aa, Bacillus anthracis str. Ames
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNSLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 14269 - protein, 97 aa, Triticum aestivum
MAPTAMASWATSVAPLQGLKSTAGLPVSRRSNGASLGSVSNGGRIRCMQAWPIQGIKKFETLAYLPPVSTEALLKQVDYLRRSKWVPSLESSKGALI

SEQ ID NO: 14270 - protein, 303 aa, Zea mays
ERIKAVRQMIMAPTVELRQLSLDRLLPYQRSDFEGIFRAMDGLSVTIRLLDPPLHEFLPEGNVEEIVRELCSETGANQEDALARIEKLSEVNPMLGFRGCRLGISYPELTEMQARAIFEAAIAMTNQGVQVFPEIMVPLVGTPQELGHQVALIRQVANKVFTSMGKTIGYKIGTMIEIPRAALVADEIAEQAEFFSFGTNDLTQMTFGYSRDDVGKFIPIYLAQGILQHAPFGVFAQRGVGELVKLFPERGRKVRPNLKGGICGEHGGDPSSVVFFPKTGGDYVFCSPFRVPIVRLAAAQVLF

SEQ ID NO: 14271 - protein, 315 aa, Bradyrhizobium japonicum USDA 110
MPVVLDPDAAAVYMAFQEAGRPAYETLTAAEARAYYAQARFATNPEPPELARVAPLAIPAPHGTIPARIYVPNDPRRHDGLSPALVFFHGGGWVIGDLDSHDVVCRQLAVEAALIVISVDYRLAPEHKFPAAADDAIAATKWVAANACELGIDASRLSIGGDSAGGNLAAVVALAARDDSGPAIAGQILIYPAVDFAMTHGSHSEPETSVLLTHSVIRWFRDHYLNGAADIHDWRASPARAENLAGLPPAYVLTAGADPLRDEGDEYAARLKQAGVSVTYKHFPGQFHGFFTMGKLLREANVAVSEIGAWLKGLG

SEQ ID NO: 14272 - protein, 499 aa, Oceanospirillum sp. MED92
MSTATFSPSEAAQAFLQRQHKILIGAEWQAAQDGRTLDVVNPADGEKIATVPSGGAEDIDRAVSAAKQAFEDSEWSRIKPVDRQKLLWDFADLIEKNAPLLAELEALDNGKSVVIAEHVDIRLAVDFLRYMAGFATKIEGRSVDVSVPFMPDAQFHGYTRREAVGVVGAIVAWNFPLLLACWKLGPALATGCTVVLKPAEDTPLTALKLAELALEAGYPPGVFNVVTGLGHEAGAALSSHPDVDKLTFTGSTEVGKLIGKAAMDSMTRVTLELGGKSPTIVLQDADLQNAAAGAANAIFFNQGQVCCAGSRLYVHKKHFDNVVADISDIANGMTLGAGLDPNAQMGPLVSAKQQQRVCGYIDQGITSGAKVVAGGSAADGPGFFVKPTVMVDVDHNASVVKEEIFGPVLVAMPFDDIDEAVRIANDSQYGLGASIWSNNLSEVHRMIPRIKSGSVWVNCHTALDPALPFGGYKQSGLGREMGSDVIEHYTEVKSVLMSI

SEQ ID NO: 14273 - protein, 246 aa, Oryza sativa (japonica cultivar-group)
MKEVVLHVYDVTNSDSEKTNNTILQINRIFKDRIGLGGIFHSAVQVYGEEEWSFGFCENGSGVFSCPIGKNPMYTYRECIVLGETECSIATVNRILRELSREWPGHSYDLLSRNCNHFCDVLCERLAVPKLPGWVNRFANAGDTAVVVAENTAVKFRQAKTEIVNASRVAYRFMAGLASKNQNPQPESPSNQSRNGPTFQGTWFKNIISNGAKPSSSESTSSHDTGTGGDESSLQNQKPSEQSTRL

SEQ ID NO: 14274 - protein, 687 aa, Azoarcus sp. BH72
MPVFSGRPSGFEETMSQSRNVKPPVFNPVTGAIRALAMDAVQQANSGHPGAPMGMAEIAEVLWRHHLKHNPANPHWADRDRFVLSNGHGSMLIYALLHLTGYDLPIEEIKRFRQLHSKTPGHPEYGYTPGVETTTGPLGQGITNAVGMAIAEKVLAAEFNRAGHEIVDHRTWVFLGDGCLMEGISHEACSLAGTLGLGKLVAFYDDNNISIDGHVEGWFTDDTPKRFEAYGWQVIRDVQGHDPAEIEAAIQQARANTTQPTLICCKTVIGAGAPNKQGGHDVHGAPLGTTEIDACRAHIGWTHAPFEIPADVYAAWDARPAGASAEAGWNDKFAAYAAAFPELAAEFKRRVQQQALPADWAAHVATVLGKINDKGETIATRKASQNSIEAFAPKLPELIGGSADLAGSNLTLWSGAKGVSRDTGGNYIYYGVREFGMAAIANGIALHGGLIPYTATFLMFSEYARNALRMAALMKLRQIFVFTHDSIGLGEDGPTHQPVEQTATLRLIPNMDVWRPCDTMESAVAWAHAIERKDGPSCLLFSRQNLPFQARSAEQIDAIRRGGYVLSEAAGGTPKAVILATGSEVALAMAAQKTLAEAGIAVRVVSMPSTNVFDRQDAAYKAAVLPAGLPRIAVEAGVTDGWRKYVGLEGEVIGLDRFGESAPAGELFKYFGITADAVVEAVRKLVR

SEQ ID NO: 14275 - protein, 338 aa, Azoarcus sp. BH72
MTIKIAINGYGRIGRCTLRALYELGLRDQFEVVAINASGDLATNAHLTKYDTTHGRFAFPVETEGDNVMIVNGDRIPFFSTKDPLAINWGDLGVDVLLECTGAYTAKAKAEVHLKQGAKKILISAPGGDDVDATIVYGVNHDVLTAAMTVVSNASCTTNCLAPVAKVLQDNIGIEKGLMTTIHAYTNDQVLVDVRHKDLRRARAAAQNIIPTKTGAAKAVGLVLPALKGKFDGFALRVPTMNVSLVDLTFTASRATSKEEINSLMIEASKGALKGVLAVNEAPLVSMDFNHDPHSSVFDATQTRVMDGNLVKVLAWYDNEWGYSCRMLDAAKALAQAK

SEQ ID NO: 14276 - protein, 394 aa, Azoarcus sp. BH72
MQVKKLTDLDVRGKKVFIRADLNVPQDEAGNITEDTRIRASIPSIQYCLDNGAAVMVTSHLGRPTEGEVGPDDTLAPVAVRLGQLLHKPVKLIANWVEGGFEVKPGEVVLLENCRCNKGEKKDNEELAKKMAALCDVYVNDAFGTAHRAEATTHGIARFAPVSCAGILMGAEIDALSKALHQPARPLVAIVGGAKVSTKLTILKTLADKVDQLIVGGGIANTFLLAAGKRIGESLAEPEMVREAQQVMDIMKSRGAEVPLPIDVVVADEVSALARANRISVDEVGPHDRILDFGPKTSAKLADIIAHAGTIVWNGPVGVFEHAQFAGGTKMMASAIAHSEAFSIAGGGDTLAAIAKFHIADDVGYISTGGGAFLEFLEGKKLPAIAALEARYEG

SEQ ID NO: 14277 - protein, 229 aa, Listeria innocua Clip11262
MKLVLIRHGQSEWNKLNLFTGWHDVDLSEEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPSGENLKVTLERVIPYWMDTIAPEIKAGRRVVIAAHGNSLRALVKFLEGISDDEIMELEIPTGVPLVYELNDDLKPVNKYYLDK

SEQ ID NO: 14278 - protein, 408 aa, Rickettsia prowazekii str. Madrid E
MPIKILMPALSPTMREGNLARWLKKEGDKVNPGEVIAEIETDKATMEVESVDEGILAKIIIPQNSQNVPVNSLIAVLSEEGEDKADIDSFIAQNNSVSLSLKTDATLKKSNDSITNVEGIKHDSNKIFASPLAKRLAKIGDIRLENVQGSGPHGRIVKQDILSYDSSTSSNKIVYRDTEEYRSVPNNNIRKIIAKRLLESKQTVPHFYLSIECNVDKLLDVREDINKSFSEDKVTKISVNDFIILAVAKALQEVPNANASWSEDAIRYYNNVDISVAVAIENGIVTPIVKDANKKNIIELSREMKTLIKKAKDNKLTPIEFQGGGFTISNLGMYGIKNFNAIINTPQSCIMGVGASTKRAIVKNDQIIIATIMDVTLSADHRVIDGAVSAEFLASFKRFIENPVLMLI

SEQ ID NO: 14279 - protein, 563 aa, Arabidopsis thaliana
  misc_feature (75)..(75): Xaa can be any naturally occurring amino acid
MMISEKPLGEESIRQDLEVLTVSRRLVKSVSQKLKKKIHKTEVVEDEEVARGAVNCLSISVGCRVADTGEDFEEXLSNKRWSSASEEGKGLMTICGTEEIRLDCFSYGVRERFWKNNNRRYLADLGQDYRKHVYLPDDILEMCLMRLPLTSLLNAHLVCKKWQSMANTQRFLQMRREGSFQTPWLFLFAALKDGCSSGDIHGYDVSQDKWHRIETDLLKGRFMYSVTSIHEEIYIVGGRSMDRNSFKSHRGILVFSPSIKAWRKIASMRHARSLPIVGATEVTSEFSTMQTKQNRQDRRFHLSRVGGESDVYEDPHRLSVRRQNRNSADQNGTKSHRLIRQKLDRLNRNSSKRFVLIAIGGTGLFDEPLDSGEIYDSATNTWSEMQRLPMGFGVVSCGIICNGIFYAYSENDKLSGYDIERGFWITIQTSPIPPRVHEFYPKLVSCNHRLFMLSVSWCDEGDGQIGRRNKAVRKLWELDLVYLTWTEVSVHPDAPMDWNATYVSDQNILMGIEMFKIFGQVLSFFTVCDVLTEEASWRHVSRNQRSQKLNLSCTNKTIALLHL

SEQ ID NO: 14280 - protein, 337 aa, Petroselinum crispum
MEVERVQAISKMSRCMDTIPSEYIRSESEQPAVTTMQGVVLQVPVIDLGSSNNTEENLVELIAEASREWGIFQVVNHGIPDDAIAKLQKVGKEFFELPQQEKEVIAKPEGYQGVEGYGTKLQKELGGKKGWVDHLFHIIWPKSAVNYNFWPNNPPLYREANEEYAVALRGVVDKLFEALSLGIGLEKHELKKASGGDDLIYMLKINYYPPCPRPDLALGVVAHTDMSAITILVPNEVQGLQVHKDDHWYDVKYIPNALIIHIGDQIEIMSNGKYKSVYHRTTVNKDKTRMSWPVFLEPPPELLTGPISKLITDENPAKFKTKKYKDYVYCKLNKLPQ

SEQ ID NO: 14281 - protein, 608 aa, Nocardia farcinica IFM 10152
MTRTLEPSAAPEEALDPQTRVETWLREFETALAARDIEAAAGMFAVDSFWRDLIAFTWNIKTVEGRDGVTDMLRARLDDTDPRGFHTTEPVTEADGVITAWIGFETAVGRAAGHLRLTDGGAWTLLTSLRELKGHEENKGPRRPKGVEHGATRERVTWSEQREQEERELGVTRQPYVVVVGGGQGGIALGARLRQLGVPALVVDKHDRPGDQWRKRYKSLCLHDPVWYDHLPYLPFPDNWPVFTPKDKIGDWLEMYTKIMEVPYWSKTVCRSATYDEQTGEWTVHVERDGEPLVLRPKHLVLATGMSGKPNIPNFPGMDRFQGDQHHSSQHPGPDAYAGKRAVIIGSNNSAHDICGALWEAGADVTMVQRSSTHIVKSDSLMELGLGDLYSERALAAGMTTDKADLTFASMPYRIMHQFQIPIYDAIRERDADFYARLERAGFQLDWGDDGSGLFMKYLRRGSGYYIDVGASELVANGDIKLAHGQVRELTEHSVILEDGTELPADLVVYATGYGSMNGWAADLIGQDVADKVGKCWGYGSGTTKDPGPFEGELRNMWKPTQQDGLWFHGGNLHQSRHYSLYLALQLKARYENIPTPVYGLQEVYHLS

SEQ ID NO: 14282 - protein, 106 aa, Triticum aestivum
AYLGDTIEQVCTKKQAGTGPEFPGYRRPTRPHRSGKIVVELNGRLNKCGVISPRFDVGVKEIEGWTARLLPSRQFGYIVLTTSAGIMDHEEARRKNVGGKVLGFFY

SEQ ID NO: 14283 - protein, 498 aa, Mycobacterium smegmatis str. MC2 155
MNVIGITLLPRGRIMSHGPVSDDTPSIFGDDDQAASSGRTAVRIAAVAALGGLLFGYDSAVINGAVDSIQEDFGIGNYALGLAVASALLGAAAGALSAGRIADRIGRIAVMKIAAVLFFISAFGTGFAPETVTLVVFRIVGGIGVGVASVIAPAYIAETSPPGIRGRLGSLQQLAIVLGIFTSFVVNWLLQWAAGGPNEVLAMGLDAWRWMFLAMAVPAVLYGALAFTIPESPRYLVATHKIPEARRVLSMLLGQKNLEITITRIRDTLEREDKPSWRDLKKPTGGIYGIVWVGLGLSIFQQFVGINVIFYYSNVLWQAVGFSADQSAIYTVITSVVNVLTTLIAIALIDKIGRKPLLLIGSSGMAVTLATMAVIFANATVKPDGTPDLPGASGLIALIAANLFVVAFGMSWGPVVWVLLGEMFPNRFRAAALGLAAAGQWAANWLITVSFPELRNHLGLAYGFYALCAVLSFLFVSKWVEETRGKNLEDMHAEALGH

SEQ ID NO: 14284 - protein, 630 aa, Hyphomonas neptunium ATCC 15444
MNKPTKPGDFDAPKVTTGALPASRKVYSRPARDPDLAVPHREIDLHPSANEPAVRVYDTSGPYSDPTAEIDVEKGLPRHRRDWLLARGGLEEYDGRDVKPEDNGGATGKYLAREFPVKHMPLRGLPGQMVTQYEFAKAGIITKEMVYVAERENLGRSQALENARAQIDQGNSFGADIPEFITPEFVRDEIARGRAIIPANINHAELEPQIIGRNFLVKINANIGNSAVASSIEEEVEKMVWATRWGADNVMDLSTGRNIHNTREWIIRNSPVPIGTVPIYQALEKVNGVAEDLTWEVYRDTLIEQCEQGVDYFTIHAGVRLAYIHLTAKRVCGIVSRGGSIMAKWMLAHHKESFLYDHFEDICDIMRAYDVSFSLGDGLRPGAIADANDAAQFAELETLGELTKIAWAKGCQVMIEGPGHVPMHKIKINMDKQLKACGEAPFYTLGPLVTDIAPGYDHITSGIGAAMIGWFGTSMLCYVTPKEHLGLPDRNDVKVGVITYRIAAHAADLAKGHPAAQLRDDALSRARFEFRWEDQFNLALDPETARDFHDQTLPKDAHKVAHFCSMCGPKFCSMKITAEVRDYAAGMSENERLDLEKQAAEARKGMEEKSREFLNKGGEIYIHAPKDRQT

SEQ ID NO: 14285 - protein, 971 aa, Saccharomyces cerevisiae
MEGSTGFDGDATTFFAPDAVFGDRVRRFQEFLDTFTSYRDSVRSIQVYNSNNAANYNDDQDDADERDLLGDDDGDDLEKEKKAASSTSLNILPHRIIISLDDLREFDRSFWSGILVEPAYFIPPAEKALTDLADSMDDVPHPNASAVSSRHPWKLSFKGSFGAHALSPRTLTAQHLNKLVSVEGIVTKTSLVRPKLIRSVHYAAKTGRFHYRDYTDATTTLTTRIPTPAIYPTEDTEGNKLTTEYGYSTFIDHQRITVQEMPEMAPAGQLPRSIDVILDDDLVDKTKPGDRVNVVGVFKSLGAGGMNQSNSNTLIGFKTLILGNTVYPLHARSTGVAARQMLTDFDIRNINKLSKKKDIFDILSQSLAPSIYGHDHIKKAILLMLMGGVEKNLENGSHLRGDINILMVGDPSTAKSQLLRFVLNTASLAIATTGRGSSGVGLTAAVTTDRETGERRLEAGAMVLADRGVVCIDEFDKMTDVDRVAIHEVMEQQTVTIAKAGIHTTLNARCSVIAAANPVFGQYDVNRDPHQNIALPDSLLSRFDLLFVVTDDINEIRDRSISEHVLRTHRYLPPGYLEGEPVRERLNLSLAVGEDADINPEEHSNSGAGVENEGEDDEDHVFEKFNPLLQAGAKLAKNKGNYNGTEIPKLVTIPFLRKYVQYAKERVIPQLTQEAINVIVKNYTDLRNDDNTKKSPITARTLETLIRLATAHAKVRLSKTVNKVDAKVAANLLRFALLGEDIGNDIDEEESEYEEALSKRSPQKSPKKRQRVRQPASNSGSPIKSTPRRSTASSVNATPSSARRILRFQDDEQNAGEDDNDIMSPLPADEEAELQRRLQLGLRVSPRRREHLHAPEEGSSGPLTEVGTPRLPNVSSAGQDDEQQQSVISFDNVEPGTISTGRLSLISGIIARLMQTEIFEEESYPVASLFERINEELPEEEKFSAQEYLAGLKIMSDRNNLMVADDKVWRV

SEQ ID NO: 14286 - protein, 191 aa, Triticum aestivum
  misc_feature (187)..(187): Xaa can be any naturally occurring amino acid
RLPLLHHLTRRLHPSVPHLLSRSNDDEPSSPSSQPQPLPSFRSQLPPASRAAQTLHHLLPFSLQHSGLPHRGFSSSAPAPDPPGEVDAAASVLVDAAVAVASSVPAPFPGEVAAAAADSFFPVAALQYLIDYVHTFTGLNWWACIALTTVLIRTATIPVLVSQLKSTQKLNAIKPEMEAVKDAMDSXDPKT

SEQ ID NO: 14287 - protein, 124 aa, Desulfovibrio desulfuricans G20
MFKAIATDKAPGAIGPYSQGTETQDLVFTSGQLPIDPATKVMPEDISEQTRQALENVKSVLEAAGCSLKQVFKTTVFLADMADFPKVNEVYATYFSEPFPARSCVQVAALPLGAGVEIEVVARR

SEQ ID NO: 14288 - protein, 84 aa, Zea mays
AEAAGARPSLAVSEVLDQRGVGELVKLATERGRKARPNLKVGICGEHGGEPSSVAFFAKAGLDYVSCSPFRVPIARLAAAQVLV

SEQ ID NO: 14289 - protein, 377 aa, Bordetella parapertussis 12822
MAKRDYYEVLGVAKNASDEDLKKAYRKLAMKYHPDRNPDSKEAEEKFKEAKEAYEVLGDEQKRAAYDRYGHAGVDPNAAGMGGGMGGGMGGGFADAFGDIFGEIFGAGRRGGGGPQVYRGADLKYALEITLEQAASGFDTEIRVPSWENCDTCHGSGAKAGTSPKTCRTCGGSGAVRMQQGFFSVQQTCPTCHGTGKEITDPCPSCDGVGRTRRNKTLQVKIPAGIDDGMRIRSSGNGEPGINGGPPGDLYVEIHIKQHKIFQRDGDDLHCELTIPFTTAALGGELQVPTLGGKAEISIPEGTQSGKTFRLRAKGIRGVRGSYPGDLYCHVVVETPVRLSDEQKAILRQFEASLNDGGDRHSPQSKSWTDRVKEFFS

SEQ ID NO: 14290 - protein, 466 aa, Burkholderia pseudomallei K96243
MSDTKTTTLLVIGGGPGGYVAAIRAGQLGVRTILVERDRLGGTCLNIGCIPSKALIHAAGEFDKVRGFAGDSPLGIRTQAPAIDIARTVAWKDGIVKKLTGGVGALLKKNGVEVVHGDARVVDGKTVDVDTGGGARVRIQCEHLLLAAGSEPVELPAMPFGGNVISSTGALSPGRLPKRLVVVGAGYIGLELGIAYRKLGVEVSVVEARERILPIYDAELTKPVAASLKRLGVRVLLGHKVLGLNARGDAVCVQDDAHAQTELAADQVLVTVGRRPRTQGWGLETLQLDRAGAALKIDDMCRTSMRNVWAIGDLTGEPMLAHRAMAQGEMVAEIVAGKKRHFMPAAIAAICFTDPEVVSVGLAPDEAERTFGACVSASFPFAANGRALTLESADGFVRVVARRDDHLIVGWQAVGAGVSELAAAFSQSLEMGARLEDVGGTIHAHPTLGEAVMEAALRALGHALHI

SEQ ID NO: 14291 - protein, 451 aa, Methylococcus capsulatus str. Bath
MGSAGRQWMERDLAVLWHPCSQMKDHESLPLIPIRRGEGVWLEDFDGRRYLDAISSWWVNLFGHCHPAINAALADQLGRLEHVIFAGFSHEPGIRLAERLVDITPPGLERCFYADNGSAAVEVALKMSFHYWRNRGRPGKTRFVTLENSYHGETLGALAVGDVPLYKETYRPLLMEAVAAPSPDAYGREPGETEAGYAERRFRDMLAILERGADEICAVIVEPLVQCAGGMRMYDPLYLRLLRAACDRLGIHLIADEIAVGFGRTGTLFACEQAGISPDFLCLSKGLTGGYLPLAAVLTRPEIYAAFYDDYGTLKAFLHSHSYTGNPLACRAALATLELFDATDVLGRNRELARCMADATERFQEHPHVAEVRQRGMILAIEMVKDKTTREPYPWQERRGLRVYRRALERGVLLRPLGNVIYFMPPYLITPEQIRLMAEVAWEGLLVAAED

SEQ ID NO: 14292 - protein, 221 aa, Cryptococcus neoformans var. grubii
MSHSSLEYPEMKKLFNRNLKWSENVREKNPSFFPHHFPGQRPEILWIGCSDARVPETTIMGCQPGDIFVHRNIANLYSPQDDSLNAVLMIALFNFNVKHIVVTGHTNCVGCLTALNVSRLPAAPPTTPLQRYVKPLATLARTLYTPDGPPTLDLLVEENVVQQVKNLVESDIIKDNWKRRGADGVVIHGWVYHLEDGIIRDLNVSMGPPGHVPGMQINNLF

SEQ ID NO: 14293 - protein, 239 aa, Cryptococcus neoformans var. grubii
MPFHAEPLKPSDEIDMDLGHSVAAQKFKEIREVLEGNRYWARKVTSEEPEFMAEQVKGQAPNFLWIGCADSRVPEVTIMARKPGDVFVQRNVANQFKPEDDSSQALLNYAIMNVGVTHVMVVGHTGCGGCIAAFDQPLPTEENPGGTPLVRYLEPIIRLKHSLPEGSDVNDLIKENVKMAVKNVVNSPTIQGAWEQARKGEFREVFVHGWLYDLSTGNIVDLNVTQGPHPFVDDRVPRA

SEQ ID NO: 14294 - protein, 503 aa, Neurospora crassa
MPSLSFLVRPSVVSSRLASGRVGSLSRHFSVTALNMAPISRETDFLVIGGGSGGIATARAAAGKYGIKSMVVEGKRLGGTCVNVGCVPKKVTFYAALVAETIHQAKDYGFSVEQTAPFDWPTFKQKRDAYVARLNGIYERNLANDKVEYVHGWAKLLSPNSVEVTLDDGTKSVVNAKKILIAVGGNPTIPPHIPGSEYGTNSDGFFDIDTLPKKVALVGAGYIAVEFAGMLNALGVETHLFIRHDTFLRSFDPMIQQVSVKEYERIGVKVHKKSQLTSVQKDAAGKLAINFKEGEGEQSISDVDHLIWAVGRTPAVEGLGLDKAGVKTNEKGYIEVDEYQNTSTENIYAVGDVCGQVELTPVAIAAGRKLAARLFGPEEFRTLKLNYDNVPSVVFAHPEIGSIGLTEPEAVAKYGAENLKIYKSSFTAMYYAMMKPEDKAPTAYKLICAGPEEKVVGLHIIGLGSGEILQGFGVAVNMGATKADFDNCVAIHPTSAEELVTLK

SEQ ID NO: 14295 - protein, 269 aa, Arabidopsis thaliana
MKMKKKGKVYPSPPPPPQSSSSSSSSNHLNEEDDDSLSVLKLLPATILVLVSVLSSEEREVLAYLITRGTIISDRGNSSSKNKTKKKSNKSSKNHKPPVFDCECFDCYTNYWFRWDSSPNRELIHEIIEAFENHHGEENSASRSKSKRGKKKEKPGRRVTDSDSKPALRVTDNGDKDSKPVVEPMNETTVSESSHVSSPVRLSEAEVAEGEPEDEIVVEEDGQEEESTVVVFPAAASNVTGHKGLARKVLPDVLGLFHSNFWRLWNPNA

SEQ ID NO: 14296 - protein, 463 aa, Bacillus anthracis str. Ames
MQHSNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQNRQKLSYKMPLYPLSSYFSLAFLVLVLGIMAYSEDTRIALIVGPIWLIGLAIVYYMKGFHKIDETPNSKIS

SEQ ID NO: 14297 - protein, 215 aa, Zea mays
MGSPGAGSSGGHECSFKFLLIGDSGVGKSSLLVSFVAASYLDGDIAPTIGVDFKIKFLTVGGKKLKLTIWDTAGQERFRTITSSYYRGAQGIILVYDVTKRESFSNLADVWTKEIEANSTNKDCIKMLVGNKVDKDDERMVTKEEGLAFAEEYGCLFLESSAKTRENVEKCFEELALKILEVPSLLEEGSSSVVKRNILKQKQESDAKNGSGCCQ

SEQ ID NO: 14298 - protein, 940 aa, Schizosaccharomyces pombe
IANMFSQRPIIAKHRASALYHPAADVISSLIVDLPFRFINISVFSIVLYFLTNLKRTAGGFWTYFLFLFIGATCMSAFFRSLAGIMPNVESASALGGIGVLAIAIYTGYAIPNIDVGWWFRWIAYLDPLQFGFESLMINEFKARQFECSQLIPYGSGYDNYPVANKICPVTSAEPGTDYVDGSTYLYISFNYKTRQLWRNLAIIIGYYAFLVFVNIVASETLNFNDLKGEYLVFRRGHAPDAVKAAVNEGGKPLDLETGQDTQGGDVVKESPDNEEELNKEYEGIEKGHDIFSWRNLNYDIQIKGEHRRLLNGVQGFVVPGKLTALMGESGAGKTTLLNVLAQRVDTGVVTGDMLVNGRGLDSTFQRRTGYVQQQDVHIGESTVREALRFSAALRQPASVPLSEKYEYVESVIKLLEMESYAEAIIGTPGSGLNVEQRKRATIGVELAAKPALLLFLDEPTSGLDSQSAWSIVCFLRKLADAGQAILCTIHQPSAVLFDQFDRLLLLQKGGKTVYFGDIGEHSKTLLNYFESHGAVHCPDDGNPAEYILDVIGAGATATTNRDWHEVWNNSEERKAISAELDKINASFSNSEDKKTLSKEDRSTYAMPLWFQVKMVMTRNFQSYWREPSILMSKLALDIFAGLFIGFTFYNQGLGVQNIQNKLFAVFMATVLAVPLINGLQPKFIELRNVFEVREKPSNIYSWVAFVFSAIIVEIPFNLVFGTLFFLCWFYPIKFYKHIHHPGDKTGYAWLLYMFFQMYFSTFGQAVASACPNAQTASVVNSLLFTFVITFNGVLQPNSNLVGFWHWMHSLTPFTYLIEGLLSDLVHGLPVECKSHEMLTINPPSGQTCGEYMSAFLTNNTAAGNLLNPNATTSCSYCPYQTADQFLERFSMRYTHRWRNLGIFVGYVFFNIFAVLLLFYVFRVMKLRSTWLGKKITGTG

SEQ ID NO: 14299 - protein, 1014 aa, Desulfovibrio desulfuricans G20
MHISRRSFIKATAASGIAAAFGGLGLSLVPSVSQAKLLPLRWAKQTTSVCCFCAVGCGLLVHTDKTSHRAVNVEGNPDHPVNEGSLCSKGASIYQVAENAERPATPMYRAPYSDAWQPVSWDWALTEIARRIKKDRDASFRFQNDMGLTVNRCDGIASVGSAALDNEECWVFQSILRALGLVWIEHQARICHSSTVPALAESFGRGAMTNHWNDIQHSDCVLVMGSNAAENHPISFKWVLRAMEKGAKLISIDPRFTRTSAKADLYVQIRAGTDIAVLGGLINYIIENDLIQRDYVVSHTNAPFLVSDSFSFKDGLFSGYKAGSKDSHYQGRYNKSLWDFAKDENGLPLKDETLAHPRCVYQLLKKHYSRYDIDTVVSVSGADKQGLLEFYRQYAATGKPDKAGTIMYAMGWTQHTVGTQYIRTMAMVQLLLGNIGVAGGGVNALRGESNVQGSTDHALLWQSLPGYLAVPDATHTSYKKHLEIKTAPHLAAAKDPKSAAWWQYYPKYMASFLKSMYPQAELADAYNWLPKADQGKTYTWLELFDAMHDGEFKGFFAWGQNPACSGAHAGKNREAMAKLDWMVNVNIFDNETGSFWRGPGMQPEKIKTEVFFLPCCVSIEKEGSITNSGRWMQWRYAGPDPRGAARSDGHIMVELMEKVRALYAEEGGTFTAPIEALSLDMWRDQKGYNPHNVARLINGTFLRDVTIKGTTYKKGQQVPSFALLQDDGSTCSGNWLYCASYTDEGNMGERQSRQQSPEQEKLGLFPNWTWCWPLNRRILYNRASCDLTGKPYNPQMPVISWTGEKWTGDVPDGGWKPGEKYSFIMKPHGHGRIYGPGLEDGPFPEHYEPMETPLKSHPLSRQRSNPACLSFNDEYKAVADPKFPYVATTFRVTEHWQTGLMTRHMPWLLEAQPQMFVELSEELARKLGVGNGDKVVVESARGSIWAVGMVTERVKPLRILGKTVHQISMPWCFGWFMPHDGSGGDSSNLLTAAVGDANTGIPETKVFMANVRKA

SEQ ID NO: 14300 - protein, 255 aa, Rhizobium leguminosarum bv. viciae 3841
MSGFNILERFSLSGRRALVTGAGRGLGRSIAEGLASAGAEVTLCARTESEVEEGARCIRDHGFKAEALVADVSDIAGFRATVDAMHAHDIFVNNAGTNRPKPLSDVTIEDFDAVIGLNLRAAVFAAQAVTARMANLGIQGSVINMSSQMGHVGAANRTIYCASKWALEGFTKALAVELGPVGIRVNTVAPTFIETPMTTPFLEDPAARNAIVSKIKLGRLGTPEDVVGAVLFLASDASALVTGSALLVDGGWTAD

SEQ ID NO: 14301 - protein, 255 aa, Candida albicans SC5314
MPDGTPRFTCKGKEILHFMGCSTFSQYTVVADISVVAINEKAEFEKACLLGCGITTGYGAATITANVQEGDNVAVFGGGCVGLSVIQGCKERKVNKIILVDINDKKEEWGKQFGATDFVNSTKLPEGTTIVDKLIEMTDGGCDYTFDCTGNVNVMRNALEACHKGWGTSIIIGVAAAGKEISTRPFQLVTGRVWKGAAFGGVKGRSQLPGIVEDYLDGKLKVEEFITHREPLDKINTAFDEMHGGDCIRAVVSLW

SEQ ID NO: 14302 - protein, 346 aa, Candida albicans SC5314
MVVNNPNNWHWVDKNCLPWSVDYFKDKLINLKVTDGTNNVHISEVSSVEGDVDVSQRKGKVISLFDIKIVLTFKGNTAKDDNVSGSITIPELTYDSEVDGLQFDISIYNETAENSGITDLIKKQLIPQLRTALMKFGPDLIEINSKDIQLSQDKVTSTYTKANQSSTIAATADHPKSESKPVEKKTETHSTSNIARKVVSEKDSSTVPKYNTTTLHLEPSFNTSAEQIYLTLLDEARIGAWTRSAPVIEKFPPKEGSEFKFFGGSVSGKFLKLVPNEQIVELWRLDDWKAGHFAQLDMKLVQSSGETKLVVKFSGIPIGEEERVKNNFEERYIRSIKITFGFGAVL

SEQ ID NO: 14303 - protein, 477 aa, Azoarcus sp. BH72
MALIRNQLFIGGRWVAPVRTGFIDVMDPSTDTVFARIPEGAAADAEAAVAAAHAAFDAWSRTPLAERAGCIERIAAGLKARSDELAHVIACEVGMPKKLAARVQVGGPLWHWNNYEALARSFEWERRVGNSLVVREPIGVVGAITPWNFPLNQITLKVAPALLAGCTVVLKPSEVAPINAFILAEIIEAAGVPAGVFNLVTGYGPVVGEVLASDPRVDMVSFTGSTRAGRRVAELAAATVKKVALELGGKSASVVLDDADLAAAVKGTVSSCLLNSGQTCSAHTRLLVPRARLDEAAQLAATAASAMKPGPALAEDSRLGPLVSAAQRERVRDYIRRGVAEGARLACGGAEPPAELEQGYFVQPTVLVCEDSRATVAQEEIFGPVLVVLPHDGDEDAIRIANDSPYGLAGAVWAGNEERALAVARRLRTGQVDINGAAWNPRAPFGGYKQSGLGRENGEYGLDEFLQYKAIQLRQPG

SEQ ID NO: 14304 - protein, 757 aa, Burkholderia pseudomallei K96243
MREFDYLLVGGGIASVTAARTLRGEDASASIAILCGEPVLPYQRPPLSQEWLMGAVQPASITLHDAAFYVAQRIDIALGVRAEQLDRAKRIVRTSSGATFRYGKLLIATGASAKAPALPGFGLDGVHVLHTFAQAQALKDAAAHARRATVLGGGFLGVEIAATLQALGLQVTLVERAPGVMPSLRAPALGGHFEALCRARGIDVLTRCEVRRVLGAQCVEAVETSDGGTRPCDLFVAAVGVTPNCGWLDGSGLALGDGVEVDAFLQTADPDVFAAGDVAHFDDPIFGVRRRIEHWDNAVRQGRIAARNMLGHRLPYRDVSIFYGSVFGLSYNLLGYPVGATETIERGAFDEASYMQLYLADDVLRAAFTIDRPAVEIAALNDAIRLHVNVAAHKTKLSDPNYPLDKLPVQTILILQGGGALGAFECGAVKALEQHGVRPDVISAVSIGAFNGAIVASHPKGATKALEAFWRELSIALPLPYESQWREAWLSSYVLSFGVPNFLKPQWSQLGFDADRLRAKWTSFFDATAIEQLIARYVDFDSLGMSPTRLLIGAVDVETGEPRIFDSYVDRLSPAHVLASGSLPPGMPWTVVDGRPYWDGGVVSNSPLDLVIARCGQIGGRVFIVDLFSGSKALPTNLVEVMLRREEIAYMDRVRNDLRFEEYASDFRDLVDGILAHVDAPSANEIRQQPLYIRLMGNRAAIDIARITLNREGRLSFIEDYDFSSDAIAQLQQQGYDAALVALANGRSRRRRGRRRA

SEQ ID NO: 14305 - protein, 443 aa, Glycine max
MKLEESVSNSNITAPLLPPEDPSPSPQNGSISGAVFNITTTMIGAGIMSIPATMKVLGIVPGLVVIVLVALITDVTVEFMLRYTSSGKSSTYAGMMAESFGSIGSLAVKICVIITNLGVLIIYFIILGDVLCGNESNGITHLGILQEWFGINWLTSRAFALLFVALFIMLPLVMLRRVDSLRYSSAISILLALVFVVICSSMAVSALLSGKSQTPRIVPDFSQVTVLDLFTTIPVFVTGFGFHVNVHPIRAELIKVEHMGLAARISLIICVAIYFAIGFFGYLLFGDSIMPDVLVNFDQNSHTSTGRLLNAIVRLSYALHLALVFPIMNYSLRANIDELIFSNKNKPPLASDTPRFVSLTLTLLALTYLVAVAIPNIWYFFQFLGSTTIVSTSFIFPAAIVLRDMHGISKTKDQVMAIVVIVLAVGTSGIAIWTNLNGSGDDQ

SEQ ID NO: 14306 - protein, 421 aa, Mesorhizobium loti MAFF303099
MADLKRTQPLARDAMAYVLAGGRGSRLKELTDRRAKPAVYFGGKTRIIDFALSNALNSGIRRLGVATQYKAHSLIRHLQRGWNFLRPERNESFDILPASQRVSETQWYEGTADAVYQNIDIIEAYGPEYMVILAGDHIYKMDYEMMLRQHVDANADVTVGCLEVPRMEATGFGVMHVDAKDNIIAFVEKPADPPGIPGNPDFALASMGIYVFKTKFLMEQLRRDAAEPGSSRDFGKDIIPYIVQHGKAIAHRFTKSCVRSTAENEAYWRDVGTVDAYWEANIDLTDITPELDLYDRDWPIWTYAELKPPAKFVHDEDGRRGSAVSSLVSGDCIVSGATLKKSLIFTGARINSYSTLEEVVMLPDVHVGRNAKLKRVVIDHGVRIPEGLVVGEDPALDAKRFRVSEKGICLITQDMINKLGL

SEQ ID NO: 14307 - protein, 881 aa, Streptococcus agalactiae NEM316
METKFVYHFDEGCKEMKELLGGKGANLAEMTSIGLPVPQGFTITTQACNDYYDNACHIRESILSQIDQAMAQLEVEQNKQLGSVDDPLLVSVRSGAVFSMPGMMDTVLNLGLNDRSVQGLVKKTEDERFAYDSYRRFIQMFADVVTGIPKYKFDTILDRLKTDKCYQDDTELTGSDLQRLVEFYKELYQKEAGEKFPQDPKRQLLLAIEAVFKSWNNPRAKIYRKLNDISETLGTAVNIQAMVFGNMGNNSGTGVAFTRNPSTGAANLFGEYLINAQGEDVVAGIRTPQSISKLAEQMPIIYQEFVSVTQKLEAHYRDMQDMEFTIENGNLYMLQTRSGKRTAKAAIKIAVDQVNEGLISKEEAILRIEPKQLDQLLHPSFDLESLKKAILLTTGLPASPGAAYGKVYFHAEDVVQEMKKGNPVLLVRQETSPEDIEGMVSANGIITARGGMTSHAAVVARGMGKPCVAGCSQLLVDEVRREISIGHQTIKEGEMLSIDGATGNVYIGQVPMAETSVDCDFEIFMKWVDENRDMMVCSNADNPRDAQKALDFGAEGIGLCRTEHMFFDDERIPVVREMILADDVLSRRKALERLLSFQRDDFYQIFKVLKGKTCTIRLLDPPLHEFLPHDKESIESMARQMGISTLAIEKRIQTLEEFNPMLGHRGCRLAITYPEIYQMQMRALVQGAILAMKEGYEAKPEIMIPLVSAHEEISIIRDLIEETIIEESKSKKINLSFPIGTMIETPRACMIADDIAKFADFFSFGTNDLTQMSFGFSRDDAGKFLGEYVDKGLLKKDPFQALDQKGIGRFIEQAVRLGKEVKPNLKIGICGEHGGEPSSIEFCYQQGLHYVSCSPFRIPIAKLAAAQAKIKQSRNDITIDK

SEQ ID NO: 14308 - protein, 404 aa, Prosthecochloris aestuarii DSM 271
MFDEIEFEKIKRLPKYVFAAVNELKMAERRKGEDVIDFSMGNPDGPTPQHIIDKLVESVQKPRTHGYSVSKGIYKLRLAICGWYRDKYGVELDADTEVVASMGSKEGYVNLVQAITNPGDIAMVPDPCYPIHSQAFILAGGNVHRFKLEMDEEYRLDEEAFFRNIETAMRESSPKPKYLVVNFPNNPTTATVERSFYERLVETARRERFYIISDIAYAEITYDGYQSPSILQVPGAKDVAVESYTLSKTYNMAGWRVGFLVGNPKLVGALMRIKSWLDYGMFTPIQVASTIALNSDQSCVAEIRDTYRKRRDVMLKSFANAGWEIRAPRASMFLWARIPEPLRQVGSLEFSKMLLREAKVAVSPGIGFGPNGDEYVRIALIENEERIRQAARNIRKFLKAHGQG

SEQ ID NO: 14309 - protein, 542 aa, Mesorhizobium loti MAFF303099
MIRTVPTKPYSDQKPGTSGLRKKVPVFQQEHYAENFIQSIFDALDGFQGKTLVIGGDGRFYNREVIQKAIAMAAANGFGKVMVGQGGILSTPAASHVIRKYKTFGGIILSASHNPGGPHEDFGIKYNAGNGGPAPEKLTDAIFAKTKAISSFKTSDIDTIDIDTIGTVKAAGMTVEIIDPVADYAELMESLFDFDALRRLFKSGFRMRFDAMHAVTGPYAKEILENRLGAPSGTCRNFKPLPDFGGHHPDPNLVHAKHLYDEMMGPDAPDFGAASDGDGDRNLIIGKGIFVTPSDSVAMLAANARLAPGYKDGLKGIARSMPTSGAADRVAEKLGIGIYETPTGWKFFGNLLDAGMATICGEESAGTGSNHVREKDGLWAVLLWLNILAARGESCKQVVTEHWAAYGRNYYSRHDYEEVESDRANALVDELRAKLGSLPGTSVRGLKIAKADDFAYHDPVDGSTSEHQGIRILFEGGSRVVFRLSGTGTSGATLRVYIERYEPDKARHDLDTQAALADLIAAADDIAGIKSHTGRNKPSVIT

SEQ ID NO: 14310 - protein, 672 aa, Mesorhizobium loti MAFF303099
MTPLGATVTPEGIRFAVWSSSARRLWVSLFDGQGNRELDRLELQSEGEGMHALFVPRLAAGTRYGFRADGDYAPDRGLWFDPDKLLTDPYAVEIDRPYAYHWRLAARRNEGADTAPLMPKTVAKTLPKTVPALPPLFRPGGLIYEVPVRAFTKLHPDIPEAQRGTIAALAHPVIIEHLQRLGVSAVELMPVTASIDERHLPPLGLSNAWCYNPVTFMALDPRLAPGGLEELRDTVAALRKASIGTILDLVFNHTGESDRLGPTLSLRGLDNQAYYRHQPDGRLVNDTGTGNTVACDHPVVRDMVLDTLRHFVRHTGVDGFRFDLAPVLGRVDGAFDPTAPLLEAITGDPVLADRVLIAEPWDIGPDGYQLGNFPPRFLEWNDRYRDDARRFWRGDAGAVGALATRLAGSSDIFGKAGQAASRTVNFIAAHDGMTLADIVAYERKHNEANGEQNRDGHNDNLSWNNGAEGETDSAAIANARFDDQCALLATLFASRGTIMLTAGDEFGRSQKGNNNAYAQDNAITWLDWAGRDHALERYASVLGMLRRAVPALSATDFLTGQSADATGTPDVAWLTETGMPLAETDWNDPARHRLVMLLGDAGGDRLAVMINGDRRQCVFTLPEREGFRWQPAIETQAIELARPLPGRSVHFMAEHRTEKWQSVFGQSDASKK

SEQ ID NO: 14311 - protein, 420 aa, Pseudomonas syringae pv. tabaci
MPISESFARRLFPLLDELTNTYPTPFHIYDERAIVQTHRNVAQAFADSAFRQYFAVKALPTPAILSLLLKEGSGLDCSSPVELMLAERLGARGDDIVFTSNNTSLSEYQMALQAGALVTFDDRSMLEQVIALPDIVAFRVSPHGVIARSSQMGNAQQSKFGIPEAELVQSYREAWDRGARRFGIHGMMCANELSLEAAVQAGVQVIEVGARVAREAGIELEYINIGGGLGIPYRIDDQALDLTAYADALKRALKQAFPHNTPKLLMELGRYISGPHGVLVSRVINRCSKGREIVGLDASMSALMRPGLYGAYHHLTLPFADQRPEGVFDVVGALCENFDKFAVDRLLPSPLIGDLALIHDTGAHGHAMGFTYNGRLRPAELMLTDDGDVVEIRRAETFDDHTGPIQWQPVDVFNPTRCVK

SEQ ID NO: 14312 - protein, 333 aa, Oceanospirillum sp. MED92
MLLLSQFLKQQDTEDTLVDLIGTLMLACKEVAIQLREGELAGVLGSTDNTNVQGETQKKMDVIANDLLKKFLLDNPLVAGLASEEEDHPVGGNPEGKYLVIFDPLDGSSNIDINVSVGTIFSILELPEGMDPSQDEAYLQCGRKQVAAGYVLYGQSSVLALTTGHGVNFFTLAHTGDFILTREQVQIPADTKEFAINMSNHRFWEEEMRNYVGDLLQGSEGPRGKNYNMRWIASMVAEVHRVLTRGGIFTYPWDGRDPSKPGKLRLMYEGNPMSMLIEQAGGISSTCYKNIMDLEPQRIHQRSAVALGSKNEVEALLTYHAESGDGQAAKLNI

SEQ ID NO: 14313 - protein, 288 aa, Thermococcus kodakarensis KOD1
MGYNEQERAFIEWYPRGYGVGFKVKRRLFETQTEYQRLEIYETEGFGKLLVLDGTVQLVEVGEESYHEVLVHPVMLAHPNPRKVLVIGGGDGGTLREVLRHDTVEKAIMVEIDEGVVEASYLYLDVAKDLLDRLIKKEEPRAELIIGDGVKYLRETDERFDVIIVDSTDPVGPAKLLFSEEFYRDAYEKLNEKGLYVTQAGSVYLFTNELLDAYKAMKKVFDRVYYFSFPVIGYASPWSFLVGVKGDVDFTRIDLERAKKLDLYYYDPERHETLFQMPRYVRKLLEGQ

SEQ ID NO: 14314 - protein, 162 aa, Bradyrhizobium sp. BTAi1
MNISATARSLLLSEFVSAFFLAMRYFFQPKPTLNYPFEKGPISPRFRGEHALRRYPNGEERCIACKLCEAVCPAQAITIEAGPRRNDGTRRTVRYDIDMVKCIYCGLCQEACPVDAIVEGPNFEFATETREELYYDKAKLLANGDRWEREISKAIALDAPYR

SEQ ID NO: 14315 - protein, 189 aa, Triticum aestivum
MAGGSPCASCKLLRRRCTKDCIFAPFFPADDPHKFAIVHKVFGASNVSKMLLELPVQQRGDAVSSLVYEANARVRDPVYGCVGAISFLQNQVSQLQMQLAVAQAEILCILMQQRDGCRSQDDAGRSDGHSLAAMQQMVVDDTAAAEAFLMQNGGGGFPPQLMSSYGGAPASNVHHYGQQDHLKRESLWT

SEQ ID NO: 14316 - protein, 215 aa, Brassica napus
ELNTNDFVHLLLDLFGAGTDTNSSTVEWAMSELLRSPKTMAKAQAEINRVLGQKGFVEESDISELPYLQAVVKEVFRLHPAAPLLVPRKAESDVEVLGFMVPKDTQVLVNVWAIGRDPSVWENPTRFEPERFLGKETDVRGRDYELTPFGAGRRICPGLPLAVKIVPLMLASLLYSFDWKLPNGVTSEDLDMHETFGLTLHKTNPLHAVPVRKHH

SEQ ID NO: 14317 - protein, 353 aa, Arabidopsis thaliana
MPKERKERSVSLDKYKRSPLCCEASLALKPSEKQVKEWEEARCPVCMEHPHNGILLICSSYENGCRPYMCDTSHRHSNCFDQFRKASKEKPSLSLLREEEESNEPTEMEDVDSDSTAVNLLGEAASEITVVDLSDGERGEEEVEEDQKKNKPPKLTCPLCRGHIKEWVVVKAARCFMNSKHRSCSCETCDFSGSYSDLRKHARLLHPGVRPSEADPERQRSWRRLERQSDLGDLLSTLQSSFGGDEISNDDGFLFADTRLLTVYFLIRVFRPESSGSRSSSWSGTSRARTHTSGRRRSSRPASLWGESYEGNTGTSPRDEENNQSSDVQVSGTRRRRSRRRTVIDDDDEEEEP

SEQ ID NO: 14318 - protein, 371 aa, Saccharomyces servazzii
MGVANTSLRYSAFNFSLGRRFKSTSETLNDLPETISEVQTQLPSIDQMTNATADIVEQASHSVGELSTHIGYLNSIGLAQTWHWPADIIQHALEYVHVYTGLPWWGTICTVTILVRLLMFPIYVKSSDTIAKNSRIKPQMDKVTKELMATTDLAEGQKIAVRRRKLLSENGIKNRWLAAPMLQLPIAIGFFNALRSMANFPVDGFANQGILWFHDLTLSDPYLGLQFITAAVLMSFSRLGGETGAQQFSGPMKRFFIILPLVSIPATMNLSTSVVLYFAINGTFSVLQTLVLRNKWFRKKLNIAEVVQHPPDPTKENSGIFAAIKENMNTARERSEKRKLMKEEEERVHELIKKKRTNERIRIIRRPELKK

SEQ ID NO: 14319 - protein, 101 aa, Glycine max
  misc_feature (15)..(15): Xaa can be any naturally occurring amino acid
  misc_feature (55)..(55): Xaa can be any naturally occurring amino acid
  misc_feature (66)..(66): Xaa can be any naturally occurring amino acid
  misc_feature (75)..(75): Xaa can be any naturally occurring amino acid
  misc_feature (90)..(90): Xaa can be any naturally occurring amino acid
MRTKRKEMASSMISXPADTSGNRASSGLDARFAVLKSMAGFPTSETNKDITLIAXNCGRVLCMQVXSPIVMMKFXTLCYLPDLDDAQLAXEVRYLLKNGWI

SEQ ID NO: 14320 - protein, 292 aa, Streptococcus agalactiae NEM316
MNSLNGETLLTGLIANPARHSLSPLMWNTSFQEKNMNYAYLTFEVEEGKLTEAVRGVRALGIRGVNVSMPFKQSVIPLLDDLSPQAKLVGAVNTIVNQGGTGRLVGHMTDGIGCFKALAAQGFSAKNKIVTIAGIGGSGKAVAVQAAMEGVAEIRLFNRNSSNYDKVIDLSDKIKKQFQIKVVVDYLENKTAFKDAIRTSHFYIDATSLGMRPLDNYSLINDPEILTPNLVVVDLVYKPKETALLRFVRQNGVKHAYNGLGMLIYQGAEAFQLITNQEMPISSVERVLQTEN

SEQ ID NO: 14321 - protein, 279 aa, Thermoproteus tenax
MGDGGALAHVAESLNISGAVMVVNGDVFTDADYRAVLDAHKRAGGVATMMLVEVSPESVSKYGIAVLDDSMRLIEFVEKPKEPPAGSRLANAGIYVFEPEVFKLIPRRRGEVKIAKDIIPELLRRGDIYAFIHRGIWHDIGTPADYLKANYAALDKWGSKEVDKPGIDITPPVYIGEGSIVEEGASLGPYVVLGQGAKVGRYARLKNSVLMRAATVEPGAYISGSIIGEETYIGRWARVLESVVADGVYIKDEVYVGRGSAIGPNREVVEDVPDGSMLP

SEQ ID NO: 14322 - protein, 121 aa, Brassica napus
  misc_feature (14)..(14): Xaa can be any naturally occurring amino acid
KPKWYERALVITVXGVFFNAYFLGYLISPKFAHCMVGYLEEEAIHSYIEFLKELDKGNIENVPAPAIAIDYWRLLADATLRDVVMVVRADEAHHCDVNHFAFDIHYQGRELKEAPALIGYH

SEQ ID NO: 14323 - protein, 396 aa, Zea mays
  misc_feature (42)..(42): Xaa can be any naturally occurring amino acid
  misc_feature (57)..(57): Xaa can be any naturally occurring amino acid
MAASVSRAICVQKPGSKCTRDREATSFARRSVAAPRPPHAKXRRRHPLRLRRGTGPXHCSPLRAVVDAAPIQTTKKRVFHFGKGKSEGNKTMKELLGGKGANLAEMASIGLSVPPGFTVSTEACQQYQEAGRALPPGLWAEVLDGLRWVEEYMGAALGDPRRPLLLSVRSGAAVSMPGMMDTVLNLGLNDQVAAGLAAKSGDRFAYDSFRRFLDMFGNVVMDIPHALFEEKLEAMKKAKGLKNDTDLTATDLKELVSQYKNVYVEAKGEPFPSDPKRQLELAVLAVFDSWESPRAKKYRSINQITGLRGTAVNVQCMVFGNMGNTSGTGVLFTRNPNTGEKKLYGEFLVNAQGEDVVAGIRTPEDLDAMKDVMPQAYKELVENCRILESHYKEMQA

SEQ ID NO: 14324 - protein, 398 aa, Bradyrhizobium sp. BTAi1
MNEQSPALRNFTINFGPQHPAAHGVLRLVLELDGEVVERVDPHIGLLHRGTEKLIETKTYLQAMPYFDRLDYVAPMNQEHAFCLAAERLLGIEVPRRGQLIRVLYSEIGRLLSHLLNVTTQAMDVGALTPPLWGFEEREKLMVFYERASGSRMHANYFRIGGVHQDLPPKLIDDIDAFCDPFLKVVDDLDQLLTGNRIFKQRNVDIGVVTLKQAWEWGFSGVMVRGSGAAWDLRKSQPYDVYAEMEFDVPIGKNGDCYDRYLIRMEEMRQSVRIMKQCIQKLRAPDGQGPVVVTDNKIAPPRRGEMKRSMEALIHHFKLYTEGVHVPAGEIYAAVEAPKGEFGVYLVSDGSNKPYKCKIRAPGFAHLQAMDFLCRGHLLADVSAILGSLDIVFGEVDR

SEQ ID NO: 14325 - protein, 573 aa, Xanthomonas campestris pv. vesicatoria str. 85-10
MPNPVMSHSVEDIKSESRRLRGSLQQSLADAVTGALREDDQTLIKYHGSYQQDDRDIRDERRRQKLEPAYQFMIRTRTPGGVITPTQWLALDGIATRYANHSLRVTTRQAFQFHGVIKRELKATMQAINATLIDTLAACGDVNRNVQVAANPLLSQAHATLYADAARVSEHLLPNTRAYYEIWLDEERVSGSGSEEEPIYGERYLPRKFKIGFAAPPLNDVDVFANDLGFIAILRDGQLLGYNVSIGGGMGASHGDAETWPRVANVIGFVTRDQLLDIATAVVTTQRDFGNRAVRKRARFKYTIDDHGLDTIVAEIARRAGFALQPAQPFAFDHNGDRYGWVEGEDGRWHLTLSLPAGRIADTDTAAHLSGLRAIAQLNVGEFRMTPNQNLVIAGVPASERARVDALVAQYALDAGNRAATALARGAMACVALPTCGLAMAEAERYLPDFSAALQPLLQQHGLADTPIVLRVSGCPNGCSRPYLAEMALVGKAPGRYNLMLGGDRRGQRLNTLYRENITEPEILAALQPLLARYASEGDHANDEGFGDFLHRAGVIALPPYPTHRRLDLELLA

SEQ ID NO: 14326 - protein, 214 aa, Brassica napus
MTSFSTFSEMLGSEYESPVTLGGEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKEIQKAAAEAALAFQAEINNTTTDHGLDMEETIVEAIFTEENNDVFYMDEESMLEMPALLASMAEGMLLPPPSVHFGHNYDFDGDADVSLWSY

SEQ ID NO: 14327 - protein, 151 aa, Oryza sativa (indica cultivar-group)
MVMAMMRRVVMVVAVLCAVATMAMAQEASNVRATYHYYRPAENNWDLGAPAVSAYCATWDADKPLEWRQKYGWTAFCGPVGPTGQDACGKCLSVTNTATGDQITARIVDQCANGGLDLDWDTVFSKIDSDGQGYQNGHLIVDYQFVDCGNN

SEQ ID NO: 14328 - protein, 309 aa, Triticum aestivum
  misc_feature (61)..(61): Xaa can be any naturally occurring amino acid
MESSEPLQDIMCEFRAGKMSLEGTRVVPDTRKGLVRIGKGEEGLIHFQWLDRGQNIVEDVXLDQIVFPDEAVFEKVTESSGRVYILKFRHDSRKFFLWMQETNADGDSQICRQVNAYINRPLDGDAISIEAEMSHEDTADDDISSRAGNLVDQSMTADMAGEVTSAAGPVRLADLQRILSSIQPSDATADPDAGLRLGDILKPDLILPLIETLPIEQLASHLPEGSWTAGDILELLQSPPLRQQLDAFTHVLQTGQIDLAQFGVDPSKYKFTVASFLEALEDSVAKASTDGGNDSKAKKDGGNDPMDES

SEQ ID NO: 14329 - protein, 496 aa, Pseudomonas syringae pv. phaseolicola 1448A
MVAELLARLGVANSAHTQGDYPVYTPIDGSRIASVTLEGKEQVVARIDSAHNAFLKWRTVPAPRRGELVRIFGEVLREHKADLGELVSVEAGKITQEGLGEVQEMIDICDFAVGLSRQLYGLTIASERPGHHMREAWHPLGVVGVISAFNFPVAVWAWNTTLALVCGNPVIWKPSEKTPLTALACQALFDKALKIFGDAPAALAQLVIGDRDAGEALVDDPRVPLISATGSTRMGREVGPRVAARFGRSILELGGNNAMILAPSADLDLAVRGILFSAVGTAGQRCTTLRRLIVHRSIKDEVVSRVKAAYAKVRVGDPREGNLIGPLIDQQAFSAMQSALTKARDEGGQVFGGERQLQDQYPNGYYVTPAIAEMPEQSEVVRHETFAPILYVLAYDDFEEALRLNNEVPQGLSSCIFTTDLREAEAFQSAAGSDCGIANVNIGTSGAEIGGAFGGEKETGGGRESGSDSWRAYMRRQTNTVNYSRELPLAQGIVFD

SEQ ID NO: 14330 - protein, 487 aa, Mesorhizobium loti MAFF303099
MRAQPTASHYVNGRYIDDEQGAPLPVIYPATGETIAMLRSATPNVLELAIEAARAAQPAWARLKPVERGRILRRAADILRARNADLARIETLDTGKAIQETLVADAPSAADCLEYFGGAVAAYNGEAVDLGGPFAYTRREALGVCVGIGAWNYPIQIAGWKSAPALAMGNAMVFKPSENTPLSALALAEIYSEAGLPDGLFNVVQGYGDVGAGLVGHDVVAKVSVTGSVPTGRKVLSLAGSKMKHATMELGGKSPLIVFDDADIENAIGGAMLGNFYSTGQICSNGTRVFVQSGIHDRFVERLVERTKKIRIGNPLDPETQMGPLVSKAQHEKVVGYIGIGKQDGAVLACGGNVPSLQGFDGGFFVEPTVFTGVTDTMRIAREEIFGPVMSVLKFDGEDEVIDRANDTEFGLAAGVFTRDLPRAHRVIAELQAGTCWINAYNLTPVEIPFGGFKQSGIGRENSLAALALYSQLKSIYVETGDVASPY

SEQ ID NO: 14331 - protein, 138 aa, Zea mays
  misc_feature (72)..(72): Xaa can be any naturally occurring amino acid
  misc_feature (106)..(106): Xaa can be any naturally occurring amino acid
AGLPSPPNTTAHLCANFGEGHKRGIAEERADGTNVHNWHWAERDCLEWFRARFYYVLVGLTILDGRGSASVXSTPSPLDKFDGEAYMNIRKVKAISEDELSVTLYXEAEAAYVSEAANVTETDADHYLAYENANEDPD

SEQ ID NO: 14332 - protein, 281 aa, Oryza sativa
HEAHLTSPPDKARGDYLLPLLLLSPPTTPPSYISAVLIAWSRGEERRPTLRGEESGGGEGSEPYLTRSAEAYGLGVGHADRAGMEEVDMDEEVRPEFACPYCYEDHDVVSLCAHLEEEHPFEPHAAPCPICSDKIAKDMLNHITVQHGYLFKNRRRLRRFVIPGSQALSLLSRDLREAHLQVLLGGGGHRSNNSSNTTNISADPLLSSFGLSFPTSDTEETSKPPISIPDDASVIKETPAQPWDSSIDSSLTREEREQKRKQASVRATFVQDLLLTTLFGD

SEQ ID NO: 14333 - protein, 574 aa, Legionella pneumophila subsp. pneumophila str. Philadelphia 1
MLDFSLNRDPQTGELYIETSLCGKPLLTTPQLNKGTAFTQEERKDFGLLGKLPHRVETLDEQVKRAYLQYSSYTTRLQQHIYLNNLHDKNQIVFYKLLSRHLGEMLPIIYTPIVGAAAKRFSHEYRQPRGLYIAHSDKNQLEEIINNRSNPDIDLVVVTDGEGVLGIGDQGIGGMDIPVAKLMVYSLCGGIDPTRTLPIFLDVGTNNQELLNDPMYLGCRHPRIKSSEYDDFIKTFVNEIHKQFPNAFLHWEDFGRGNARRILDQFQDELCTFNDDIQGTGAVTLAAILAACDVTGLPLHEHRIVVFGAGSAGTGISDQIVDAMVKSGLSLTDAYDRFWLIDKQGLLLATDQELTDAQKPYARNPIDIQSWEINNKQHPSFTDTIRHVKPTILIGCSAQTGAFSQDIVETMSTSCERPIIFPLSNPDEKCEAQPSDILAWSKGRALIATGTAFAPIEYQNRMVQIAQCNNALVFPGIGLGVLAVSASRLTKDMILAAAQTLSKFAPSKKDSFLPLLPSLDNAQIVAKEIAIAVAQCAIDSGYAQKNQDKELPRLIDELFWEPRYLPFRKKGWSE

SEQ ID NO: 14334 - protein, 334 aa, Xanthomonas campestris pv. vesicatoria str. 85-10
MSIEQLAETAQAMVAPGKGIIAIDESTSTIAKRFASVGIENIEENRRAYRELLLTTPKLSDYISGAILFDETIRQKTKDGVPFAEYMTAHGIIPGIKVDKGAQPLAGMPGELVTEGLDGLRTRLEEYYTLGARFAKWRAVINIGEDIPSGTCIEANSHALARYAALCQEQGLVPMVEPEVIMDGSHDIETCYEVTEATLRSLFGALYEQNVVLEGTILKASMVISGKSCEEQASIEEVAESTVMCLKSTVPAILPGIVFLSGGQTDEQSTAHLNEMHQLGNLPWPLSFSYGRAMQQAALKLWAKDMTGNFAKAQQVIYERAKENGLAALGKWKG

SEQ ID NO: 14335 - protein, 339 aa, Corynebacterium efficiens YS-314
MMDEMTGDGMRSEHEAIIIGGGQSGLATAYYLLRAGVDTLVLDDQPAPGGAWLHVWPSMTLFSTAEFSNLPGWPMPLYDGFPPAQHVVDYLTAYEQRYKIPVERPVRVDRIEHEEGIFRVRAGNKVWSAQNVVAATGTWSAPFVPNYPGTFRGTHWHSANYPGIEPFRGTRVAVVGGANSGAQIAAELTRVAEVTWYTRRPPRWMPDEVDGRVLFRRNRLRALAIQRGEPDPGADSDLGDIVALPEVRDARDTGRLQATPMFTSLDEVDADHLIWCTGFRPALGPVRRLLDGTTPRYSALHLVGYGDWTGPGAATITGVGPYAKQAAREIAESVGKVVK

SEQ ID NO: 14336 - protein, 456 aa, Streptococcus thermophilus CNRZ1066
MVFIKETPIMAITAADIRREVKEKNVTFLRLMFSDILGIMKNVEIPATDEQLDKVLSNKVMFDGSSIEGFVRINESDMYLYPDLDTWTVFPWGDENGSVAGLICDIYTSAGEPFAGDPRGNLKKALRHMEEVGYKSFNLGPEPEFFLLKLDEQGNPTLEVNDKGGYFDLAPTDLADNTRREIVNVLTEMGFEVEASHHEVGVGQHEIDFKYTEVLKACDNIQIFKLVVKTIARKHGLYATFMAKPKYGIAGSGMHCNMSLFTEEGNAFFDPEDPHGMQLSQDAYYFLGGLMKHAYNYTAIINPTVNSYKRLVPGYEAPVYIAWAGSNRSPLIRVPASRGMGTRLELRSVDPMANPYLAMAVLLEAGLDGIINKIEAPAPIETNIYSMSPEERKEAGIIDLPSTLRNALKALETDEVVRQALGNHIYTNFLDAKRLEWASYATFISQWEIDNYLDLY

SEQ ID NO: 14337 - protein, 471 aa, Bacillus cereus ATCC 10987
MSKLFKKKSVTQLLDPSKSKTLMKTLGSFDLVMLGLGSIIGTGVLVLAGLVAARDAGPAVVFSFVLAAIVCGFIALCYAEIASILPVSGSVYTYAYATIGELVAHLVGWMLLSIYILATAAVASGWTGYFHNLISGLGLDMPKSLLMIPSQGGMMNLPAMVITLIITWMLSRGTKESKRINNIMVLIKIGMVILFIVVGVFYIKPENWVPFTPYGVSGVLAGGAAAFFTFMGFDILATSAEEVKDPQRNLPIGIIVSLIICTLIYVIVCLVMTGMVSYKELNVPEAMAYVMEVVGQGKVAGVIAVGAVIGLMAVIFSSMYAATRVFFAMSRDGLLPKSLAKINRKTGAPTFTIGLVGIGSSFIAGFIDLKELANLVNISGLVTYSMVGVSVIVLRKTHPNLKRGFMVPFVPILPIISIASCVFLMFNLPLRTWLYFCIWITIGVIIYFVYSIKHSNLNEEAISKAKDKIVK

SEQ ID NO: 14338 - protein, 391 aa, Halobacterium sp. NRC-1
MSEDFYDVLGVSRDATEDEIMQAYRDQVSEYHPDVSDDPDAEEKFKKIQKAKDVLTDEETRQQYDQLGHERFEEAEKRGATGNGGGGAGGMGGAGGPFGGGMGGGAGGGMGDIFEQFFGGAGGGGGRGRSGPEQGRDLRTDLTVTLSEAYRGVSKQVTVRRPESCADCGGSGYPEDADVRTCPQCDGQGVVTQVRQTPLGRVQQRQECSRCGGEGELHSETCSTCGGQGQTRERATLTVDIPEGIRTGQTLRMDGEGAPGEPGAPNGDLLVDVTVEEHPDFERDGDDLHHRHAVSFPQAVFGAEIEVPTLDGAATFDLDAGTQSGETFRLKGKGMPRLRRRGNGDLYVTVQVVTPESLSDEQRDALEQFAEAGGEEIDVEQGFFEKLKNSF

SEQ ID NO: 14339 - protein, 311 aa, Micromonospora echinospora
MESAAVPPTRPSLVLTGHQEGVIGAVFHPDDHLVATSGEDGTVRLWDATTGEQVGRTLTGHTDTVWLVVFDPEGRLLASASEDRTARIWDVSTGEQVGEPLTGHTAGVYGVAFHPDGGLLATGSADHTVRLWKVPGGEPVGEPLTESTDEIDGVAFHPDGHLVASTGDAVRLYDTATGRPVGTPLVGHTKGAVSVAFSPDGRLLASGSDDLTVRIWDHAAGGAAVEPLVGHTDAVDGVVFHPNGRLLVSAAEDCTVRVWDVATGRQVGEVETGHTAPVWNIAFDRSGERIVTASQDGTARILPFPAYPAAG

SEQ ID NO: 14340 - protein, 386 aa, Yersinia pseudotuberculosis IP 32953
MSTLSFIPDSKLPAQGTTIFTQMSALAQKHQAINLSQGFPDFDGPDYLKQRLAYHVDQGANQYAPMIGVAPLRHAIAEKTANLYGWRPDAEHEVTVTTGASEALFAAITALVRPGDEVICFDPSYDSYAPAVKLAGGVLKRITLKPPAFTTDWAEFTRLLSERTRLVIVNTPHNPSATVWCAEDFEQLWQVIAERNIYVLSDEVYEHICFSRSGHASVLAHPQLRQRAIAVSSFGKTFHMTGWKVGYCIAPAAISAEVRKIHQYLTFSVCTPVQLALADMLNAEPEHWQQLPKFYRARRDRFVKALAASRLKILPSEGTYFLLADYSGISDLDDVEFCQWLTEHVGVAAIPLSVFCEAPFPHKLIRLCFAKQDATLDAAAERLCQL

SEQ ID NO: 14341 - protein, 196 aa, Physcomitrella patens
MSTSRFIKCVTVGDGAVGKTCMLISYTSNTFPTDYVPTVFDNFSANVVVDGNTVNLGLWDTAGQEDYNRLRPLSYRGADVFLLAFSLISKASYENISKKWIPELRHYAPSVPIILVGTKLDLRDDKQFFADHPGAAPITTSQGEELRKSIGAASYIECSSKTQQNVKAVFDAAIKVVLQPPKQKKKKKKQKNCVIL

SEQ ID NO: 14342 - protein, 297 aa, Magnetospirillum magnetotacticum MS-1
CAIRQDATPKLRTSRTRIREGSPHPRGATWDGRGVNFALFSAHATKVELCLFDDAGEKEIERIALPEYTDEVWHGYLPDARPGTIYGYRVHGPYEPEAGHRFNPNKLLIDPYAKGLVGTIEWNPALFGYKMETGDDLTFDERDSAPYTRRSRVIDPAFTWGRDAKPRVPWERTIVYETHVKGFTKLHPAVPEKLRGTYAGMGHPAVLDYIKSLGVTSVELLPVHSFVQDDYLQQKGLINYWGYNTISFFTPARRYAAVPDFAFSEFKEMVARMHGAGLEVILDVVYNHTAEGNEGDP

SEQ ID NO: 14343 - protein, 846 aa, Oryza sativa
  misc_feature (315)..(315): Xaa can be any naturally occurring amino acid
MQMPFCPKLWSSAAPAPVQPGSVVINGTVVVANHFGLSAPGKSTTLRLFSGTEVDHETRKGRLSAEAALRGGKKTRHGKASTTMYQVTFFVDGEFGTPGAVAVKNGNRNDQFFLRHVRLDLAEDRSIHFDCNSWVYPYKKTTSDRVFFINTSYLPDKTPEALRLLREEELRSLRGNGRGERKDWERIYDFDYYNDLGNPDNDDHVRPVLGGTKTHPYPRRCRTGRPLSKTDGVTETRKHKLINLDYYIPPDERFSPGKLAEVLAMGVQAVTHFVIPEARSIFHGDVVNFKSTEQLRADLYGKPPQPAADARVMDXKSSVPSHKTYKQVSRIVKDNPAKFPTPQVIHYDTEAWRSDEEFAREMLAGLNPVVIKRLEVFPPNKSKITTDDIMTQIGGLTIQQAMEQKRMYILDHHDYLMPYLRRINTEGVCVYASRTLLFLRDDGALRPVAIELSLPDGGVGGSEISRVFLPASQGTDAHLWHLAKTHVAVNDSGYHQLISHWLFTHATVEPFIIATRRQLSAMHPIHKLLDPHFKDNMQINTLARSILLNAGGLLEKTMYPGKYSMEMSSDIYAHWRFTEQSLPNDLIKRGMASRDPKARGGVSLHIEDYPYAVDGIDVWLAIEGWVRSYCDHFYHADAAVAGDAELQAWWDDVRRVGHGDRQGDAACWLDLDTVAGLVETLSTLIWTASALHAAVNFGQYGYAGYPPNRPTRCRRFVPLPGSPEMAQLEADPGRFFLETVPDRFTATLGIALIEVLSNHTSDEVYLGQRATSTWTDDGEVLLLLDRFRDELRRVEKRVEERNKDPRLVNRRGPVRVPYTLLYPDAGDVAGKEKGITGRGIPNSVSI

SEQ ID NO: 14344 - protein, 127 aa, Rhizobium leguminosarum bv. viciae 3841
MSRRTVNASNAAAVGPYSHATWAGNLLFCSGQTPLDSSTGKLVDGTVADQTRQCFDNLFEVLEAAGLGSDDVVSVNVYLTDMDDFGQMNEIYATRFSSPYPARTTIGCASLPLGARIEIGLTAKRQS

SEQ ID NO: 14345 - protein, 392 aa, Bacillus cereus ATCC 10987
MKSFQPSEIVTSLPTQFFASLVAKVNKVVAAGHDVINLGQGNPDQPTPQHIVKALQDAAEKTIHHKYPPFRGHESLKEAVATFYQREYGVELNSKTEVAILFGGKAGLVELPVCFTNPGDTILVPDPGYPDYLSGVALAKAKFETMPLIAENNFLPDYAKIDDSIAERAKLMFLNYPNNPTGATASKDFFDETIHFANKHNILVIHDFAYGAIGFDGQKPVSFLQADGAKDTGIEIYTLSKTFNMAGWRIAFAVGNESVIETINLLQDHMYVSIFGAVQDAAREALLSSQSCVIDLVNSYEARRNALISACHSIGWNVNIPTGSFFAWLPVPKGYTSEQFSNILLEKAHVAVAPGVGFGEHGEGYVRVGLLHTEDRLREAIHRIDKLNFFKK

SEQ ID NO: 14346 - protein, 303 aa, Halobacterium sp. NRC-1
MDALSRYEPIIDDFEGFLAACERPLPTTVRVNPLAVTPDRAVEALAAEGVAVDRREWHPGVLEVDTNKPGNTWPYVHGWVHGQEEVSCVPPRVLDPEPGDVVWDACAAPGGKTAQIAAEIDDDGLVVANDDNLGRLSALRGNCDRLGVTSAAVTNTDARRATLDAFPDVAAVDAALVDAPCSCEGTIRKNADALDGAGASASRSLGRLQADILARAVALTRPGGTVVYSTCTFAPEENEAVVDEVLGRTDSRLVEFDVGLASAPGLTEWGDASYDDSLARAQRYYPHHNDTGGFFAAKLEVTA

SEQ ID NO: 14347 - protein, 376 aa, Crypthecodinium cohnii
MADDEVAAIVCDNGSGMVKCGFAGDDAPRAVFPSIVGRPKMPGIMVGMDQKDSYVGDEAQSKRGVLTLKYPIEHGIVTNWDDMEKIWHHTFYNELRVAPEEHPVLLTEAPLNPKANRERMTQIMFETFNVPAMYVAIQAVLSLYASGRTTGIVMDSGDGVSHTVPIYEGYALPHAILRLDLAGRDLTEYMMKILTERGYSFTTTAEREIVRDIKEKLSYIALDYDSEMKVATESSDKEKTYELPDGNIITVGSERFRCPEVLFNPSLLGKESSGIHDTTFQSIMKCDVDIRKDLYANVVLSGGTTMFSGIGERMTKELTALAPSTMKIKVVAPPERKYSVWIGGSILSSLSTFQQMWISKGEYDESGPTIVHRKCF

SEQ ID NO: 14348 - protein, 517 aa, Bradyrhizobium sp. BTAi1
MNGYRSRPAAAAGDKSGLMEVLTTSEMERADRLTIAAGTPGFSLMLSAGQAVADAAMDLVETGPILVVCGPGNNGGDGFVAAAELAAQGREVSVVLMCERDALQGDAASAARGWKFPVLPFTPQAIGKPALIIDALFGAGLSRPVAGDPHDVIAAINANGAPVLAVDLPSGINGTTGAVMGIAVKATETVTFFRKKPAHLLLPGRQHCGHVRLADIGIAPQVLDEIKPQAFENDPELWHGHFPVPRIDGHKYARGHVLAMSGDVAATGAARMAARAALRAGAGLVTLASPRDALAVNAAALTAVMVRAADTVLEFAELLGDRRYNTCIIGPGTGVNERTRDVVFTALTAQRHLVLDADALTSFADAPERLFEQIRATPAAQIVLTPHEGEFPRLFSDLSNKHPGRSKLERVRAAAARCGAVVLLKGADTTVAAPDGRAAIAANAPPWLATAGAGDVLAGIIAGLLAQGVPAFEAACIGVWMHGEAGAEAGPGLIAEDLTETLPAVFRRLYDRLGVEY

SEQ ID NO: 14349 - protein, 505 aa, Nocardia farcinica IFM 10152
MIYAKPGTEGSIVDYAARYDNFIGGEWKAPVEGRYFENPSPVDGEVFCEVARSSAADVELALDAAHAAADAWGKTSASERANILNKIADRIEQNLEALAVAETWENGKPVRETLAADLPLAVDHFRYFAGAVRAQEGGISEIDNDTIAYHFHEPLGVVGQIIPWNFPILMATWKLAPALAAGNAVVLKPAEQTPASILKVVELIADLLPPGVLNVVNGFGVEAGKPLASSSRVAKVAFTGETTTGRLIMQYASENIIPVTLELGGKSPNIFLPDVMAADDAFLDKAVEGFVMFALNQGEVCTCPSRALIHSSIYDEFMARAVERTKAIVSGNPLDDATMIGAQASNDQYEKILSYIDIGRKEGAEVLTGGGPRKVDVFPNGYYVEPTIFKGRNDMRIFQEEIFGPVVSVTTFDSVDEAISIANDTLYGLGAGVWTRDMNTAYRLGREIKAGRVWTNCYHAYPAHAAFGGYKKSGIGRENHKMMLDHYQQTKNLLVSYSPDKLGFF

SEQ ID NO: 14350 - protein, 469 aa, Bradyrhizobium sp. BTAi1
MKTAKDVLKAIKDNDVKYVDLRFTDPRGKWQHVTFDVSMIDEDIFAEGTMFDGSSIAGWKAINESDMCLMPDPVTATIDPFFAETTMIITCDVLEPTTGEPYNRDPRGIAKKAEAMVKSMGVGDTVFVGPEAEFFVFDDVRYSSSPYNTGFRLDSSELPTNSDTEYEGGNLGHRIRTKAGYFPVPPQDSVQDMRSEMLGAMARMGVKVEKHHHEVASAQHELGMKFDTLTLMADQMQIYKYCIHQVAHIYGKTATFMPKPVYGDNGSGMHVHQSIWKDGKPVFAGNKYSDLSETCLSYIAGIIKHAKAINAFTNPSTNSYKRLVPGYEAPVLLAYSARNRSASCRIPYTSSPKAKRVEVRFPDPLANPYLGFAAMLMAGLDGVKNKLDPGPAMDKDLYDLPKEELKQIPTVCGSLREALENLDKDRAFLKAGGVFDDDFIDSYIALKMTEVERFEMTPHPVEFDMYYSG

SEQ ID NO: 14351 - protein, 427 aa, Exiguobacterium sibiricum 255-15
MKTETLTMPQLGESVTEGTISLWLVKPGDTVKKYDPIAEVITDKVTAEVPSSFDGVIDKLLAEEGDTLQVGEAIVTLQVSGGSTEVAATEEAVPAIEETPVSSDQSMKKRYSPAVLKLSAEHGIDLEQVSGTGAGGRITRKDLLKIVETGQIKQPDTVEAPTIESVPAAKPAEQRESAQPSRPQAAKSTASTTEDGDIEIPTAGVRQAIATNMVRSKHEAPHAWLMIEVDVTNLVEARNRHKDAFFKQEGVKLTFLPFFMKATVEGLKKHPIMNSTWAGDKIIQKKAINLSLAVATQEALFVPVVKNADELSIKGLARSIDDFGKRAQAGRLSSSEMQGGTFTVNNTGSFGSIQSAPILNFPQAAILSVESIVKRPVWINGMFAARDMVNLCMSIDHRVLDGLVAGQFLQTVKQSLESIDPNQLSLY

SEQ ID NO: 14352 - protein, 391 aa, Xanthomonas campestris pv. vesicatoria str. 85-10
MSIVRMTDLDLSGKRVLIRQDLNVPIDNGQITSEQRITASVPTIKLALEKGAAVMVTSHLGRPKEGSWTEEDSLAPVATRLAALLGVDVPLVRDWVDGVDVAPGQVVLLENCRMNVGEGKDDETLARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHAVGKSLNEPDLIPTANQIVADAKARGAEIPLPTDVVVAKQFLPDAQASVKSLDAVDADDLILDIGPHTAQRYAELIASAGTVVWNGPVGVFEFESFSHGTETLARAIASSKAFSIAGGGDTLAAVDKYDIAQEVTYISTGGGAFLEFLEGKTLPAVAALQARGQ

SEQ ID NO: 14353 - protein, 327 aa, Exiguobacterium sibiricum 255-15
MTTLSLIEAINSAIKEEMERDESVFVLGEDVGVRGGVFRATQGLLEQFGEERVIDAPLAESAIAGVGIGAAMYGMRPIAEMQFADFIMPAVNQIVSEAAKIRYRSNNDWSCPIVIRAPFGGGIHGALYHSQSVEAMFNSTPGLKIVIPSNPYDAKGLLKAAIRSNDPVLFFEHKRGYRLLKGEVPEGDYTVEIGKADVKREGEDLTVITYGLCVQFALEAAARLEKDGIDVHILDLRTVYPIDREAVVAAARKTGKVLLVTEDNKEGSVMSEVSAIIAEEALFDLDAPIERLCGPDVPAMPYAPTMEKFFNVSSEKIEDKIRTLHAY

SEQ ID NO: 14354 - protein, 279 aa, Nocardia farcinica IFM 10152
MGFPEQQQDVPGVQAAMNPVPDCGEDSYRGSGKLTGKSAVITGADSGIGRAVAIAFAREGADVLISYLNEHDDAKQVAQLVEDAGRKAILVAGDLADPTHCRTVVERAATEFGKIDVLVSNAAYQMTHETLEEISDEEFDYTFKLNVGAYFYLVKAALPHMPPGSSIIGSSSVNSDMPSPTLAPYAATKAAIANFSASLAQLLGDRGIRVNSVAPGPIWTPLIPSTMPTEKVSKFGDDTPLGRAGQPAELAAAYVLLASDDGSYISGARLAVTGGRPIL

SEQ ID NO: 14355 - protein, 452 aa, Triticum aestivum
  misc_feature (176)..(176): Xaa can be any naturally occurring amino acid
  misc_feature (196)..(196): Xaa can be any naturally occurring amino acid
  misc_feature (221)..(221): Xaa can be any naturally occurring amino acid
  misc_feature (248)..(248): Xaa can be any naturally occurring amino acid
  misc_feature (277)..(277): Xaa can be any naturally occurring amino acid
LERGRGSTHSPAPAASSSPHHHKPVTTIRIGGGDREAGGDAGEELRGEGVMAAVMDYFRSCWGARSRAGRRGKKGSDAAGRQDGLLWYKDAGQAATGDFSMAVVQANNLLEDQSQVESGSLSMADPGPQGTFVGVYDGHGGPETSRFINDNMFHHLRRFATEHKCMSADVIRKAFXATEDGFLSVVSKEWSMKPQXSQAVGSCCLVGVICSGTLYIANAGXTRRAVLGRLVKATGQVVAMQLSAKHNXAIEEIRQELQSSHPHDSKIVGLKHNVWRXVKGLIQISRSIGDVYLKRPEYNRSPLHSKFRLRETFKKPILSSEPAIAVHQIQPSDQFVIFASDGLWEHLSNQEAVDLVQSNPRNGIARKLVKAAMQEAAKKREMRYSDLKKIERGVRRHFHDDITVVVVFLDASAVSRAGWSKSPSVSVRGGGVSVPANSLAPFSAPAMVSSTY

SEQ ID NO: 14356 - protein, 473 aa, Exiguobacterium sibiricum 255-15
MAREFDVVVLGGGPGGYVAAIRAAQAGKTVAIVEQGKLGGTCLHRGCIPSKAFLKSAAVYQTVKHAATYGVDVPESFLRFEQVKQRKQDIIDGLESGIQHLMKKGKIEVFHGRGSILGPSIFSPMPGTISVEPEEGDGELILPRQLIVATGSRPRPLNGLAFDSEYVLSSDEALDMNALPKSIVIIGGGVIGIEWASMLTDFDVEVTVVEFSDRILPTEDQAVSREVARQLKKRGVKIMTSAAAQSDSFQLTESGVTIDVDRNGDKTTLAADKLLVAIGRMANVEGIGLENTNIIVENGFIQVDDEFRTKDNHIFAIGDVIGRLQLAHVASAEGAKAVETIVNGSTTPLNYAFVPRCIYSVPEAASVGLTEAEAKAAGLDVKTGMFSFNGLGKARIEGEAAGFIKLVSDAKTDDLVGVHIVGPKATELISEGGLALVLNATAWEVGQLVHPHPALSEAFGEAALAVDGLAVHA

SEQ ID NO: 14357 - protein, 333 aa, Xanthomonas campestris pv. vesicatoria str. 85-10
MAIKVGINGFGRIGRNVLRSAAQNFANDIEIVAINDLLEPDYLAYMLQYDSVHGRFKADVSVDGNTLIVNGKKIRLTQERDPANLKWDAVGADVVIESTGLFLTKETAQKHIDAGAKKVILSAPSKDDTPMFVYGVNDKTYKGEAIISNASCTTNCLAPLAKVINDKWGIKRGLMTTVHAATATQKTVDSPSNKDWRGGRGILENIIPSSTGAAKAVGVVIPELNKKLTGMSFRVPTSDVSVVDLTVELEKPATYAEICAEVKAQSEGALKGVLGYTEDKVVATDFRGETCTSVFDADAGIALDSTFVKLVSWYDNEWGYSNKCLEMVRVVAK

SEQ ID NO: 14358 - protein, 374 aa, Exiguobacterium sibiricum 255-15
MVETNVEARFSIFETMAMEDYEQVVFCHDKVSGLKAIIAIHDTTLGPALGGLRMWNYASDEEALIDALRLAKGMTYKNAAAGLNLGGGKAVIIGDAKTQKSEALFRAFGRYVQSLNGRYITAEDVNTTVADMDYIHMETDFVTGVSPAFGSSGNPSPVTAYGVYRGMKAAAKEVYGTDSLGGKTVAIQGVGNVAFNLCRHLHEEGAKLIVTDINQDALRRAEEAFGALVVGPDEIYSVDADIFAPCALGATLNDETIPQLKVKIIAGAANNQLKEDRHGDMLQERGILYTPDFVINAGGVINVADELDGYNRERAMKKVELVYDAVAKVIEIAKRDHLPTYRAAEKMAEERIATMGSARSQFLRRDKNILGSRG

SEQ ID NO: 14359 - protein, 399 aa, Streptococcus thermophilus CNRZ1066
MAKLTVKDVELKGKKVLVRVDFNVPVKDGVITNDNRITAALPTIKYILEQGGRAILFSHLGRVKEEADKEGKSLAPVAADLAAKLGQDVKFIPGVTRGAELEAAVNALEDGQVLLVENTRFEDVDGKKESKNDPELGKYWASLGDGIFVNDAFGTAHRAHASNVGISANVEKAVAGFLLENEIAYIQEAVENPERPFVAILGGSKVSDKIGVIENLLEKADKVLIGGGMTYTFFKAQGIEIGNSLVEEDKLDVAKALLEKSNGKLILPVDSKEANAFADYTEVKYTEGEAVDPGFLGLDIGPKSIAKFDEALTGAKTVVWNGPMGVFENPDFQAGTIGVMDAIVKQPGVKSIIGGGDSAAAAINLGYADKFSWISTGGGASMELLEGKELPGLAALTEK

SEQ ID NO: 14360 - protein, 139 aa, Triticum aestivum
MDVEIQRPREVGSCRVVKVDKEAAWELFTTQAANEGRTVAAHFGASWCVTSLSMNYKFEELAQTHPDMLFLFVDVDDVPGVSSKLGVKAMPTFFLIKGKEVVKKIVGANSDELHKMVDASDDDSLGSAVTALPDIVIEK

SEQ ID NO: 14361 - protein, 345 aa, Streptococcus thermophilus CNRZ1066
MIFIRRKSLMVVKVGINGFGRIGRLAFRRIQNVEGVEVTRINDLTDPVMLAHLLKYDTTQGRFDGTVELKDGGFEVNGKFVKVSAERDPEQIDWANDGVEIVLEATGFFTKKVLAEKHLHPGGAKKVVITAPGGNDVKTIVFNTNHDILDGTETVISGASCTTNCLAPMAKALNDNFGIVEGLMTTIHAYTGDQMILDGPHRGGDLRRARAGAANIVPNSTGAAKAIGLVIPELNGKLDGSAQRVPVPTGSVTELVAVCEKNVTVDEVNAAMKAATNESYGYTEDPIVSSDIVGMSYGSLFDATQTKVLDVDGKQLVKVVSWYDNEMSYTLQLVRTLEYFAKIAK

SEQ ID NO: 14362 - protein, 517 aa, Triticum aestivum
  misc_feature (175)..(175): Xaa can be any naturally occurring amino acid
  misc_feature (186)..(186): Xaa can be any naturally occurring amino acid
MDKAYIAILTIAFLFLIHYVLGNGRRGGKGAAQLPPSPPAIPFLGHLHLLEKPFHAALRRLAARLGPVFSLRLGSRRAVVVSSAECARECFTEHDVTFANRPRFPSQLLVSFDGAALVTSSYGPHWRNLRRVAAVQLLSAHRVACMSGVIAGEVRAMARRLFRAAAASPGGDGAXARVQLKRRLFXLSLSVLMETIAQTKATRSEADADTDMSVEAQEFKKVVDELIPYLGAANTWDYLPVLRWFDVFGVRNKILAAVSRRDAFMLRLIDNERRPTRPAGTEGDKKSMIAVLLNLQKTEPEVYADTMITALCANLFGAGTETTSTTTEWAMSLLLNHPAALKKAQAEIDAAVGTSRLVTADDVPRLAYLQCIVSETLRLYPAAPMLLPHESSADCKVGGYNVPSGTMLMVNAYAIHRDPAAWERPLEFVPERFEDGKAEGRFMIPFGMGRRRCPGETLALRTIGMVLATLVQCFDWERVDGAEVDMTEGGGLTIPKVVPLEAVCRPRPAMRDVLQSL

SEQ ID NO: 14363 - protein, 373 aa, Halobacterium sp. NRC-1
MTEFSDRVAQVSISGIRAVFEAAGEDAINLGLGQPDFPTPDHARQAAVDAIESGAADGYTSNRGTAALVDAIVEKHARDQGVDVAPAGVIATAGGSEALHLAMEAHVDPGDEVLFPDPGFVSYDALTRMAGGNPVGLPLRDDLTLAPETVEDHITDDTAAFVVNSPANPTGAVQSPADMRAFARIADEHDVLCISDEVYEHIVFEGEHRSPMEFADTDNVVVVNACSKTYSMTGWRLGWVAASERRAERMLRVHQYVQACASAPAQYAAEAALSGPQGVVDEMVAAFEARRDVLLDGLEAMGLDVPTPGGAFYAMPTVPDGWIDEVVDRGVVVVPGSAFGDHGAGTARISYATDMATLRDAIDVMRAATAAVQ

SEQ ID NO: 14364 - protein, 318 aa, Rhizobium leguminosarum bv. viciae 3841
MIVVCGDALIDFLPVALPEGGSGYIPVCGGSCCNIATAIGRLGGKVGFMGGLSEDFFGAMLVQQFNEAGIDLRYATRLPFDTTLAFVRLGDDEPEYAFYDSGSAARHWTLKGAPSLGTEVDVLHIGSVTLIHPPVSSACESLFENEQGKRVLSIDPNCRPGLAQDPEAYRQRLNRLCGMADIVKLSVTDLGFMQPGVGPHSAAESWLSNRAKIVLVSRGAGGATVYLAGGRVVEVPARPARVVDTVGAGDALIAGFLTHLQQSGDLHRDSIGALTGDRARKALEFAAHVASLACEHRGSDPPWRREIIVAGYDESSQM

SEQ ID NO: 14365 - protein, 221 aa, Arabidopsis thaliana
MVSRQEGTLYSRKRDFTVCGEEFHNSFKKSKQEDQSQSTLFNERPKSESMRSITFDFELHLHTPLPSDWQTKGYSRTSDEHRAYPKDPVIFGQPKMSLDLELNLSPSGSPSRTTTKKYESSSIHNETVSSSKIKVLTNTSKKSIIGTGLSRSPSWLAFEGGDDNDVDHKGQEMVTTVCMKCHMLVMLCTSTPVCPNCKFMHPHDHSSTKLFKPSNLLRLLC

SEQ ID NO: 14366 - protein, 804 aa, Rhizobium leguminosarum bv. viciae 3841
MKAPSIPIHAYDENIEAERARYGDEGLLQILRDMIIIREFETILASLKGKGAYCGIEFNYKGPAHLSIGQEAAAVGAAASLEPDDHIFGSHRSHGEFIAKGLSAIRKLPDDALRLIMESHERGTLLRTVETSLQGPKTSETAENFLLLGLLSEIFMRSTGFNRGMGGSMHAFFPPFGTYPNNAIVGASAGIATGAALRKKLAGASGITVANAGDGSTGCGPVWEAMNFAAMAQFETLWADAFKGGLPVLFFFTNNFYAMGGQTIGETMGWDRLSRIGLAVNQQAIHAETVDGTNPLAVADAVARKRELLVQGRGPALLDVECYRSSGHSTTDINSYRTKDEMQAWEQHDPIILFSNRLQEAGIVTAGQVAELREQTTDRMRSITAIAVDPALTPPVDIHADPTLIGKLMFSNTNIELPSQEVSLLKPVDEVSRIRQDAKKSRYGFAEDGAKLSPMRAITLRDALFESVLHHMTHDGSLVAYGEECREWGGAFGVYRGLAEILPHDRLFNSPISEAAIVATAVGFALEGGRALVELMYGDFLGRAGDEVFNQMAKWQSMSGGELKVPVVLRCSIGSKYGAQHSQDWTALCAHIPGLKVVYPATPYDAKGLLASALSGNDPVVFFESQRLYDTVEEFRNEGVPTGYYQLPIGEPDCKRAGEDVTILTVGPSLYSALAAAEELESTFGISVEVIDARSLVPFNYEPVLASIRKTGRIVLVSEASERGSFLMTLAANITRFGYETLHAAPRVIGSPNWIVPGAEMESTYFPQKDDIIDVITSELFPGQRSNRRSIRDWDDRELARLGL

SEQ ID NO: 14367 - protein, 144 aa, Triticum aestivum
MARLFAVCLVLLAFAMAVAADMAPMMAPMAAHMAPMMAPADMAPMMAPMAAPAADAGDCNSDLQDLVANCQNYVMFPAEPKIPPSPACCAVIQRADMPCLCAKVTPAVEKVVCMDKVVFVAKYCKRPLQPGSNCGSYPVPGVIV

SEQ ID NO: 14368 - protein, 368 aa, Halobacterium sp. NRC-1
MRDRLLDANAENNKYQQKLERLSHENKKLKQSPLFIATVQELTDEGAVIKQHGNNQEALTEVTDELRATLEPGSRVAVNNSLSVVRQLDDEADVRARVMEVDDSPDVGYEDIGGLDDQLREVRETVELPMKDPGLFETVGINPPSGVLLHGPPGTGKTLMAKAVASQTDASFIKMAGSELVHKFIGEGAKLVRDLFQVARDHEPAVVFIDEIDAIASKRTDSKTSGDAEVQRTMMQLLSEMDGFDERGDIRIIAATNRFDMLDRAILRPGRFDRLIEVPHPNVGGREKIFRIHTRAMNVADSVDFGELAADTGDLSGADVKAICTEAGMFAIRDDRTEVRMQDFQSAREKLDQDSEPAAATDVSRTFA

SEQ ID NO: 14369 - protein, 317 aa, Burkholderia thailandensis E264
MTTALDQLKQYTTVVADTGDFQQLAQYKPQDATTNPSLILKAVQKDAYRPILEKTVRDHAGESVGFIIDRLLIAFGTEILKLIPGRVSTEVDARLSFDTQRSIDKGREIIKLYEAAGIGRERVLIKLASTWEGIRAAEVLQREGIRCNMTLLFSLVQAAACAEAGAQLISPFVGRIYDWYKKQKGAEWDEAKDGGANDPGVQSVRRIYTYYKQFGYATEVMGASFRTTSQITELAGCDLLTISPDLLQKLHDSAETVARKLSPDAAKDAQLERVAIDESSFRFQLNDDAMATEKLAEGIRLFSADAVKLEKMIDALR

SEQ ID NO: 14370 - protein, 78 aa, Brassica napus
MDPSAANSPELLRFLNEEEQRVMMNEAVAKLTSVCWDKCLTSAPGSKFSPSEYSCLTHCAKRYADMSMVIIRSTQSKK

SEQ ID NO: 14371 - protein, 288 aa, Bacillus anthracis str. Ames
MPQQKNFVTMPAQHQNKQPGIESLMNPLPQFEDPNYKGSEKLKGKNVLITGGDSGIGRAVSIAFAKEGANIAIAYLDEEGDANETKQYVEKEGVKCVLLPGDLSDEQHCKDIVQETVRQLGSLNILVNNVAQQYPQQGLEYITAEQLEKTFRINIFSYFHVTKAALSHLKQGDVIINTASIVAYEGNETLIDYSATKGAIVAFTRSLSQSLVQKGIRVNGVAPGPIWTPLIPSSFDEKKVSQFGSNVPMQRPGQPYELAPAYVYLASSDSSYVTGQMIHVNGGVIVNG

SEQ ID NO: 14372 - protein, 387 aa, Corynebacterium efficiens YS-314
MRNKYVVERLRPFGETIFATMTQRANEAGAINLGQGFPDEDGPAPMLEIASQQILGGNNQYSGGRGDLGLRTAVASDRHKRFKLDYDPDTEVLITVGATEAISASVLGLVEPGDEVIVLEPYYDAYAAAIALAGATRVAVPLKEEDNTWVLDTDAVHAAVTKKTSMIIVNSPHNPTGSVFSKRSLEALAGIARAYDLLVLSDEVYEHLTFDKVSHTAVASLPGMWDRTITVSSAAKTFNVTGWKTGWALAPAPILEAVIRAKQFMSYVGATPFQPAVAHAVAHEKPWVKQMRKGLQNKRDILTDALTQAGLKVHDSHGTYFVVADIGERDGAEFCFDLIDRVGVAAIPVQAFVDKPEQWSSKVRFAFCKQEDTLREAAQRLRAAGSL

SEQ ID NO: 14373 - protein, 313 aa, Bacillus anthracis str. Ames
MRNVFCIGELLIDFVCRNTNVSLVNGSNFEKKAGGAPANVAAAITKLGGHATFMGQVGNDPFGEFLEQTLQHAHVDTSMLIKDKQTTLAFVSIDQNGERDFTFMRGADGEYHFNSIDLSKIKTNDLIHFGSATALLSSPLKDTYFQLLQHARESGQFISFDPNYRNALITNTEQFIQDCLTFIKHAHFVKVSQEEAIMLSKESDLQQSALKLLNHGAKAVAITLGKDGTLLATKDKQTIVPSISIQQVDTTGAGDAFVGAMLYQIAKSEQMFLHNFEGLTTFISFANKVGALTCTNYGAISSLPSLTDVKAYE

SEQ ID NO: 14374 - protein, 452 aa, Arabidopsis thaliana
MASGVFEDEAEGTITINEYIERLDAEELAADLVLGGDEGDECTFPKGYMKRQAIFSCITCTPEGNAGICTACCLSCHDGHELLELWTKRNFRCDCGNSKFGTLACKLLPSKDIENSENSYNHNFKGLYCTCDRPYPDPNVEEQVEMIQCCLCEDWFHEEHLGLTPSDSVGSQIPRDEESEPIYEDFICQNCSPACSFLTLYPENLWVVAKVDSTGSANACSETIELDKNHMDYEPGQPENGTDAEKSVVGKCSETISDSEPGQPENGTEAEKSVVQKCSEKIDESEAGQPENSTEAEKFVVRKCSEKIDGSENVPAAGCVIRTDLNSCPEFEKKPLFLTKNWRNILCRCEKCLEMYKQRKVSYLLDAEDTIVEYEKKAKEKRTEKLEKQEGEALDLLNNLDHVSKVELLHGIKDFQDGLQGLMESAGPSKAITSADIEQMFSKLKNKRKRME

SEQ ID NO: 14375 - protein, 247 aa, Glycine max
  misc_feature (30)..(30): Xaa can be any naturally occurring amino acid
  misc_feature (240)..(240): Xaa can be any naturally occurring amino acid
MAAYKLVLIRHGESAWNLENRFSGWYDADXSAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRXAMGAVAA

SEQ ID NO: 14376 - protein, 86 aa, Coprinopsis cinerea okayama7#130
MSESTLQFDAATQKELAEFVESELAKRKYQESVQKFTGMCWDKCITSVSSNSLSRSEESCLANCVDRFMDASLYIVSQVESKRNQA

SEQ ID NO: 14377 - protein, 749 aa, Mycobacterium tuberculosis CDC1551
MIGNGGAGGSGAPGAIGGAGGPAGLIGVGGAGGAGGDSAVAGVIGGAGGAGGAALLFGAGGAGGAGGSGGSGAAGGAGGAGGAGGLFASGGSGGFGGFASTGTGGAGGTGGAGGLFASGGVGGTGGGAGSGGTGGVGGTGGAGGLFASGGAGGAGGSGGTGGAGGTGGAGGLFGAGGAGGLGGQGNHTGGHGGAGGSAGLLALGDGGAGGAGGAATTGTGGAGGAGGKAGLLFGSGGAGGSGGAAGTFGDTGNSGGAGGAGGKAGLLFGSGGAGGSGGAGGFANGSTGGAGGAGGGAGLIGNGGNGGSGGTSVATGGAGNGGAGGAGGGAGLIGNGGNGGSGGMGDAPGGTGVGGIGGLLLGLDGANAPASTNPLHTAQQQALAAVNAPIQAVTGRPLIGNGANGAPGSGAPGGHGGWLFGGGGTGGSGVSGGAGGDGGAGGILFGAGGAGGAGGAVTGTGATGGSGGAGGGALLFGAGGAGGAGGSSGIGGFAAGGAGGPGGAGGLFNGGGAAGAGGSGVSGGAGGEGGAGGAGGLFAGGGAGGAGGSGNNVGGAGGAGGVGGLFGAGGAGGSGGGGSVAGDGGAGGNAGLLAPGLAGGAGGGGGQGFDTGGAGGPGGDAGLLVGSGGVGGAGGFGLTTGGPGAAGGDAGLLFGSGGAGGAGGSGRTDLGGAGGAGGKAGLIGNGGNGGAGGAGGNGGGDGGPGGAAFGLGNGGNGGNGGTGTSAGSPGAGGAGGSLIGAEGLPGLLP

SEQ ID NO: 14378 - protein, 223 aa, Saccharomyces cerevisiae
MSSEDYGYDYDLLFKIVLIGDSGVGKSNLLSRFTKNEFNMDSKSTIGVEFATRTLEIDGKRIKAQIWDTAGQERYRAITSAYYRGAVGALIVYDISKSSSYENCNHWLSELRENADDNVAVGLIGNKSDLAHLRAVPTEESKTFAQENQLLFTETSALNSENVDKAFEELINTIYQKVSKHQMDLGDSSANGNANGASAPNGPTISLTPTPNENKKANGNNCC

SEQ ID NO: 14379 - protein, 245 aa, Idiomarina baltica OS145
MSEVANKVVIITGASSGLGEETAKMLASKGAKLVLGARREERLKALADSIKNDGGEAIFKTVDVTDKSQVQALADAALEQFGRIDVLVNNAGLMPLAPLDELKIDEWDQMIDVNIKGVMYGVAAVLPSMRKQKSGHIINLSSVAGHVVFPGATVYCATKFAVKAISEGIRQESNGEIRATNISPGAVSTELTDHISHKDSKEMADDLYQDAIGSDSIARAITFAIEQPGDVDVNEMIIRPTKQEL

SEQ ID NO: 14380 - protein, 316 aa, Oryza sativa (japonica cultivar-group)
MGNLLDMKVVAMVAALVVMSLAGVSMAARRVPALLKSHVGDGISYHGGAVLGGDIPVTLVWYGKFKPAQKAIVVDFLLSLTATPPNATTPSAAQWWGAIAAGYLSSNATNVTTAARVVLANQTSDEEYSLGKSLTLVEVFQLAAGVVPDRGDLVVVLTDRDVAVEGFCSARCGVHGSDAGAGYAYAWAGDAERQCPGQCAWPFAKPPYGPKGEAALVPPNGDVGADGVVATLAGVLAGAVTNPFGDGYYLGDKDAALEACSACAGAYGSDSYPGYAGKVLVDETTGGSYNAVGAHGRKYLLPAVYDPATSRCTTLV

SEQ ID NO: 14381 - protein, 128 aa, Azoarcus sp. BH72
MNLIQLLEQEEIARLTAGKTIPAFAPGDTVVVQVKVKEGNRERLQAYEGVVIAKRNRGLNSSFIVRKISSGEGVERTFQTYSPLVATIEVKRRGDVRRAKLYYLRQRSGKSARIKEKLDYKSAAGKKA

SEQ ID NO: 14382 - protein, 450 aa, Prosthecochloris aestuarii DSM 271
MQKNVDILVIGGSAAGIVAATTARAFYPDKAVMIVRKEQKAVVPCGIPYIYGTLKSIEQNIIPAGHITDAGVEMMIDEVVSIDSEKKTATTVSGTVISWDKLVIATGSVPKVPGWLKGTDLDNVFTIPKDCQYLDHVQHAMEGSRKVVIIGGGFIGVEIADELSKKGLDITLVELLPHVLQMAFDEEMSVRAEEILTTSGVKLKLGCKVEEIEGDGKVTGVRLDGGEVLEADLVILSTGYLPNTTLAADAGIKLNELGAIRVDEYMRTENKDIFAVGDCAEKFSFFTRIVKGLMLASTACSEARIAGMNLYKLSRLRTFGGTLSIFSTAIGGTTFAAAGVTEQMAIERGFDIVSASAEGIDKHPKTLPGVHAQRVKLIVNRESGLVLGGSVIGGVSAGELINVIGVIIESMMTIHQVLTLQLGTHPLLTGPPTGYPLLKAAENVAKKMRQ

SEQ ID NO: 14383 - protein, 536 aa, Prosthecochloris aestuarii DSM 271
MNHRDGRKTGTDFLFNHLMFTFMQSVLVLDFGSQYTQLIARRIREIGIYSEIIPYSTPLDTIKEHKPGAIILSGGPNSVYGEDALLPDKGIFSLGVPILGICYGLQVIATHFGGEVAVSSKQEFGRAKILVDRENDVAASRLFSDIPDSDVWMSHGDKVVRMPEGFSITASSGNSEMCAIEATGSKAALKVYGLQFHPEVQHSLYGKQLLSNFLIDIAGLKPDWSPKSFIEHQIEEIRKTAGNATVICGISGGVDSTVAAVLVSKAIGKKLHCVFVNNGLLRKNEGEKVMSILKPLGLNITMVDAEEIFLKRLKSVASPEKKRKIIGRTFIHIFEEQIHEEKFLVQGTLYPDVIESVSVKGPSETIKSHHNVGGLPKRMKLKLIEPLRELFKDEVRAVGRELGIDEDILMRHPFPGPGLAVRVLGSLTKERLDILRDADEIFLEELKKQNLYQQVWQAFSVLLPVQSVGVMGDKRTYENVLALRAVESSDGMTADWAHLPHEFLSHVSNRIINEVRGINRVAYDISSKPPATIEWE

SEQ ID NO: 14384 - protein, 477 aa, Bordetella parapertussis 12822
MTESTSSDAPVTDAPTRTFADFGLHPLLLKSIADTGYTNPTPIQAQAIPVVVEGRDVMGAAQTGTGKTAAFTLPILHRLMPLANTSASPARHPVRALILTPTRELADQVYESVKRYSLHTPLRSAVVFGGVDIGPQKEALRRGCEVLVATPGRLLDHVEQKNVNLSQVGILVLDEADRMLDMGFLPDLERIIRLLPAQRQGLLFSATFSNEIRKLGRSYLNHPVEIEVAARNATADTVTQIAYQMHGDTKRAAVVHLVKSRGLKQVIVFSNTKIGTARLARQLERDGVKAESIHGDKTQGDRMKALEAFKAGDLEVLVATDVAARGLDVAGVPCVINYDLPYNAEDYVHRIGRTGRAGASGEAIALFTADEERYLLDIEKLIKRQVPRGKLELPADLVARSHGRDRDAPRERGADRHRGERRTSGAAAPRQPVDELFYKPYEPANGQPASPETPKQEGRSNAPKRQLAVLLGGSRKG

SEQ ID NO: 14385 - protein, 166 aa, Oryza sativa (japonica cultivar-group)
MAAAAEEKNKKMIKVISSDGEAFEMTEAAASMSRILLHMIEDGCTGDGGAGITLPNVAGSALAKVIEYCTKHAIAAAEGSSSSRKAKEELKKFDVEFMEVGIDMLYDLIMAANFMGVEGLLSLAAQRTAELIKGKSPEQIREMFGIKNDHTPEEEEQIRKEYEWAF

SEQ ID NO: 14386 - protein, 443 aa, Pyrococcus furiosus DSM 3638
MEPLEIVRRYEKVIAPANRTTYYPLIPVKAENAKVWDITGKEYIDFLSDAAVQNVGHNNPRVVKAIKDQIEKLVHASYIYLFPIEPLLLAEKLVEIAPIENAKVSFGLSGADANDGAIKFARAYTKRNMILSYMKSFYGSTYGAMSLTGLDFQVRALVGELSGVHYIPYPNCYRCPFGKDRNSCKMECVEYIKEKFEGEVYSEGVAALFAEAIQGDSGMIVPPQDYFKKVKRILDEHGILLVVDEVQSGLGRTGKWFAIEHFDVKPDIITIAKPLGGGLPISATIGRAEIMDSLPPLSHAFTLSGNPTAAKAALAVIEEIEEKDLLKRAEKLGEYTKKKLEELKKKHELVGDVRGLGLMLGVELVKDRETKERAFEETKKVVWRAFELGLIVTFLQGNVLRIQPPLTIEKDVLDEGLEILDQAIEDVEEGKVPDEVIKNVRGW

SEQ ID NO: 14387 - protein, 710 aa, Arabidopsis thaliana
  misc_feature (579)..(579): Xaa can be any naturally occurring amino acid
MVVATTIALYASPPSSVCSTPHQISCDLDLTSRSSSTSSSMASSPQKPIVGGLSSLFSSASVKSSSSSSCSYSTGVDEFSSLRYDRSDDLKDLSFSSSFGYSPAKFVNSFRRDHQSPISVLHGPVSCSCSPPMRMSRDRNLDGSFRLGASGLFNGFVRKALGSCVDYEFGSDSVLVDELTFPMEVDTIKPYARDLLRRAQLRHKIFNDESVIKAFYEAEKAHRGQMRASRDPYLQHCVETAMLLANIGANSTVVVAGLLHDTIDDSFMSYDYILRNFGAGVADLVEGVSKLSQLSKLARENNTACKTVEADRLHTMFLAMADARAVLIKLADRLHNMKTLYALSPVKQQRFAKETLEIFAPLANRLGISTWKVQLENLCFKHLYPNQHNEMSTMLEDSFDEAMITSAIEKLEQALKKAGISYHVLCGRHKSLYSIYSKMLKKKLTVDEIHDIHGLRLIVDNEGDCYKALGVVHSLWSEVPGKLKDYITHPKFNGYQSLHTVVMDNGTVPLEVQIRTQEMHLQAEFGFAAHWRYKEGGCKYSSFVLQMVEWARWVVTWHCEAMSKDRSSISSSDSIKPPXQVFRLTLEDCPASYKPNSSQDGPVYVIVIENDKMSVQEFPASSTVSDLLSRAGPGSSRWSMYGIPAKEELRPRLNQIPVSDLKWKLKMGDVVELTPTIPDESLTEYREEIQRMYDRGLAFSRPGTMVGWGS

SEQ ID NO: 14388 - protein, 666 aa, Xanthomonas campestris pv. vesicatoria str. 85-10
MTQPTRRQLANAIRFLAADAVEAAKSGHPGMPMGMADIAEVLWNDFYRHNPNNPQWFNRDRFVLSNGHGSMLQYALLHLSGYDLPIEQLKQFRQLHSKTAGHPERSETPGVETTTGPLGQGFANAVGFALAEKLLAQRYNRPELEIVDHRTWVFMGDGCLMEGISHEAASLAGTWGLGKLVAFWDNNQISIDGNTAGWFSDDTPARFEAYGWHVIRDVDGHDADKIKAAIEAALENTDKPTLICCRTKIGFGAPTKAGKESSHGAPLGKDELEGARKALEWPYGPFEIPEEIYAGWRAGGTGTLRQAEWEQLFDKYAKQYASEADELTRRSHGELPADFIAKADAYIAKAQEEGQTIASRKASQLAIEAFAPLLPELIGGSADLAHSNLTLWKASKSVATDDPDANYVYYGVREFGMTAIANGLALHGGFIPFDATFLVFSDYARNGVRMSALNPAHAIHVYTHDSIGLGEDGPTHQPVEHLASLRYIPNNDVWRPGDAVESAVSWKAAITRKDGPSCLIFSRQNLQHQPRSAEQIKLIERGGYVLADAQGGTPDVILIATGSEVGLAVEAKQTLDAAGLKTRVVSMPSTDVFDRQDAAYRDSVLPNAVRKRVAVEAGVTGFWRKYVGLDGDVVGMDTFGASAPADQLYAYFKITAEHVVAAAKAL

SEQ ID NO: 14389 - protein, 628 aa, Coprinopsis cinerea okayama7#130
MTNEFHTLDGTCANLVPSGPGYGGVGLANQACPVVGAQPGQDRVDGSDYLALSFEYYHRNLWRNYGILVAFGIFFLLCLLVFSEFNTRVAGDRAVILFKRGTRPAVVEEAEAAVGPDEEKDQQPGEKGGVMAVADEATLASSSGSSGGKEADGGKEKDGESGKDGKNGKDGEKRAGVIDVEAVEAQDALKEQPKMTNVFSWDHLRYIVSVAGEKKVLLDDVSGYVAPGKLTALMGESGAGKTTLLNVLAERTDTGVITGDRFFNGQALPPDFQSQTGYCQQMDTHVGNTTVREALRFSARLRQPSDVPTAEKDEYVEKCLKMCGLEPFADAMVGTLGVEQKKRTTIGVELAAKPKLLLFLDEPTSGLDSQSAWAIVSFLRTLADNGQAILCTIHQPSAELFEVFDRLLLLKKGGQVVFFGDIGTHASSLINYFESNGGRKCSPEENPAEYMLDIIGAGATAVTDRDWNDVWVQSEECARAKEELKQIHEDGRKSPPVAATLKSTFATPWIYQASFVLQRSLRTYWRDPTYLMSKLTLNIIGGLFIGFTFFKSKDTVQDTQNKLFAIFMATILAASYMYHISRCVTSTKSANGPAGCTTGPPSLPPKSSSNCPGTSSAPASSSAAGTGR

SEQ ID NO: 14390 - protein, 443 aa, Candidatus Kuenenia stuttgartiensis
MKTQLELARDGVITEAMKEAAVYDDVTPEFIREGIAKGQIVIYGNPNRKARVIGIGKGLKTKVNASIGTSPDIIDAEMEVKKAQTAEKYGADTLMELSTGGDLVKIRKRVLDSISLTVGTVPLYQAAIETNKKKGSVVHMEADFLFDVIEQQAEEGIGFMAIHCGINLITLERLRRQGYRYGGLVSRGGSFLTAWMNHNKKENPLYEQIDRLIDIMKKHDVILSLGNGLRAGAVHDSTDRAQIQELIINSEIAEYAQSKGVQIIVEGPGHIPIDEIEANVLIQKRLSNNAPFYMLGPITTDIAPGYDHISSAIGAALSSRYGADFICYVTPPEHLALPGPDDVREGVMAARIAAHVGDMVKLKDKAKNLDLKMGIARRDLDWKTQYETAITKERAQEIRNSRPPMDEDTCTMCGSLCSLKGVMKYYEEDLNKSRKKSAATAAF

SEQ ID NO: 14391 - protein, 454 aa, Candidatus Kuenenia stuttgartiensis
MFEEIRKEQLQTWDKTYLWHPFTQMQEYVKETPLVIAEGKGIYLKDIDGNEYIDGVSSMWCNLHGHRKKEIDDAIKAQLDKIAHSTFLGPTNIPASELGKKLIEIVPNGLSKVFYSDNGSTANEVALKMAFQYWQHKGRRDKTQFIALQYGYHGDTIGTMAVGGIDIYHKVFSPLYFKTHFAPSPYCYRCPLNKIPEDCSMECLGTLEKILQEHADNVAAMIMEPLVQGVGGMLMHPKGYLAGVSKLCKQYDVLLILDEVMTGFGRTGKMFACEHECVVPDLMPLSKGINGGYMPLAATLATQEIYDAFLGEYTHLKTFFHGHTYTGHPLGCAASLASIHLFEKENILENLQPKIKHLKEKLSSFKVLKHVGEIRQCGLIAAIELVKDTKTKEPYSWVERIGIQICLEAKKQGVLIRPLGHIIVIMPPLIITTAELDRLLGVIYESIRTVTEKV

SEQ ID NO: 14392 - protein, 471 aa, Frankia sp. EAN1pec
MIEKRTIFIDGEWVSSAGTGTLTVINPATEEPLATLPRGHVDDVDRAAQAAARAFESWSRSTVDDRIDMLTRIADILDTRAEELARTIVSEVGTPITLARGSQSATAINDLRIAAASLKDIVWEERFDDTIVRRIPAGVAGAITPWNGPMRMIALKAGAAIAAGCTMVLKGTEVAPLSAFLFAEAAAEAGLPRGVFNLVSGTGPEIGEALATHPLVDIVSLTGSVRAGSRVMELASRSVKRVALELGGKSANIILADADLEKAVVDGLGDAFRNSGQVCGGLSRMLVPRGRLAEAEEIAAAKATSYVIGDPLDEATTLGPVVSDAQRDRVRRYIQTGVDEGLRLVAGGPEAPEHLDRGYYVQPTVFTGDNSSRLAQEEIFGPVVIIIPFDDTDEAVAIANDSDYGLAGAVWAADPARARDVGRRIRTGRVRINGAPIDMRAPHGGLKRSGIGREMGRYGIEEYLEYQSLIS

SEQ ID NO: 14393 - protein, 558 aa, Oryza sativa (japonica cultivar-group)
MDKLGANPANSCALTPLGFLERAATVFGDCPSVVYHDTVFTWSQTHRRCLRLASALVSSLGISRGDVVSVLLPNVPAMYEMHFAVPMSGAVLNSINTRLDARTVSVLLRHSGSKLIFVDPALLPVLRDALRLLPAGHTAPRVVLVEDPHEKEFPPAPAAALTYERLVEKGDPEFAWVRPASEWDPMILNYTSGTTSAPKGVVHCHRGIFLITVDSLVDWAVPPRPTYLWTLPMFHANGWSFPWGMAVVGGTNVCLRRVDAAEVFDTIARRGVNHLCGAPVVLNMLANAPEGVRKPLPGKVRILTAGAPPPAAVLYRTEAIGFEVSHGYGLTETAGLVLSCAWKGEWDKLPASERARLKARQGVRTPGMAEVDVVDGETGRSVPRDGSTMGEIVLRGGCITLGYLNDEAATKAAIRDNGWFYTGDVGVMHPDGYVEIRDRSKDVIISGGENISSVEVESVLYGHPAVNEAAVVARPDEFWGETPCAFVSLKQGGGAVTAADVVAWSRERMPRYMVPKTVIFRDELPKTSTGKIQKYVLRNIAKEMGPTTGTNTKRNSKM

SEQ ID NO: 14394 - protein, 476 aa, Pseudomonas syringae pv. phaseolicola 1448A
MYPDVQLYIDGQWRASRDGRSIPVIDPATGQSLGSVAHAGITDLDEALAAAERGFATWRATSAYDRYKLMQKAANLIRERADNIARILTQEQGKPLAEARMETLSAADVIDWLAEEGRRSYGRIVPSRGVAIEQKVVKEPVGPVAAFTPWNFPINQVVRKLSSALAAGCSIIVKAPEETPASPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLDAFTERFVGLTREIKVGNGLEAGTTMGPVANERRIPALVDLIEDAVRGGATLSAGGKAVEGAGYFFEPTVLSGLTPQMRIMNEEPFGPVALLVPFDTVEEAIAESNRVPFGLASYAFTTSMKTAQALSTYIEAGMLSINHQGIGLPEVPFGGIKDSGYGSEGGTEAIEAYLNTKLVTQYN

SEQ ID NO: 14395 - protein, 719 aa, Zea mays
VFIAISIILGDGLYNLVKIFIVIARELCSMQSKQHELPVQALEDDGSCEQLADEKLQTEIFLKDSISPWFAASGYIVLAAISTASVPAIFPQLKWYLVLLCYFFAPVVAFCNSYGMGLTNLNLAPTYGKIALFALASLVGSDGGGVIAGLAACGIVMSVACSTADLMQDLKSGYLTLSSPRSMFTAQLIGIALGCVIAPLTLWLFWTAFDIGDPDGEYKAPFAIMFREMAILGMEGFSALPLHCLDICYAAFFLALATSLLKDVAPANVSRFIPIPIAMAAPFYVGAYFGVDMFIGTAILYAWQKLNREQADGYAVAVASGLICGDGIWSIPSALLSILGAVPPICMSFEASSAPSTGASGSSRRSAAAMEMLSMLKVGYTILRSETPATDLVNTFMDWAARRSLMLLAIFLPPYYIYKLTTSAFAAAVPEDVAGKVVLITGAASGIGQQIAYQYAKKVARLALVARMVGSLHDVAARARDGGSPDVLVVAGDVAKPEDCRRFVQATVEHFGRLDHLVNNAGVANVCWFEDVPDVAALKRVLAVNFWGAVHATHCALPHLKKSGGGKVFVNSSAAAALAMPGMSLYNASEAAVLNFFETLRVELRDEVGITIATSGWIVSEMTGGKQLSKEGTVEVAVRCAEATVDAICRGRRHLTVPLWYRALFLWRALAPEVVEFSQRLLCRRTAGGRGHQAKGKRLQEVTGAVQPAPLHSSDIKRE

SEQ ID NO: 14396 - protein, 303 aa, Mesorhizobium loti MAFF303099
MRVHVVGNVCVDTTFQLGRFPRPGETLNASSHVDGLGGKGANQAVAAARTGADVCFRAAIGDDTAGLWIRERLSRDLDASHLTVLALPSDRSTIIVDVRGENLIVTGASCAAAFDPLADGGFATSIEHGDIVVMQGNLLPDVTTSCLQAARSAGAMTILNPSPLAVGSTPCMDAVSLAVVNAGEAEQLTGTGDAASAARELIRQGTEGTIVTLGAAGCLVADREGRIDRFAAPKVDVVDTSGAGDVFCGCLAGFLAAGISLAAAARIAVRAAAISVGRPGTLGSCPDRQEMKILMETTEAETA

SEQ ID NO: 14397 - protein, 427 aa, Pyrococcus furiosus DSM 3638
MGPDIKVKIDEKVEPKRAILFGLQHVLAMFGATVTVPLVVGTTVGLSTREIATMIQAVLLAMGIATILQTTIGSRYPIVQGSSFAFIPGLISIGKSLGMAATQGALIVGGIIEALVGGLGIVGKIKKLFTPVVTGVTIMLIGFSLAHVSVKYFFNYFADPSGASIPRATIVALITFGTTVYVALKSRGTLRAMPVIVGAFVGYLVSIPLGLADFQLVKELPVVSVPKIFPWGTPVFDVGAIITLLFAFMVSIIESVGDYHAISAIAEAPITNKHINRGIMSEGIACSIAGVLGACGTTSYSENIGLVALTKVASRYVVQVGGIILIVISLFPKFAGLLAAMPAPVLGGLTLALYGMISVTGLRLIKEKVELNDRNTIIIATALIAGLGAPQLPPEFLEHFPQIIASILESGMAVGAITAIVLEQVLR

SEQ ID NO: 14398 - protein, 204 aa, Wolbachia endosymbiont of Drosophila ananassae
MPDLKTMMLNFGPQHPAAHGVLRLVLEMDGEVIERADPHIGLLHRGTEKLIEHKTYLQALPYFDRLDYVSPMSQEHAYSLCVEKLLQCEVPIRAKYLRVLFCELTRILNHLLNVSSQALDVGAMTPLLWLFEEREKILEFYERASGARFHAAYIRPGGIAADVPEDLIEDIAKFIEQFPKYIDDWSEMRLLLSGLYMNFVVFID

SEQ ID NO: 14399 - protein, 392 aa, Bradyrhizobium sp. BTAi1
MTSPKFDLIVYGATGFTGKLVAEYLTTQYRGDASLCWAMAGRSLDKLAAVRDEIGAPADTPLIAADASDPASLAAMVAQTKLVLTTVGPYQFYGNELVAACVDTGTDYVDLCGEPVWMRQMIDKHQAAAEKSGARIMFSCGFDSVPFELGVYFVQQQAKKVLGATAARVKGRVRGMSGTLSGGTAASAKATFDAVAKDLSLVSILKDAFALTLGFKGPKQPAGNKPLYEEDLQSWTAPFMMALINTRNVHRSNMLMGFPYGQDFVYDEMVLTGPGEKGEANAKKVMAANAEKTGPNAPKPGEGPSKEEREKGYYNLLFVAIAADGRQVRATVKGDRDPGYGSTSKMISECAIGLLRDGANVKGGFWTPGAALGDSLIKRLVDHAGLTFTVED

SEQ ID NO: 14400 - protein, 128 aa, Sulfolobus tokodaii
GSHMETVFTEKAPKPVGPYSQAIKVGNTLYVSGQIPIDPRTNEIVKGDIKVQTRQVLDNIKEIVKAAGFSLSDVAMAFVFLKDMNMFNDFNSVYAEYFKDKPPARVTVEVSRLPKDALIEIAVICSKG

SEQ ID NO: 14401 - protein, 121 aa, Corynebacterium efficiens YS-314
MNLMEKPQIEAQTGPVPEDLVIKDLIVGDGAEAQPGGVVEVHYVGVDFETGEEFDSSWDRGQTNQFPLTGLIAGWQEGIPGMKVGGRRQLTIPPEAAYGPEGSGHPLSGRTLVFIIDLISA

SEQ ID NO: 14402 - protein, 227 aa, Haemophilus influenzae R2866
MELVFIRHGFSEWNAKNLFTGWRDVNLTERGVEEAKAAGKKLLDKGYEFDIAFTSVLTRAIKTCNIVLEESHQLWIPQVKNWRLNERHYGALQGLDKKATAEQYGDEQVHIWRRSYDISPPDLDPQDPNSAHNDRRYANIPSDVVPNAENLKLTLERALPFWEDQIAPAMLSGKRVLVVAHGNSLRALAKHIIGISDSEIMDFEIPTGQPLVLKLDDKLNYVEHYYL

SEQ ID NO: 14403 - protein, 559 aa, Arabidopsis thaliana
MDLGRKPLARFPSGDWVISEQPVTHQDLELAVSKVGDFSDDNRSGIDRSLHRISAIRNRKLQVIGLTCRVGRVVSGSAEIIRDLIEGGGSILVIGSPGVGKTTLIREIARMLADEHRKRVVIVDTSNEIGGDGDVPHSGIGRARRMQVPNVNLQHDVMIEAVENHMPETIIIDEIGTELEALAASTIAQRGVQLVATAHGMTIDNIIKNPSLQILIGGIESVTLGDEEARKRKVQKTILERKGPPTFTCAVEMISRTECRVHQRLDVTVDAILAGKSAPFEIRQIRGEDDVPHKLVTPIPLENLEEEPAPLLNRDFVSELLSDDEDEDFLLIRSNKARSNTYTSPRSSPVHVYTYNVLEADLLQVAEVMGLDDEIEVTDDVGEADVILASSSELKQNSSIRRVAKLHKLPIFVIKSTTMAQMVKAVRMILGRESFGSAPKAIEKSSVDDIEIKDDAPESKPSLEELDALEEVRLAIEYIVIPGGEPVELLPRRSDIIVRQLELVESYQLAVENLGTHLNPRLQILPRRSTKKTLTSSSPQKSADGSMGTTGTRLPFLKD

SEQ ID NO: 14404 - protein, 244 aa, Frankia sp. EAN1pec
MTGSRTLLLLRHGESAWNAADRFAGWVDVPLSARGRVQAGRCGDLLRDTGLLPDVVHTSLLRRAVSTADLALDAADRHWIPVRRSWRLNERHYGALQGRNRMQVRAEYGADLLRFWRRSFHGTPPPIDPGSVFGQDDDARYRELGVHVPRTESIADVLDRLRPYYESEIANDLDAGRTVLVVAHGNVLRALIRHLGAQAGDPADDDLSEVRLPTGALLRYDLTDVGLPVRPGGVLLSASGATQK

SEQ ID NO: 14405 - protein, 470 aa, Frankia sp. EAN1pec
MINQDLILIDGEWVPSSGTGVINVENPVTEEIIGTIPDGTPEDVDRAAAAAARAFDGWSRSTLDERAEVLRSLADFVEGRAEEITEAIVQEIGEPLSIATAHQTLSTVKHLRGTADALAEVDWNVAVGDTLVHRAPVGVVGAITPWNVPLLMIAMKVGAAVAAGCTVVLKGTEIAPRSSFFFAEGTLKAGLPAGVVNLVSGTGPVVGEAIAGHRLVDMVSITGSVRAGSRVMEIASRTVKRVGLELGGKSANVILEDADVARAVTAGIADAFRNSGQVCGGLTRVLVPRARLAEAENAARAAAESYVLGDPFAEGTSLGPVVTRAQRDRVRELIQSGIDQGATLVTGGPEQPEGLATGYYVKPTIFSGTPDMRIAREEIFGPVVTILPYDTEEEAVAIANDSDYGLAGGVWAASPARAREVALRLRTGRIRINGSPVNPRAPHGGFKLSGIGRENGRFGIEEFLEYQSIG

SEQ ID NO: 14406 - protein, 510 aa, Oryza sativa (japonica cultivar-group)
MTNQDVVMPDIAAAAAMPGSSGRAPLFACRGAAAVSASSMLGGGGAAYQAAVVAHVAPVPAIRPCASWVVEAMRASSPTRPAAAAVDAEYDAWTRKHPSALGSFEQVAAAASGKRVVVFLDYDGTLSPIVADPDMAFMSDEMRAAVRDVAEHFPAAIVTGRCVDKVQSFVGLPELYYAGSHGMDIKGPSSNEEEDTKILLQPAREFLPVINKAYKALMEKTKSTPGARVENNKFCLSVHFRCVDEKRWNPLAEQVKAVLRDYPELKLTQGRKVLEIRPSIMWDKGKAVEFLLKSLGFDDDRRDVLPVYIGDDRTDEDAFKVLRKRGQGLGILVSKCAKETDASYSLQDPAEKYTNAGAHVFVTMLLTVVFTAAVALALVNAVNSHDFAAHLAGVDCRMGLAGPVRCPASGFVELLVLALHVASTGEQRSTGETAVGAAAAGMYRMVPLHAAKWGDKWRMSGERMAAGVDCRRREDLPSSGDGYRQEEIDGGGRICRSEWKRRPVAECLAR

SEQ ID NO: 14407 - protein, 250 aa, Pisum sativum
MPIRNIAIGTPQEATHPDTLKAGLAEFISTFIFVFAGSGSGIAYNKLTDNGAATPAGLISASIAHAFALFVAVSVGANISGGHVNPAVTFGAFVGGNITLLRGIVYIIAQLLGSIVASALLVFVTASSVPAFALSAGVGVGPALVLEIVMTFGLVYTVYATAVDPKKGNIGIIAPIAIGFIVGANILVGGAFTGASMNPAVSFGPAVVSWSWANHWIYWAGPLIGGGLAGLIYEVLFINSTHEQLPTTDY

SEQ ID NO: 14408 - protein, 378 aa, Zea mays
  misc_feature (126)..(126): Xaa can be any naturally occurring amino acid
  misc_feature (360)..(360): Xaa can be any naturally occurring amino acid
KSEMQKSDHHEQKLTSPRGLIHKILRRTNSRRSPTAADQQPSPVSPETSNSSIFSKQKDVDDAIKDSEKLSTHTIRIEDEKSDLLGSEIYSGKLTLDNKTKSSSNEQSGSGSSSNCFDARLSTEAXLIWGSNILKLEDIVSVSYNSGLRYFTVHACPLEKISSGLSCFMKPRRTQTDLKFVSSSPHEAFRWVNSFADQQCYVNLLPHPMASSKKHSSELIQFDAMFDPYVKCRSPPKILVILNPRSGHGRSSKVFHGKVEPIFKLAGFKMEVVKTTHAGHAKSLVSTIDFSTCPDGIVCVGGDGIVNEVLNGLLCRDDQNMSASVPIGIIPAGSDNSLIWTVLGVKDPISAALSIVRGGXTPIDVFSCEWIQSGTMHY

SEQ ID NO: 14409 - protein, 133 aa, Phaeodactylum tricornutum
MKLAVIATLLATASAFSIQAEFSKVAKGAAAVGVGAVIAAAPALAGDVGAGEQIFNANCAACHAGGQNVIMPEKTLEKEALDQYLAGGRTEKSIISQVTGGKNAMPAFGGRLSDEEIANVAAYVLASAEAGWE

SEQ ID NO: 14410 - protein, 142 aa, Chlorella vulgaris
MQRTAVLCSTPNAARAVAQVRTPAPAKLLALKRAATGLGAAAVVLSTAAAPVLAADLVLGAEVFNNNCAACHAGGQNSVINERTLQKGALEQYLAGGFNVEAITTQVTNGKGAMPAWGDRLDEDEIAAVAAYVFDQASGNKW

SEQ ID NO: 14411 - protein, 522 aa, Frankia sp. EAN1pec
MATDTPRATSADSPLPARTRPLLLAAVAVCAACGLVYELVLLTLSTSLAGGGITQTSLIVAGFVAALGAGALLVKPFLGHAAAAFVAVETLLGILGGLSAVTLYVTFSFYATSGPVLVLGTALLGTLVGAELPLLVTLLQTGRTDVDARASGRLLADLNAADYAGALVGGLVWPFVLLPTAGMIRGAALTGLVNLTAATVVATLLLRRWLTRRALVTALGALLAAATLLGTLLLRARDIETDARQRLYADPIVVATRSAYQEIVVTRRVGDMRLYLDGDLQFSSADEHRYTEALVAPALARDPARVLVLGGGDGLAARELLRHPTVRQVVQVELDPRMIELARTTFARLNRAALNDPRVRVVVADAFRWLRDPPPEPFDAVVVDMPDPDTPTLGRLYSQEFYGLVRAVLAPGGLLTVQAGSPYATPSAYWRTVSTVRAAGLATTPYHVDVPSFGDWGFVLATTGGTPPPLVLSERATPARFLDQAVLTAAGVFPLDRPPRTLEPSTLDRPRIVDDLRTGYQR

SEQ ID NO: 14412 - protein, 132 aa, Chaetoceros gracilis
MKLALIATLATSAAAFSISPQKAAQAGAVAAAIATSVAAPAFAGDVAAGEQVFNANCAACHAGGQNVIMPEKTLEKDALEQYLAGGRNEKAVITQVTNGKNAMPAFGGRLSDDDIANVASYVIATSESGWDE

SEQ ID NO: 14413 - protein, 126 aa, Xanthomonas campestris pv. vesicatoria str. 85-10
MSQIIHTDQAPAAIGPYSQAVRAGNTVYFSGQIPLDPATGEIVPGDIGAQARRAFDNLKAVAEAAGGSLDKIVRLGLYLTDLGQFAAVNAVMQEYFQAPFPARSTIEVSGLPKGAGFEVDAVMVIE

SEQ ID NO: 14414 - protein, 128 aa, Schizophyllum commune
MPKEAVLTLNAPPPLPGIYSQAIKAGGMVYCSGAVPMDAKTGKLIDGDVKAHTHQCIKNLSAILEEAGTSLNNVVKVNVFLSNMDDFAAVNEVYKEYWGDVKPCRTCVAVKTLPLNTDVEIECIATQN

SEQ ID NO: 14415 - protein, 463 aa, Yersinia pseudotuberculosis IP 32953
MELPVKNKLKRGLTTRHIRFIALGSAIGTGLFYGSADAIRMAGPSVLLAYLIGGVVAFVIMRALGEMSVNNPQASSFSRYAQDYLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMILSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 14416 - protein, 591 aa, Prosthecochloris aestuarii DSM 271
MEPILPQSDTGTKKNKAVFHGIGASKGIAIAPAFLFIKNIIEHSSAPLSAEKAEIEVDKFLAALQRSEKELRKIEKVTTKKLGKVYSDLFQAQIMLLNDSVLIECVTKRIRQELKSAPLVIEEEFEKYLEHFNNSTEQMFQERAQDLIDIKNRIIRNLHNQKLQSKIPEGMIVVSTCLSPADIILFTRANVKAFITETGGITSHISLICRSLNIPIIVGLSNFTQKVKTNDLLIVDGSSGEALINPDSETIRQYQNRSEEKSRLEAQTCRLADAPAQTKCGQPLHFCSNIDFKEEIPSIRSVGARGVGLFRSENLFIDNTKPPQEEDQTAYYKEMAEELFPDPLVIRLFDIGGDKLIYSTIREPNPNLGWRGIRILIDVPEILDSQLLAILKANDKGNIQILLPMISSIEEIMQIQSSLKRHVDNLNTIGLSCCEPDIGAMIEIPAAVLIIDEITRMVDFISIGTNDLTQYTLAVDRNNEIVQDLFDKFHPAIIRQLHTIITTANKNGCRVSLCGDMGSDPLALPFLVGCGLRVFSVVSADIPLLKTLGRHLDVKESEALARECLSFDSSEKIKAHLKEFQMRHVPQNVLM

SEQ ID NO: 14417 - protein, 475 aa, Streptomyces coelicolor A3(2)
MTSAQVDTDKAPEEGYERGLNSRQVQMIAIGGAIGVGLFLGAGANIAKAGPSIILMYALAGVIIFFIMRALGELLLYRPVSGSFAEYSREFLGPFFGYFTGWTYWLMWVVTGMAELTAAAIYIHYWFPDIPQWVSALVFLVLLFVANLISVKLFGEIEFWFSMVKVTAIIGMIVIGVGVLTLGFSQAGDTAAVSNLWEFDGFFPKGIGSSLMTLQGVMFAYLAVELVGVTAGESENPEKTLPKAINTLPWRIALFYVGALTVILAVVKWTEFAEGVSPFVEAFAVIGIPAGAGIVNFVVLTAALSSCNSGMYSTGRMLRTLADNGEAPRIFNKLSSTKTPAIGIAVSVVFMAIGVVLNYLVPEKAFGYVTSVATAAGIWTWLMILISHVRYRRKVVAGRLPASSFPAPGGSVCSYIAIAFLLFVTCLIAYDADARVCLYVMAGWAAALGIGWAVLKSRNPQITERPGEPEFEKIG

SEQ ID NO: 14418 - protein, 188 aa, Halobacterium sp. NRC-1
MDRLKQSLLDAPIIEKDGYHYFVHPISDGVPMLEPELLREIVIRIIRKAELDEVDKIVTPAAMGIHISTAVSLMTDIPIVVIRKREYGLPGEVALSQETGYSENEMYINDVHEGDRVLVLDDVLSTGGTLRAITDALEQTGADVADVLAVIKKAGPNELDDTDMDVRTLINVDVADGEVVVVDDQGDH

SEQ ID NO: 14419 - protein, 387 aa, Triticum aestivum
  misc_feature (81)..(81): Xaa can be any naturally occurring amino acid
  misc_feature (215)..(215): Xaa can be any naturally occurring amino acid
  misc_feature (328)..(328): Xaa can be any naturally occurring amino acid
MAAAASSPSPPAVITCRAAVAWGPGQALVMEDVEVAPPGPLEIRVKVVSTSICRSDVTQWQSTAQPDLFPRIFGHEASGPXVVESVGEGVTEFQVGDHALTVFIGECMSCKHCVSGKSNMCQTLGLERKGVMHSDQTTRFSIGGKPVYHYCAVSSFSEYAVVHSGCAVKVSPTMPMDRICLLSCGASAGLGAAWNVADVSKGSSVVIFGLGTVGXLSVAQGAKLRGASKIIGVDTNPAKQEKGKAFGVTDFINPAELNEPVQQVVKRLTDGGADYSFECVGDTGVVSTALQSCSDGWGLTVTLGVPKAKPEVSAHYGLLLSGRTLKGXLFGGWRPKTDIPLLVEKYANKEIQVDGLVTHDMPFSDINKALELMLQNRCLRCVIHMPK

SEQ ID NO: 14420 - protein, 747 aa, Burkholderia xenovorans LB400
MNTEIVTSTPKPLPSFEEAMAFVREHAGEVRLSSGEMLADHAAGTASIMRTLNVDPPAVLAAALFALTPHLQDPERVIADNFGEEVAQLVGDVRKLLRLGTVSLRAAQNAMPEAGRDAQAARRAQVEALRKMLLAFAQDIRVVLIRLASRLQSLRYYAAAKITPSPDVARETLDIYAPLANRLGIWQLKWELEDLALRFEEPVTYKRIAKLLDEKRVERESYVAQAIERLQKELAAAHIRAEVSGRPKHIYSIWRKMRGKELDFAELYDVRAFRVIVPDIKDCYTVLGIVHNLWQPVPKEFDDYISRPKPNGYKSLHTVVIGDDGRAFEVQIRTQEMHQFAEYGVAAHWRYKEAGTRGYAGQFAANGKYDEKIAWLRQLLAWKDEVSEGEHGEKRAAQPWEQLRQATLDDDHIYVLTPQARVIPLPHGATPVDFAYHLHSELGHRCRGARVDGAMVPLNTPLQNGQTVEIVAVKEGGPSRDWLNPQLGYLQSPRARQKVRAWFNAVEVQEHIASGRAMVEKTLQREGKTSVNLDQLAAKLGFKTTDDLFSVVGKEEFSLRLVEQALHDAPPPEPVVDAPEQFEKRSSGASVARGASTGVLVVGVDALLTQLARCCRPAPPDDICGFVTRGKGMSIHRSDCATFLRMAERAPERVLQTAWSAEVMSGRGQSVYPVDLSIEATDRQGLLRDISEVFAREKMNVIGVKTQTRRNAAFMQFTVEVSNAAQIQRACTLLGEVTGVMRASRKS

SEQ ID NO: 14421 - protein, 523 aa, Xanthomonas oryzae pv. oryzae KACC10331
MTSPCSAWPPVTTIFAMGILRNPKREGVAGNDVRAFRPQCKRRGAEAHRSNDAEWGCKAPAAVIRCSWTASGGRHDAGAYRPALAQLVWQQAQPTRSAFFRRQGLQLQRVNRPAHQLAQGRIDHAVPRQRCLADECRADHGGLEVHAVITVHVDAGFGHAGFDEFTDGFGVHRAFPHKMSAHSTLHPSSRMAVSHLPPATVSDASLVASGQRVLEIEREALANVGARIGSEFAAACRLVLASRGRVVATGMGKSGHVARKIAATLASTGTPAFFVHPGEAGHGDLGMITEADIVLALSYSGESDEVRMLLPVLKRQGNPIIAMTGRTSSTLAQAADVHLDVSVSAEACPLHLAPTSSTTASLAMGDALAVALLDARGFTADDFARSHPAGSLGRRLLLHITDVMHAGDDLPRVREDASLSEALMEMSRKRLGMTAVVDNDERLIGLFTDGDLRRALDSDIDVRSAGIAQVMTRNPRTIGADQLAAEAARLMEDYKINGLIVVDAQQRAVGALNIHDLLRAKVV

SEQ ID NO: 14422 - protein, 129 aa, Saccharomyces cerevisiae
MVTTLTPVICESAPAAAASYSHAMKVNNLIFLSGQIPVTPDNKLVEGSIADKAEQVIQNIKNVLEASNSSLDRVVKVNIFLADINHFAEFNSVYAKYFNTHKPARSCVAVAALPLGVDMEMEAIAAERD

SEQ ID NO: 14423 - protein, 229 aa, Pyrococcus furiosus DSM 3638
MNVEEMKKAVARAALEFIEDDMVVGLGTGSTTAYFIRYLGEMIEKGKVEDIYGVPPPIKQKFLRMESGVPVLSLDQVDAIDIAVDGADEVDPNLNLIKGRGAALTMEKIIEYRAGTFIVLVDESKLVDYLCQKMPVPIEVIPAAWKAILEELSIFNAKAELRMGVKKDGPVVTENGNFIIDAKFPRIDDPLDMEIELNTIPGVVENGIFADIADIVLVGTKEGVKRLER

SEQ ID NO: 14424 - protein, 473 aa, Xylella fastidiosa 9a5c
MGDDGDLLMQRAGRAAWDLLRQRWPDARQVLVACGTGNNGGDGYVLACLAHRAGWQVQVVHLPGRGPASLLAQRAYDAYLAAGGQVMLFSGGLETADVLVDALFGIGLNRPLDVPTQGLINALNAAGRPVLALDVPSGVDAERGAVFGTPVYAHVTLQFIVPHVGLYTGPALEAVGERVLAALDVPPALRDALAPCAERWGSQRLASRFRPRRRNSHKGEFGRVLCVGGNWGSGGAIMLSAEAALRSGAGVVHVATREAHVAPLLARCPETMPRGVAGSAELMPLLAAADVVALGPGLGQDPWGQALLAATLDSGCALVIDADALNVLAAAPRPLPPGAILTPHPGEAGRLLGCTTAQVQADRRAAAQALAARFAAVVVLKGAGSLIAAPGCLPCVIDAGNPGMAVAGMGDVLTGVIAALRAQGDSVFDAALFGALLHAAAGDLVARDGGERGLLPSDVLPVLRRLINPDPAL

SEQ ID NO: 14425 - protein, 139 aa, Chlorella vulgaris
MAALTICSAAAGKAQAVRSSAQKPKAVAALPRLATAVGAAAVLLTSTPAFAGDLTLGQQVFDNNCAACHMGGQNSVQPEKTLQKAALEQYLEGGFSVASIITQVENGKGAMPAWSGRLDSDEIESVAEYVFKQAEGNLW

SEQ ID NO: 14426 - protein, 849 aa, Coccidioides immitis RS
MAEEPRRSGRATKGQHKNLDMPEPPPKRKGKSQTKAPKQTSAEPTPPENEEDEIIRCICGEYEEEEDVERDMICCDKCSAWQHNDCMGLDFAKGEEPAEYYCEQCKPENHKVLLERMARGEKPWEEAAQKRAQAAEERKARRRKGGKRGRKSRVSDVKPETSDTTPRASAAPTQEPIQAVNEIQNGPPTNTGIQEQTTSSQKRKYSDHADTGQHEPEPKPKLQRLSVSGLPTVHPQEIKKSPAQSRKASMAGSPTTHGAKTSKSPTETTAGGATTLTQARKNVANALIKLFVEQAGVAQEQGKFSIPEGRTKESVGEYLGFAIEQAMYQNLCGGSGEPNDPYRQQMRTILFNVRKNPSLRDSLLVGRITPDAFSKMSTQDMASEELRQRDDEIKREAERQHIIIQETGPRIRRTHKGEEFVESDPQFVGTESVFSTAPARRDTLGEAMSPRAASPATGRTGSMDAVQQNQKPQPIDTQVIPTGRPGRSASDDFNIQNVWSSVQSPGAVPHHDPPQFGPTVFPQEHPPPSTHKVQADAEIDQLLKDEEPESPPYSPKDFPGPDIIWRGKVLMDGVASFSAGARFVGGADLSVRIPWSQLVPPSLTIDGRIDIQLATNYVCGLRYSHTVDITVVAIPPPDAPDDVVSFNNLFDYFVRRKRYGVMGKHPLPAVKDTYLVPVEAGSGRKPEFMEILENNAIENPTPERLLLVVFVLKTSNNHSNAVTPQHPPASVASPLTATPTARYSQHSLSYQDTDRPSGSPSQSQGHYSPPPPYSQPQSPLVLNGKAAAVYVLGEQLASSPTIEEVLRHAPNADVAQFNVIAEILSRHPSAANSYEQLMNALMERTNGGT

SEQ ID NO: 14427 - protein, 577 aa, Lithospermum erythrorhizon
MESSNLKDVTGGVEDAYGEHRAIEEQLVTPWTVSVASGYSLLRDPHHNKGLAFTERERDSHYLRGLLPPAVVTQELQEKKLMENIREYQLPIHKYMAMMGLEERNERLFYKLLIDNVEELLPVVYTPTVGEACQKYGSIFRRPQGLYISLKEKGKILEVLKNWPERAIQVIVVTDGERILGLGDLGCQGMGIPVGKLALYTALGGVRPSACLPITIDVGTNNQQLLDDEFYIGLKQRRATGEEYYELLEEFMSAVKHCYGEKVLVQFEDFANHNAFELLSKYRNTHLVFNDDIQGTASVVLSGLIASLKPLGGTLGDHTFLFLGAGEAGTGIAELIALEISKQTKAPVEETRKKIWLVDSKGLVVSSRKEKLQHFKQPWAHEKEPIGNLLDAVKDIKPTVLIGTSGVGRQFTKEVVEAMASFNEKPLIMALSNPTSQAECTAEEAYTWSEGRAIFSSGSPFDPVEYNGKVFVPGQANNCYIFPGLGFGLLISGAIRVHDDMLLAASEALANQVTDEHYAKGLIYPPFSDIRKISANIAAKVAAKAYELGVATRLPRPENLVEYAERCMYSPIYRTYR

SEQ ID NO: 14428 - protein, 329 aa, Glycine max
GVTVLYLGQPEPHLLNICSKTKSLWKIFCLGPLLRALQKRKKCHHWTSQVICVDGGLTVNGFEPSIINRGARWSLNGTTALVTGGTRGIGHAIVSDLAAFGAAVHTCSRTQTELNKCLQEWQSLGFQVTGSVCDVSSPSQREKLIEEVTSILNGKLNIYVNNVGTNFRKPTIEYTAEEYSQLMTVNLDSSFHLCQLAYPLLKASENGSIVFISSVAGVVSLGTGAVYAASKAAINQLTKNLACEWAKDNIRSNCVVPWATRTPLVEHVRDQKFVDDIMSRTPIKRIAEPEEVSSLVTFLCLPAASYITGQVICVDGGLTVNGFQPSMRI

SEQ ID NO: 14429 - protein, 451 aa, Lactobacillus plantarum WCFS1
MKVIVVGSSHGGYETVRGILAAQPDTEIQWYEKGDFLSFLSCGMQLYLEGAVKDVNSVSYATPAGMQAQGVHVFVNSEISKVDPASHSVHVIDHATGDERDETYDKLVLSVGAVPFDLPVPGHDLANIYAMRGRDWAIKLKAKTVDPSVKNVVVIGSGYIGIEAAEVFAKAGMHVTVIDLLPRLLSLYLDQEFTDILTKTMADHGIYAAVGQGIKAYEGVDGHVTKVVTDQGEYPADLVVTAAGIRPATGFLKGVVDLDDHGLIKINDHLQTSDTDIYAVGDATLVPFAPTGKDNRIALATNARRQGRIAAKNLLGENVPMPAVSGSSALSVFDYHFASTGVKEGTADKLGVKTASVLVTDTIRPKFVSEDAGNTKVWFKLTFDPTDGRVLGAQIMSKYDVTANINAISVAIQAKLTVADLAYTDFFFQPGFDRPWNIINVAAQKAAATLN

SEQ ID NO: 14430 - protein, 109 aa, Oryza sativa (japonica cultivar-group)
MSQLKSSSLAALLIFLLAVFTTAAAAAGTECQNDVEVLKTTCYKFVEKDGPKLQPSPDCCTSMKGVNVPCVCTYLGSPGVRDNINMDKVFYVTKQCGIAIPGNCGGSKV

SEQ ID NO: 14431 - protein, 345 aa, Tuber borchii
MSLPATMKALRYDKPESYAVVEVPLPTLRDNDVLIKVKACGVCGTDLHIHEGEFIAKFPLIPGHETVGVVAAIGKDVKGFTVGERVCADNSELCNECFYCRRGQLLLCEKFEAHGVTMDGGFAEYCAYPAGKVFKIHNLSDVDATLLEPASCAAHGLEKIAPKIGSSVLMFGAGPTGLCLAQLPHNGASHVVIAAPEGLKMDLAKKLDCADIYVPLSRSNPQAQFDQIKSDNPYGFDIVVEATGSPKILEDAINYVRRGGKLVVYGVYSDAARVSWPPSKIFGDEITIIGSFSETYMFPATIGYLDTGKVKVEGIVNKTYKLEQWGECLEAMRNKSAIKAAIVFE

SEQ ID NO: 14432 - protein, 542 aa, Corynebacterium efficiens YS-314
MANDITTTAAWQSLTERYEAFQGTTLRELFQDGGRAEKLSFDAAGLRVDLSKNLLDDAILTDLVALAEQAGLTDRIEAMFRGEHINNTEDRAVLHTALRLPVEESLEVDGQDVAADVHEVLGRMRDFATALRSGAWLGYTGRTIKKVVNIGIGGSDLGPAMATKALRAYATAGITAEFVSNVDPADMVSVLEDLDAESTLFVIASKTFTTQETLANANAAKNWLIEQLGSEEAVSKHFVAVSTNAEKVTAFGINPENMFGFWDWVGGRYSVDSAVGLSLMAVIGPRDFMRFLGGFRAMDEHFRYTDFGQNVPVLMALLSVWYTDFFGAETHAVLPYSEDLSRFAAYLQQLTMESNGKSVRRDGSPVTTGTGEIYWGEPGTNGQHAFFQLIHQGTRLIPADFIGFARPKQDLPAGEKSMHDLLMSNFFAQTKVLAFGKTAEEIAAEGVDDNLINHKVMPGNRPTTTILAEELTPAVLGALIALYEHIVFVQGVIWDINSFDQWGVELGKQQASDLAPAVSGEVEVDSGDSSTDALIRWYRTNR

SEQ ID NO: 14433 - protein, 106 aa, Lactobacillus plantarum WCFS1
MQNMEELYELIKQRKATPKKGSYTDYLFTKGLDKILKKVGEESTEVIVAAKNPGDDELTYETADLLYHVLVLLVERGVSFDQIKQELAKREGKMSDYKDRPEIKNL

SEQ ID NO: 14434 - protein, 108 aa, Lactobacillus plantarum WCFS1
MKPDFEKGDGLLTTVVTDADTKDVLMVAWMNAESYQRTLASGQTWFWSRSRQELWHKGATSGNLQDVVSMTLDCDQDTLLVAVHPHGPACHTGHTSCFFNPVELEQGA

SEQ ID NO: 14435 - protein, 576 aa, Triticum aestivum
MLEQVCTKKSLVPVRNSRDIVDPRVRSDKSPRSPCPPPNVLPASSPPHHARTRARALARSRSLGPSLLLCLLAPSARREVPAGRRTRARARSSSLSGPSLLDLRPRREGGAGRPANPRPRARRAGMAASEGAMRMGKYEMGRTLGEGHFGKVRLARHADTGRAFAIKILDRQRILAMKIDEQIKTEIATLKLLKHPNVVRLYEVAASKTKIYMVLEYVNGGELFEKIALKGKLPEKEGRKLFQQLMDAVSYCHERGVYHRDLKPENVLVDAKGNIKVSDFGLSALPQHQRGRVGLHTTCGSPNYIAPEVLLNKGYDGSMSDVWSCGVILYVMLTGNLPFDDENMVVLYQKILKGDYRIPKWLSPGAQDILRKLLDPNPITRLGMDGLREHDWFNQSYTPAVPFDDDDDNYVGDDNSHMTKNNGIPDNPAINQMNAFQLIGMSSCLDLSGFFEKEDVSERKTRFASNYPPTYLFEKIESNVINMGFQVQKNNGKLKVIQERKGPTNPRGHGSLLISAEVFEINESLYVVELKRSCGDCSLYRQLCATLSDDLGICKSQQLLKNDSIRQELYRFNSSF

SEQ ID NO: 14436 - protein, 376 aa, Ocimum basilicum
MANNTNAGVITCKAAAAWKPSEPLVVEEICVEPPKSTEVRIKMLAASMCHTDILLWKGFFPLYPRIPGHEGAGVIESVGEKVANLKVGDTVMPLSIGQCGECSNCATGKTNICFKYPFGISGLMPDGTSRMSAKGQKLYHMFTCSTWSEYTVVDSNFVVKVDPRIPLPHASLLTCGFLTGYGAPWRESRVEKGSTVAVIGLGAVGLGAVSASRILGASKIIGIDVNELKREKATVFGVTEFINPKHSDKTVSQLIQEATGGLGVDCCIECTGVSSLLNEAIASTKVGIGEVVLIGAGEKEKVEISYIPLMLGRSVKGTTLGGVRIHSDLPKIVEKCINKEIDLDELITHEVSLVDVNKGFMEYMNQPDCVKVSVKF

SEQ ID NO: 14437 - protein, 107 aa, Anabaena variabilis ATCC 29413
MTQETSEKISNLITQNKIMVFMKGTKLMPQCGFSNNVVQILNTLGVPFETINVLEDQEIRQGIKEYSNWPTIPQVYINGEFIGGSDILIELYQKGELQQLVEVALAS

SEQ ID NO: 14438 - protein, 345 aa, Ocimum basilicum
MFRNENKQVIFNNFVNGSPEESDMSVRTETVDLGIPEGCDDAVLVKNLYLSCGPYMIGRMKNLEGYFFESFKPGSPIVGCGVFKVLDSSHPNYKKGDIISGFTNWEEYSLLTITDATPFFKIQDKDLPLSYYIGILGVPGMTAYTGFFELCCPKKGETVFVSAASGAVGQLVGQFAKLAECYVVGSAGSNDKVNLLKNKFGFDEAFNYKDEKDYSAALKRYFPNGIDIYFDNVGGKMLEAAISNMRAHGRIAICGMVSQYGLEQHEGVHNLFTILTKQIRMQGFLVGEYYHLFPKFLEMILPHIKQGKITYVEDIVEGLENAPSTLVGLLSGRNVGKQVVLVSPE

SEQ ID NO: 14439 - protein, 983 aa, Coprinopsis cinerea okayama7#130
MYNNTNANPTRNRQPPLRETITVVGIPSVSIDNDRLVVGSSQTSSTRSYTPIKVLGDGSFGTVWLCDWHTTLPPNTPLSPMQCGQGARPEWAGKRLVAVKRMKKRWEGGWDECQKLKELESLRAIPFHPNIIPLYDFFLLPTSKELYFVFESMEGNLYHLIKARKGRPLAGGLVSSIFQQITLGLDHIHTHGYFHRDMKPENVLVTTVGLFDYTPVSPIAPPNAPKERDVVTIIKLADFGLARETRSRPPYTEYVSTRWYRAPEVLLLSREYSNPVDLWALGTIMAELVNLRPLFPGSDQVDQVARVCEVLGDPAEDYRDNGGNVVGGGQWPHGVSLARDVGFQFPRIEPKDIFSLFDASVPRSLIQCIRDLLRWDPAKRLTSKQCLDHLYLRETIHRNNIPMPSGLRAASVSQTSIPMMSSHLNGSSSHPSLSSHTPRNVPPSHSNSAHHVRPPPVPSHFPEVPPPQNSQPTPLPSVPHQPIPLHAQNGRRPHPIVGWTGPSPQPASDYPMDTSPSEPYANGHANNGHSEHHPPAGHSMPPPKSLKLGPFGKKSSRWALGIFGSEKSHQLPPVDEVTTTALGTRKRSQSSSTDGKSVRDLSPERPQDLREVQKQQKKEAERINREAEKERRKLAEKMAREQARAVMSKRNRMLREAVGEDIDWSGGNQERVVDKGTKQASSGPIRQKSMGNLGNSTLHAASGKYSEPPAPPVSFDRYRDWRGTGERVAKARRREYDDDHSMSSSDVHSLSRVSSISFATVDSDPGPSRLRHHSSFHHAASSRTSRSSLRTSFDDFSPSARSSNSFSLEGSSSLAHEFGAHLNVNPHISGSVSPPPLHMLSLSPTLSPPLSPNPPWIQVQDIKENGLGGQSPPYITLQNRQFSPSPHSPLDIHNYLQQPPSPFNNPSAPAQPPTTGQTPRSANSAINPIFKVPLPPPPLPSLPLPAGQPLSSTSLTNKLPPFSQLEAVAGGEISPTSPMFADP

SEQ ID NO: 14440 - protein, 412 aa, Zea mays
MAALSVPLHAAAGSRAAAADPVKVPCVRSTGSAHFGRAFPSVAVSSLAARHIEPMRAIATQAPPAVPQYLSGEKTKIGINGFGRIGRLVLRIATSRDDIEVVAVNDPFVDAKYMAYMFKYDSTHGPFKGSICVVDDSTLEINGKKVTITSKRDPAEIPWGNFGAEYVVESSGVFTTTDKASAHLKGGAKKVVISAPSADAPMFVVGVNENSYDSKMNVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRIEKNASYDDVKAAIKAASEGALKGILGYTDEDVVSNDFVGDSRSSIFDAKAGIGLSSSFMKLVSWYDNEWGYSNRVLDLIAHMALVSAAAKL

SEQ ID NO: 14441 - protein, 539 aa, Ralstonia metallidurans CH34
MHDKILILDFGSQVTQLIARRVREAHVYCEIHPNDVTDEFVREFAPKGVILSGSHASTYEDHQLRAPQAVWDLGVPVLGICYGMQTMAVQLGGKVEWSDSREFGYAEVRAHGHTNLLKGIEDFATDEGHGMLKVWMSHGDKVTALPAGFKLMASTPSCPIAGMADEARGYYGVQFHPEVTHTSKGREMIERFVLEICATKADWVMRDHIAEAVEKIREQVGDEEVILGLSGGVDSSVAAALIHRAIGDQLTCVFVDHGLLRLDEGKMVMDMFAGRLHAKVVHIDASEQFLGHLTGVTDPEQKRKIIGREFVEVFQAEAKKLSNAKWLAQGTIYPDVVESGGTKTKKATTIKSHHNVGGLPETLGLKLLEPLRDLFKDEVRELGVALGLPPEMVYRHPFPGPGLGVRILGEVKRDYADLLRRADAIFIEELRKTIATEQDAAAGLCEANQVGKSWYDLTSQAFAVFLPVKSVGVMGDGRTYDYVVALRAVQTTDFMTAHWAHLPYSLLGRCSNRIINEVRGLNRVVYDVSGKPPATIEWE

SEQ ID NO: 14442 - protein, 643 aa, Mycobacterium avium subsp. paratuberculosis K-10
MCGLLAFVAARAGAVGADDAIARASHLMRHRGPDEPGTWAGADGSVVFGFNRLSIIDIAHSHQPLRWGPPETPDRYELVFNGEIYNYLELRDELAARHGAVFATDGDGEAIVAGFHHWGTDVLTRLRGMFAFALWDTVTRELFCARDPFGIKPLFVATGTGGTAVASEKKCLLELAELIGFDTAIDERAVQHYTVLQYVPEPETLHRGVRRLESGCYARIRPGAAPDVTRYFVPRFAAVPITRDTEQARYDEITAVLEDSVAKHMRADVTVGAFLSGGIDSTAIAALAIRHNPRLITFTTGFEREGFSEIDVAVASAEAIGARHIAKVVHPDEFVAALPEIVWYLDEPVADPALVPLFFVAREARKHVKVVLSGEGADELFGGYTIYREPLSLRPFDYLPRPVRRSMGKVSRPLPDGMRGKSLLHRGSLTLEERYYGNARSFSDTQLRDVLPGFRAEWTHTDVTAALYAQSIGWDPVARMQHIDLFTWLRGDILVKADKMTMANSLELRVPFLDPEVFAVASRLPVEAKITRTTTKYALRRALEPIVPAHVLHRPKLGFPVPIRHWLRAGELQDWAYSMVASSQAGHLVDLGAVRRMLDEHRNGVSDHSRRLWTVLIFMLWHAIFVEHSVVPQISEPVYPVQL

SEQ ID NO: 14443 - protein, 61 aa, Glycine max
YTEDTECVGLARLGNEDQMIVAGTMNQLQLIDFGAPLHCLVITGPTHPVEEEMLDFYRCRT

SEQ ID NO: 14444 - protein, 422 aa, Oryza sativa (indica cultivar-group)
MAPLRGAKRRRKAAAEKKAAMAAAAAAGGAPGAGGGDWWDGFCMRMSGTLSGIQDAQRFEFIFKMPRRTFNYICGLVRDEMMVRSSSYTFLDGKVLSLEDRVAVALIRLNSGGSLVTVGSAVGVNHSTVSLITWRFVEAMEERASHHLRWPDSSEVEKIKSMFEKIHGLPNCCGVVDTTHITMCLSSAEPNCKVWLDHEKNYSMVLQAVISPDMRFMDIVTGWPGSMKESSILHSSGLFKMCEKGARLNGSKMVVSDGSEIGEYIIGDAGYPLLPWLLTPYQEKDLSDSKLEFNKRHAAAITVAPRTLANFKDTWKFLHGEMWRPDKHRLPRIIHVCCMLHNIIICLQDATIDEAAMSNDHDANYKQQVCQLADENAVRVRDKLSEHLVSRGERGSAKLLISRSVVTNENPTVTVELSSSPL

SEQ ID NO: 14445 - protein, 191 aa, Brassica napus
MSSNPTQISDDYVSENRSGVGGGISDVYGEDLATLDQLVTPWVTSVASGYTLMRDPRYNKGLAFTDKERDAHYLTGLLPPVILSQDVQEKKMMHNLRQYTVPLHRYVALMDLQERNERLFYKLLIDNVEGLLPVVYTPTVGEACQKYGSIFRRPQGLYISLKEKGKILEVLKNWPQRGIQVIVVTDGERIL

SEQ ID NO: 14446 - protein, 196 aa, Lactobacillus plantarum WCFS1
MNMRQATIKRETKETQIEISLNLDEQSGIEIDTGIGFLNHMLNLFAKHGRFGLVVKCHGDLDVDPHHTTEDTGIVLGECFKQALGDKQGIERYGTEFVPMDETLGQVSVDLSGRSYLVFDAELTNPRLGGLDTETVEDFFQAVAFAAEMNLHARILYGRNTHHKVESLFKAFGRAMRAAVTINPDIQGVNSTKGVI

SEQ ID NO: 14447 - protein, 238 aa, Synechococcus sp. CC9311
MSDLQTQMKQAVAEAAVAQIRDGMVVGLGSGSTAALMIEGLGARLAAGQLRDIVGVTTSFQGEVLAAELGIPLRALNATDRIDLAIDGADEVDPSFQLIKGGGACHVQEKLVADRAERFIVVVDSTKLVRCLNLDFLLPVEVLPGAWVQVQSRLKSMGGVAELRMATRKAGPVVTDQGNLVLDVRFENGISDPIALERDINNLPGVLENGLFVNLADEVLVGEIKDGVAGVRSLDRVG

SEQ ID NO: 14448 - protein, 215 aa, Xanthomonas campestris pv. vesicatoria str. 85-10
MSEAKRLAAEKAIDYVEDGMIVGVGTGSTVAYFIDALGRIGHRIKGAVSSSEQSTARLRQHGVEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHHLQITDPVGLERSLNQIPGVVCVGLFARRPADVVIVGGEPPQVI

SEQ ID NO: 14449 - protein, 382 aa, Zea mays
MNPHSRCYVPAVVRATFQDPALPLPPAGCNIPRPVSDYGNVNPFYADTGYSLGMEVPAPWDRWYCYRGSRHFVQRTAEEPVPVMSAAPVCDGGSTRDDEKNSTRVPTTKYGPYHGYDKEIEDTLRTQEREAKPSPDYLETTQRGRMSQDARADLVSWMKAFTRHYNDDLAPGTLHRAVYYADRFLSVRSVEDVAMHRLYLLGAAAVYVAAKYEDQGTVRKLNAEKVARYYGHRSGGFASTKQQVLDMERALLVALDYRLGRPTAYTFVQHFTRHYGQAEVEQDLRSAAHDFADMSLLHYSCLQHNPSAVAAAAMFLARLTLKPWYGQITRSNRELRELTGYEPQKLKRCVEAIHSLIPQYGNGSYSDIDLFPMFYAVAADPR

SEQ ID NO: 14450 - protein, 506 aa, Legionella pneumophila subsp. pneumophila str. Philadelphia 1
MDLLQRLNIKSVNPGAFSGHGWHSVNHAHTLESFNPSTGNKIAEIATCTMDDYEQVMQRAEQAAQAWRKVPAPKRGEIIRQIGQVLRENKDSLGSLVSLEMGKSKQEGDGEVQEMIDIADFAVGQSRMLYGNSMHSERPNHRMYEQWHPYGIVGVISAFNFPVAVWSWNAFLSAICGNVTIWKPSAKTPLCAVAVQHICNQVLKENNCPEIFGLIIPNSHDVVEAMVDDKRIQLISFTGSTAVGKQVAAKVAARLGKSILELGGNNGIILDESADLNLAIPAIVFGAVGTAGQRCTTTRRLFVHESKYQDVIKRLRHAYEQITIGDPLDTRNLMGPLIDLQAVEQFKKAINRIKAAGGQIVYGGEILKQAGSFVQPTLVCDVKNDWDIVQEETFAPILYVMSYRTLDEAIALHNGVPQGLSSALFTQNLKNAERFLSACGSDCGIANINIGTSGAEIGGAFGGEKETGGGRESGSDSWKAYMRRQTNTINWGDELPLAQGIRFNLS

SEQ ID NO: 14451 - protein, 163 aa, Acetabularia acetabulum
WFQGTADAVRQQIRYVEEDKGDEVLILSGDQLYRMDYVPMIQMHRETGADATIAVIPIPTEETYGLGLAVSMTMAGSKGLSKTQDRGRACPGEDVGRLAEKRGVKDTNRQFLGNMGIYLFKKDSLLELLNAPPKATDFGKEIFPRCVDTHKVMTYVFEDYWED

SEQ ID NO: 14452 - protein, 153 aa, Burkholderia xenovorans LB400
MRVSDILKVKGNTLFTVTPDTTLHDAVNTMAEHDIGSLVVMEYGDLVGMLTFREIILTLSKNGGSVGTSTIRKVMDDHPLTCTPETDVNEVRRMMLEHHVRYLPVLESRTLMGVISFYDVAKAVVEEQGFENRMLKAYIRDWPEEQQEQQPAR

SEQ ID NO: 14453 - protein, 479 aa, Bacillus cereus ATCC 14579
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVSLLKAQVAELSVGSPEQDSTIVPLIDDKSADFVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 14454 - protein, 339 aa, Brassica napus
  misc_feature (191)..(191): Xaa can be any naturally occurring amino acid
  misc_feature (205)..(205): Xaa can be any naturally occurring amino acid
  misc_feature (216)..(216): Xaa can be any naturally occurring amino acid
AGSSSQTTPNKALLMRAETNMMLMSPAKQGKPNTSGVKQLDIESGKIVTEWQFEKDGTEITMRDITNDTKGSQLDPSESTFLGLDDNRLCQWDMGDKRGIVQNIDSPVLEWTQGHQFSRGTNFQCFASTGDGSIVVGSRDGKIRLYSKTSMRMAKTAFPGLGSPVTHVDVSYDGKWILGTTDTYLVLICTXLFTDKDGRTKTGFXSGRMGNKIPAXPRLLKLTPLDSDLAGIPKSTHASGYLQVTESGKQERHIVATVGKFSVIWDLERVKNSAHECYRNQQGLKSCYCYKILLKDESIVESRFMHDRFSFSGNKSPEAPLVVATPQKVSSISLSGRRL

SEQ ID NO: 14455 - protein, 371 aa, Mycobacterium avium subsp. paratuberculosis K-10
MTSGSLEFTVSRSTRPATGAERETILAEPGFGKYFTDHMVSIEYDETEAGRGWHDARVIPYGPIELDPSAIVLHYAQEIFEGLKAYRWADGSIVSFRAQANAARLRSSARRLAIPELPEELFLESLRQLIAVDNAWVPAAGGEEALYLRPFVIATEPGLGVRPSKQYRYLLIASPAGAYFKGGISPVTVWVSTEYVRASPGGTGAAKFGGNYAASLSAQAEAAANGCDQVVWLDAVERRFVEEMGGMNIFFVFGSGGSARLVTPELSGSLLPGITRDSLLQLAIDAGFAVEERKIDIDEWQKKAAAGEITEVFACGTAAVITPVSHVKYGETEFTIADGQPGEVTMALRDTLTGIQRGTFADTHGWMTRLG

SEQ ID NO: 14456 - protein, 333 aa, Triticum aestivum
  misc_feature (316)..(316): Xaa can be any naturally occurring amino acid
AARPRSPSSEGEREGLPASSSSAHLAPPPRRAAPSSPSRECERDPIEKMEEVENTSKRKAPELDSEDSSAAAVMNGQQSLPGSAAKRQNLARSCIHEVAAPNGYDLSKDEAVHGTLSNPVFNGNMAKTYPFQLDPFQTVSVACLERNESVLVSAHTSAGKTAIAEYAIAMSFRDKQRVIYTSPLKALSNQKYRELSQEFSDVGLMTGDVTLQPNATCLVMTTEILRAMLYRGSEVIKEVGWVIFDEIHYMKDRERGVVWEESIVFLPPAIKMVFLSATMSNATEFAEWICNLHKQPCHVVYTDFRPTPLQHYVFPXGGSGLYLVVDENGQFKE

SEQ ID NO: 14457 - protein, 351 aa, Frankia sp. EAN1pec
MTVRLLDHWTCIEVDVDEQRMTMREALNLALDQALARDERVFLLGEDIADPGSSGPTKGLSTKYGADRVLDTPISEAAIVGAAIGAAMEGFRPVAEIMIMDFIGIAADQIVNHAAKLRFMTGGRTTAPITVRTQVYGGLGTGATHSQSLEAWFMHVPGLKVIVPSTPRDAKGLLASAIFDDDPCVFLETIRLQGQRGLVPVDPGFSIPLGQADVKRPGTDVTLIGYGRGVVESLGAAAVLEAEGVSAEVLDLRTLVPLDVPAMVDSVRRTRRAVVVHDAVRFAGPGAEIAAILQRELFGVLEAPVERVGARFVPNPAPPALESQIYPSTERIVAAVQQTLRSETTRDGACG

SEQ ID NO: 14458 - protein, 332 aa, Frankia sp. EAN1pec
MTTDRTAGISGQVWRRLYELMTLMKAADDRLSRGIASGELQCVYWPPRGQEAIAAAMGVCLRSDDQLVTTYRGLHDLIGKGVPLVEIYGEMLGRQVGSGRGKGGTMHIARPDSGVMLSTGIVGSGPPVAVGMAMAARRKGLDRVTAVSFGDGATNTGSFHEAANMAALWDLPLVLVCQNNQYGEMTPTEHTMKIAQVADRAGGYGMPGVRVDGNDPLAVLAVLTQAVERARSGGGPTLVECVTFRFRGHYFGDPMAYIPAERMAAAVEADPIPRFRSRLLETGVCDEHELDEIEAAAVAAVEEALTAVLAAPVAALDELDRDVYADPRNCPA

SEQ ID NO: 14459 - protein, 350 aa, Thermus thermophilus HB8
MKDYYAILGVSREASQEEIKKAYRRLALKYHPDRNPGDKEAEERFKEINEAYAVLSDPKKRAAYDRGHLEAPEYRPEDLFDLFFQEVFGVRGHRRPPRGEDLEAEVEVELQDLLHGAEKEVRYTRLVPCEACGGEGGRRTPCPTCRGQGVVESYRQSFFGTVVTRTACPHCKGRGYLLAETCPACRGRGRVPREERVRVQVPPGMDEGHLLRVPGYGNLGPGGPGDLYLRIRVRPHPHLERQGPDLVYRLRLGLAQAALGARVEVPGLEGPIPLDIPPGTGHGEVFALEGGGLPLPGGRGRGTLRVVVELAVPKKLSPKAQKLLRAYAEEVGEEVAPEGFWERLKGFFRK

SEQ ID NO: 14460 - protein, 375 aa, Bacillus licheniformis ATCC 14580
MSKRDYYEVLGVGKSASKDEIKKAYRKLSKKYHPDINKEAGAAEKFKEVKEAYETLSDDQKRAHYDQFGHTDPNQGFGGGGFGGGDFGGFGFDDIFSSIFGGGARRRDPNAPRQGADLQYTMTLSFEEAAFGKETTIEIPREETCETCSGSGAKPGTKPETCSHCGGSGQLNMEQSTPFGKVVNRRVCHYCNGTGKQIKHKCSTCGGTGKVKKRKKINVTIPAGVDDGQQLRVAGQGEPGINGGPSGDLFVVFRVQEHEFFERDGDDIYCEMPLTFAQAALGDEIEVPTLHGKVKLKVPAGTQTGTKFRLKGKGVANVRGYGQGDQHIVVRVVTPTNLTENQKNILREFAEVSGNMPDEQEMSFFDKVKRAFKGD

SEQ ID NO: 14461 - protein, 467 aa, Coccidioides immitis RS
MTFSVLARKRRRQLSPPSPHIVSRKSSVVMVPALPMTPPDPDVDPIPSINPTASALDTVVHVISTERAALANLERMYATDPFSRESMERAVEQIAKTINVGGKLVICGVGKSGKIGEKLVATMNSFGIQSCFLHPTEALHGDLGMIKQNDTLLFITFSGKTSELSMVLPHIPPMLPVIAITAHMQPSSCALLSDSDIRYTILLPAPVHEREEISFGLPAPTTSTTVALAVGDALALAVARSLHTIPGRGPAEVFKEFHPGGAIGAAFASSSSSASETPSRSSASSATSSPTLVGLNGALDQPNGINTALQQSHQKLISDIATPLSYIPIISQLEPSSSNTRIADVLAAAVRCPKANFWVLMTTDCIISPTRLRFLAGDRDPGTRLCDVDDKSHVVVKQNWIRVPKSSSLATVRQILNDIDSSSKYEGAVGKTGKLPGKDRVVAITGEKFEDDVYGFVEEQEVWRGDM

SEQ ID NO: 14462 - protein, 223 aa, Zea mays
  misc_feature (122)..(122): Xaa can be any naturally occurring amino acid
  misc_feature (164)..(164): Xaa can be any naturally occurring amino acid
HVPVALMKCFLRLAELNTAKNLETCGILAGTLKKRTFYVTTLIIPKQKSTSDSCQATNEEEIFEVQDKGSLLSLGWIHTHPTQTCFLSSIDLHNHYAYQIMLPEAIAIVMAPTDTTRYYFHXCCTLSFLVIVIWRHASQEEKSIMLISTDHYGLFVVFIKGANXKHGIFHLTEPCGMGVIHDCDATGFHPHEEPLDGTPIYEHCSHVYMNPNVRFEMTDLREA

SEQ ID NO: 14463 - protein, 429 aa, Xanthomonas campestris pv. vesicatoria str. 85-10
MNHSRSHALFAQAQTLLPGGVNSPVRAFKSVGGEPFFVARADGPYLFDVDDNRYIDYVGSWGPMIAGHNHPAVREAVERAIGNGLSFGAPCAAEVTMAQTITRLVPSCEMVRMVNSGTEATLSAVRLARGATGRNRIIKFEGCYHGHGDSFLVKAGSGMLTLGVPTSPGVPAGLSELTATLSFNDFEGATALFDEIGAEVAAVIIEPVVGNANCIPPQAGYLQHLRTLCTRHGALLIFDEVMTGFRVALGGAQAHYGVTPDLTTFGKIIGGGMPVGAYGGRRDLMEQVAPAGPIYQAGTLSGNPVAMAAGLAMLELVQEPGFHTRLSEATSMLCEGLEDAARAAGIAVTTNQVGGMFGLFFTDDIVESYAQATACDITSFNRFFHAMLQRGVYLAPSAYEAGFMSSAHDQAVIEATLAAAREAFADVAR

SEQ ID NO: 14464 - protein, 650 aa, Arabidopsis thaliana
MIMKNSAAIFLTSSLILLLQTLHGVKAGFICVGSSFPTNSSYQKNRDSLFSTLSDKVTTNGGFYNASLDGVHVVGLCRRDYDRQGCINCVEESIRQIKTSCSNRVQSFHCNSDDRERVSCLVRTTDQSTYRILELGPATNDPSPVAIDTFAKNMTLFRQEWEAMVDRTLEAVTIDNSTTVLKYYGALKSEFSEFPNVYMMMQCTPDINSGACKRCLQASVTYFRDQNWGRQGGGICRPSCVFRWEFYPFYGAFANVTRVPAPPRALIPRTEAISITRLKGGIIAIFVVPIVINLLVFIGLIRAYTRIRKSYNGINEAQYDYGGQSKLRFDFRMILTATDDFSFENKIGQGGFGSVYKGKLPGGEEIAVKRLTRGSGQGEIEFRNEVLLLTRLQHRNLVKLLGFCNEGDEEILVYEFVPNSSLDHFIFDEEKRLLLTWDMRARIIEGVARGLVYLHEDSQLRIIHRDLKASNILLDAYMNPKVADFGMARLFNMDQTRAVTRKVVGTFGYMAPEYVRNRTFSVKTDVYSFGVVLLEMITGRSNKNYFEALGLPAYAWKCWVAGEAASIIDHVLSRSRSNEIMRFIHIGLLCVQENVSKRPTMSLVIQWLGSETIAIPLPTVAGFTNASYQAEHEAGTLSLNELSITELSPR

SEQ ID NO: 14465 - protein, 469 aa, Legionella pneumophila subsp. pneumophila str. Philadelphia 1
MTKNVVLDAIKEHDAKFVDLRFTDIRGKEQHITIPVSAVDDDFLENGKMIDGSSFKGWQKIHQSDLALVPDLTSIKPDPFFQDNTLFIRCNVVDPQTMMGYDRCPRSIAQRAENYLQSTGIADGVNFGPEPEFFLFDNVQWETTISGSFYKIDSDEAHWNSGKEMEGGNIGHRPPLKGGYFPVPPVDSSHDIRSAICITLESLGMVVEAHHHEVATANQCEVATRFNTLTKKADELQILKYVIHNVAHNYGKTATFMPKPLVGDNGSGMHCHQSLYKDGYNLFSGDQYSGLSETALYYIGGIIKHARALNAFTNPSTNSYKRLVPGFEAPVLLAYSARNRSAAIRIPHVSNPKARRIEVRFPDPTANPYLAFSAMMMAGIDGIQKKIYPGQPMDKDLYDLPPEELVDVPTVCSSLEMAMDHLRADHEFLLQGDVFSRDFINNYIQMKEEEITKIRSLTHPYEFELYYSL

SEQ ID NO: 14466 - protein, 382 aa, Yersinia pestis KIM
MCDKKPLKESSMSHENLKGAQMAEGIPETMRAVVAYGPRDYRFERVPVPTIDAKEILVKVEGCGICAGDTKAFEGAPSFWGDDKQPAYIKAPMIPGHEFIGHVVGLGADVEGFELGDRVTSEQIVPCWGCRFCNHGQYWMCEKHDLYGFQSNVNGAMAEYLKFTKEAINYHVPDHLPLEKAILIEPYACAFHAVQRAKIKLGDVVVLAGSGTLGLGMIGAIKKSGAAKLIVLDLSDDRLALAKKFGADLVLNPSRDDVNTLIKEMTGGYGCDIYIDATGAQKAVEQGLTLLRKLGTFVEFSVFKDPVTVDWSIISDRKELDVLGSHLGPYCFPLVIEGISNGDLPTEGVVTHILPLEKYAEGIELVKRGVDSLKVVLNPNLT

SEQ ID NO: 14467 - protein, 441 aa, Bacteroides fragilis YCH46
MKTDLIYGIEDRPPFKDALFAALQHLLAIFVAIITPPLIIASALKLDVEKTGFLVSMSLFASGVSTFIQCRRFGPIGAKLLCIQGTSFSFIGPIIATGLVGGLPLIFGVCMAAAPIEMIISRTFKYMRNIITPLVSGIVVLLIGLSLIKVGIISCGGGYTAMDNGTFASWENLSIAGAVLLSVLFFNRCKNKYLRMSSIVLGLCLGYGLAFVLGKVDMSALNVEMLMSFNIPQPFKYGLDFNVSSFIAIGLVYMITAIEATGDVTANSMISGLKIEGDDYLKRVSGGVMADGFNSFLAGIFNSFPNSIFAQNNGIIQLTGVASRYVGYYIAAMLILLGLFPIVGAVFSLMPDPVLGGATLLMFGTVAAAGIRIVASQNIGRKETLVLAVSLSLGLGVELMPDVLSQAPEAIRSIFSSGITTGGLTAIIANIVIRVKEENEE

SEQ ID NO: 14468 - protein, 583 aa, Coprinopsis cinerea okayama7#130
MDELRSEDVQLRLNAIHSIPTIALALGPDRARDELIPFLQDSVDDEDEVLLALAEELGRNFEEYIGGSEYAHILLGPLENLSAVEETLVRDKAAESITKVAAVLSQKQIEDYYIPLVKRLSQGEWFTSRTSSAALYAAVYPKVSSTIQDDLRKGFLALGSDDTPMVRRASAKWLGPLVAHFSQQHVLSDGLPIYRRLQSDDQDSVRLLTIEGLIAIAKRITPAEVKEHLLKQIKQSVGDKSWRLASAVGAEVTREELVALYVNLLKDNEAEVRTAAATQIPGSGFSSFLEKEVILARIIPCVRDMSQDASQHVRAALAKEISGVAPLLGREATIEHLLPLFLHLLKDDFPEVRLNIISKLETVNNGTRHLEQERGLTFHPVIGIELLSESLLPAIVELAEDKSWRVRQAIIEYIPLLANQLGKPFFDEQLGNLCMSWLGDTVYSIRESATVNLKKLTDVFGVEWAKTSIVPKVMGMGSHTNYLFRMTTVQAITTISPSLTLDIIQSDVIGPLLELSKDPIPNIRFNVAKALEVIATSHGNTPEGRKFVAEWIVPALERQKGDTDADVRYFATRGLQKAATTSA

SEQ ID NO: 14469 - protein, 292 aa, Coprinopsis cinerea okayama7#130
MPVHQLPGKIILQHPEGPSLEILLYGATIVSWKSPSVENKELKERLFLSSKAILDGTKAIRGGIPIVFPCFGAPQHPEHLKLAQHGFARTSLWTFRKILLDNEAGVSVQLTLDPTPEIAAVYDRPFQLTYVVTLAQHQLSTDLHVANPSESATLQFQSLLHTYIAAPAQELTITPLQNVKYYDKMESITEAQQTAKVETRAKVDVRRPTDSVYEDAPLDYTVSWPGGTVNIRAREFKDVVVWNPGEGGKKIADMEDGGWNNYVCVEPGYVRGYVNLAPGQTWIGQQVITIKA

SEQ ID NO: 14470 - protein, 483 aa, Anabaena variabilis ATCC 29413
MQKLNGLLTNDIIEESAWEALEKSILYYKGRPVGTVAAFDASVEALNYDQCFVRDFVSSALIFLIKGKTDIVRNFLEETLKLQPKDRQLDAYKPGRGLIPASFKVVSDNGEEYLEADFGEHAIARVTPVDSCLWWILLLRAYVVATKDFSLAYQPEFQTGIRLIMEICLANRFDMYPTLLVPDGACMIDRRLGIYGHPLELQVLFYAALRAAREMLICQGNQDVVEAIDNRLPLLCAHIRQHYWIDINRLNAIYRFKSEEYGKAAVNLFNIYVDSIPYYELDKWLPKKGGYLAGNVGPSQLDTRFFALGNLMAIISDLATEEQSQAIMTLIEDRWEDLVGDMPMKICYPALEDEEYRIVTGCDPKNIPWSYHNAGSWPVLMWMLAAASVKAGKPYIAGKAIEIAQARLLEDEWPEYYDGKKGRLIGKQARKYQTWTIAGFLLAAELMENPSHLSLISFDKLPSELVSRACEFEIGSVDTSISL

SEQ ID NO: 14471 - protein, 261 aa, Candidatus Kuenenia stuttgartiensis
MNSDNQKKRPIILGNWKMNKSLKEGVQYARSLKAAIAGKTWIMCGICPPYVFLKDICAILEGSTICVSAQNMHSEASGAFTGEIAAPMLKEVGCSHVLVGHSERRHIFGEDDFFINDKIKKAISFELVPILCIGETLEEREAGNTKDIVLRQLKNGLRGVGIELIKCIIIAYEPVWAIGTGRTASPEQANEVHSFIRTILSEDYGKDIAKKLSIIYGGSVKADNTEALIHQPEIDGLLVGGASLELESFLTIIEVVQGVDF

SEQ ID NO: 14472 - protein, 590 aa, Mycobacterium avium subsp. paratuberculosis K-10
MAFSVQMPALGESVTEGTVTRWLKQEGDTVELDEPLVEVSTDKVDTEIPSPAAGVLTKIIAQEDDTVEVGGELAVIGDAADGAAGGGAQAPSQPSQPQAPAQPEPQAQEPAQAQPEAPAQPQAPAQPAPQESGGGAATPVLMPELGESVTEGTVTRWLKKVGDSVQVDDALVEVSTDKVDTEIPSPVAGVLISITAEEDSTVPVGGELARIGTGAQAPAPAAPQPPPAPKPEPKPEPAPQPQAQPAPQPQAQPAPEPKAQPAQAQPAAGGEGTPYVTPLVRRLAAENDIDLSSITGTGVGGRIRKQDVLAAAEQKQRQQQAAAQPSAAPAPAAAEARKPAAPTPAPALAHLRGTTQKASRIRQITAAKTRESLLATAQLTQTHEVDMTRLVGLRARAKAAFAEREGVNLTFLPFIARAVIDALKIHPNINASYNEETKEITYYDAEHLGFAVDTEQGLLSPVVHNAGDLSLAGLARAIADIAARARSGNLKPDELSGGTFTITNIGSQGALFDTPILVPPQAAMLGTGAIVKRPRVIVDEFGNESIGVRSICYLPLTYDHRLIDGADAGRFLTTIKHRLEEGAFEADLGL

SEQ ID NO: 14473 - protein, 101 aa, Zea mays
  misc_feature (29)..(29): Xaa can be any naturally occurring amino acid
  misc_feature (70)..(70): Xaa can be any naturally occurring amino acid
AAGVETVAVLPQHAGTIVLAGEETGLLVXGLQNDGESIVNVAGVHSTLHLPYDHTMYGQNLTVQNFFNSXVPVAVQAAFHYKYAGSKYLQPAAYDLAVYIL

SEQ ID NO: 14474 - protein, 119 aa, Brassica napus
NRERFTEQGDAITFESETDKIYLSTPTKIAILDHEKKRTFVVRKDGLADAVVWNPWDKRSKTISDLGDEDYKHMLCVEAAAIERPITLKPGEEWKGRLELSAVPSSYSSGQLDPKKVLE

SEQ ID NO: 14475 - protein, 249 aa, Candida glabrata CBS 138
MSHHCEDEHFEHDHDHDHGHDHGHSHEAPIATSAAQSLYEQIDTPKIKCLNGVGKGATGKELYKYFIKPHEEKYNTEIYLESDADCQLIINIPFVNSCKVHSVVLRTNANSSGYSTPRTIKIFNNFKKSLDFDTLSGESKVDFKTEHPNNVGVHKGEASVTEDSSFVEYHLPRAQFQNCESLTLFIEDNWADDEDELSQLFFLEIRGEITGKLRPENAVPLMTVYESAPNPLDHAKLESEVSDGLNLGK

SEQ ID NO: 14476 - protein, 124 aa, Glycine max
MAAISLRKGNTRLPPEVNRVLYVRNLPFNITSEEMYDIFGKYGAIRQIRIGTNKDTRGTAFIVYEDIYDAKTAVDHLSGFNVANRYLIVLYYQQAKMSKKFDQKKKEDEIARMQEKYGVSTKDK

SEQ ID NO: 14477 - protein, 170 aa, Arabidopsis thaliana; identical to SEQ ID NO: 1028

SEQ ID NO: 14478 - protein, 905 aa, Thermus thermophilus HB8
MTEKELKAAFQALSPEEKARFLEIENREWLESLEYVLKVEGPERVEELLRLLDEYLFRHGVYPANRLSTPYLNTLPKEKEPPYPGDLELERRIANILRWNVAMMVTRANKKADGIGGHIATYASIAELYEVGFNHFFRGPEAGLDRDLVFFQGHASPGNYARAFLEGRLKEEDLENFRREVHPPVPGGRGLSSYPHPWLMPDFWEFPTVSMGLGPIQAIYQARFMRYLEDRGLKPKSSAKVWAFLGDGEHDEPETVGALHLAARENLDNLIFVVNCNLQRLDGPVRGNSKVIQELERLYRGAGWRVIKVVWGSAWDELLAKDKEGHLLRRFEALVDGESQRYAAFGGKELRERFFNTPELKKLIEGMTDEELTELTRSRGGHDMVKIYAAYKAAVEHRGSPVVILARTIKGYGMGPTVMAKNVAHQVKKLTEEDLKEARRFLGIPIPEEKLPELPYYHPGPDSPEVRYLLERRKALGGFVPERRVRFQGGLEVPEEEFFREFYEGSGGREISTTMAFVRILAKLLRHPKIGKYIVPIVPDEARTFGMEALIAQVGVYSPQGQLYVPVDAGTLTAYKESQKGQILEEGITEAGAMAEFIAAGTAYAHWGIPTIPFFITYSMFGLQRIGDLVWAAADQRARGFFLGATAGRTTLAGEGLQHQDGQSHVYALAAPNLLAYDPAFAYEFAVILEDGLRRMYGRGEDVFYYITIENENYVHPPMPEPREKVKEGILKGLYLFRAGEGKGPKVQLFGTGPILNEALKAQELLAKYGVVADVWSATSYKALYVDAIEAERETRLLGKARRPYVQEALEGHEGPIVAATDYLKALPNLIRGYVDRPFAVLGTDGFGRSDTREALRDFFEVDARHIAYTALALLHGEGKVTKRTLNQARKDLGLKLEEVPPHRR

SEQ ID NO: 14479 - protein, 287 aa, Coccidioides immitis RS
MASTRSMLRLAASRHLAYARPARAARLFSSIPALQEAKVVSGSPLPNPRDESRPPIETLNRPVVNPADKYAEKSKELHTYGEYLMSCLPKYIQQFSVWKDELTIYIPPTGVIPVISFLKDHTAAEYKQVSDITAVDFPTREYRFEVVYNLLSVRHNSRIRVKTYADEATPVPSITSLYDGAVWYEREVYDLFGVFFVGHPDLRRIMTDYGFDGHPLRKDFPLTGYTEIRYDEEKKRIVVEPLELTQAFRNFEGGTSAWEQIGQGTDRKPDQFKLPTPKPEEKEEPKK

SEQ ID NO: 14480 - protein, 137 aa, Thermus thermophilus HB8
MERTFVMIKPDGVRRGLVGEILARFERKGFRIAALKLMQISQELAERHYAEHREKPFFPGLVRFITSGPVVAMVLEGPGVVAEVRKMMGATHPKDALPGTIRGDFATTIDENVIHGSATLEDAQREIALFFRPEELL

SEQ ID NO: 14481 - protein, 188 aa, Clostridium perfringens
MLKSYWRDILLLIFGDKRVAAGVLSDGVGSALGGLVGSCPNTSFSQNIGIISLTKVASRHVAVMAGILLVILGFLPKVAAIITGIPNPVLGGVGIMMFGTVAAAGIRTLSNIKLTERNLLIIAISMGLGLGVTFRPDVIHNLPEAIRMIFSSGISTGTIAALILNAVLKESPTSMEFENMYDEETKAS

SEQ ID NO: 14482 - protein, 329 aa, Glycine max
  misc_feature (157)..(157): Xaa can be any naturally occurring amino acid
  misc_feature (186)..(186): Xaa can be any naturally occurring amino acid
  misc_feature (247)..(247): Xaa can be any naturally occurring amino acid
  misc_feature (265)..(265): Xaa can be any naturally occurring amino acid
  misc_feature (287)..(287): Xaa can be any naturally occurring amino acid
  misc_feature (290)..(290): Xaa can be any naturally occurring amino acid
  misc_feature (305)..(305): Xaa can be any naturally occurring amino acid
MASMAAIGSLNVPCSASSRSSNVGRKSFPRSLSFSASQLCGDKIHTDSVSFAPKIGRNPVIVTPKAVSDSQNSQTCLDPDASRSVLGIILGGGAGTRLYPLTKKRAKPAVPLGANYRLIDIPVSNCLNSNVSKIYVLTQFQGGGAKKEGGFLGGFFXPKRGFAENSYFFSGGSQNFLGGIFFCFFXKAHNFWDFFVLGGGPFFLGGVRGNIFPGLMGKFWGDIPGGGHSQRGKGGGPLPFGFNKNLXKGGLKLDLAEKPKRGTSXKALKLDTTILGLDDERAKEMPXYMXSMGIYVFSKNVMLDXLREKFPGANDFGSEVIPGATSIGC

SEQ ID NO: 14483 - protein, 478 aa, Mycobacterium avium subsp. paratuberculosis K-10
MTETTPDDVFKLAKDEKVEFVDVRFCDLPGIMQHFTIPVSFFDESVFEDGLAFDGSSIRGFQSIHESDMLLLPDPATAQIDLFREAKTLNLNFFVHDPFTLEPYSRDPRNIARKAENYLISTGVADTAYFGAEAEFYIFDSVSFDSRTNGSFYEIDAISGWWNTGSPNELDGSPNRGYKVRPKGGYFPVAPVDHYVDLRDQMLSNLIKAGFSLEKGHHEVGTGGQAEINYKFNTLLHAADDMMLYKYIVKNTAWQNGKTVTFMPKPLFGDNGSGMHTHQSLWKDGSPLMYDETGYAGLSDTARHYIGGLLHHAPSLLAFTNPTTNSYKRLVPGFEAPINLVYSQRNRSACVRIPITGTNPKAKRLEFRCPDSSGNPYLAFSAMLMAGLDGIKNKIEPQAPVDKDLYELPPEEAANIPQAPTQLSAVIDRLEEDHEYLTEGGVFTPDLIETWISFKRETEILPVQVRPHPYEFALYYDV

SEQ ID NO: 14484 - protein, 437 aa, Chlamydophila abortus S26/3
MPIIEESTMTYAEACRYFPGGVNSPIRACIPVGILPPIVSSAHRDIFIDSFGKTFIDFCGSWGSLIHGHGHPKILDVICNSASQGTSYGLTSENEISLAATLFSCLEFEDHKVRFVSSGTEATMTAVRLACATTGRSIMIKFLGCYHGHADVLLKGISIDESNIHQVPHIVDTYFSGNPYLPLNLILPYNDIQIFKEVMLQVGERVACVIFEPIAINMGVVLPKPGFIEGVITISRRFAALTIMDEVVTGFRMGIRGVRSIMDVDSDITVYGKILGGGMPVAAFLAHHRIMDHLLPLGQVFQAGTLSGNPIAMAVGKASLELCREVDFYPKLENLAQSFFAPIEEVICHQGFPVSLVRAGSMFSFFFRETPPTNLREVQECDHQMFGVFYRHVFAQGVYLSPAPMEASFLSSVHSKENLAYTQNVLIDSLMKTFGSL

SEQ ID NO: 14485 - protein, 446 aa, Mycobacterium avium subsp. paratuberculosis K-10
MDRQKEFVLRTLEERDIRFVRLWFTDVLGFLKSVAIAPAELEGAFEEGIGFDGSSIEGFSRVSESDTVANPDPSTFQVLPWASPNGHHHSARMFCDITMPDGSPSWADPRHVLRRQLQKANDLGFSCYVHPEIEFFLLKPGPDDGTPPVPVDTAGYFDQAIHDSASNFRRHAIEALEFMGISVEFSHHEGAPGQQEIDLRFADALSMADNVMTFRYVIKEVAIENGARASFMPKPFGQHPGSAMHTHMSLFEGDVNAFHSPDDPLQLSDVGKSFIAGILEHASEISAVTNQWVNSYKRLVGGGEAPTAASWGAANRSALVRVPMYTPHKTSSRRVEVRSPDSACNPYLTFAVLLAAGLRGVEKGYVLGPQAEDNVWDLTPEERIAMGYRELPTSLDSALRAMESSELVAETLGEHVFDFFLRNKRTEWATYRSHVTPYELRTYLSL

SEQ ID NO: 14486 - protein, 457 aa, Wolbachia endosymbiont of Drosophila ananassae
MNEYDITVIGSGPGGYIAAIRAAQLGFKTAIVEKEKNLGGICLNWGCIPTKSLLRASEVYRLIKRSKEFGIEVKGANFDIQSIVKYSRNVVDKLSSGVAYLMKKNNIKVHQGFGKLAGNGTIKVAGDKEEQEIVSKHIILATGVRARNLPGIEADGDLIWNAQHAMTPERLPKSLLIIGSGAIGIEFASFYSTLGVDVTIIEIKSTILPLEDKDISDLAQEIFTKQGIEIYTSSSVKALTKSKDSAQVLLSSGESKEFERVIVAVGIQANIENIGLENTKIKLSPSGFIETNEWYETSESNVYAIGDVAGPPCLAHKASHEAVICIEKIAGKNAHALKKECIPNCTYSHPQIASIGLTEEQAIKGGYDIKIGKFHSNFNGKSVALSETEGLVKTIIDKKTGEILGSHMIGAEVTELISNFALVKQLEGTDFDIKSTIFPHPTISEMIHESVLAADVK

SEQ ID NO: 14487 - protein, 141 aa, Haemophilus influenzae R2866
MMTERTFSIIKSDAVKRNLIGAILTRFEQNGFKIIASKMVRLTREQAEGFYAEHQGKEFFAPLVEYMMSSPIVVSVLEKENAVKDYRTLIGTTNPETAEEGTIRKDFALSQRENSVHGSDSIENANREIAYFFTDCEIFER

SEQ ID NO: 14488 - protein, 425 aa, Nicotiana tabacum
MDNNSVGVPHNLPRGEMGGKQKNAQADGRNRRALGDIGNLVPAPAAEGKPKAAQISRPVTRSFCAQLLANAQEEKNKKPLAEVVNKDVPAKKKASDKEMKTVGGSPLSKRKAKKSGKTLTSTLTARSKAACGLSNRPKYEIEDIDVADADNHLAAVEYVEDIYNFYKLTEGESRVDDDYMNFQPDLNHKMRAILVDWLIEVHRKFELMPESLYLTITILDRFLSLKTVPRKELQLVGISSMLIACKYEEIWAPEVNDFIHISDNAYAREQILQMEKAILGKLEWYLTVPTPYVFLVRYIKAATPSDNQEMENMTFFFAELGLMNYKITISYRPSMLAASSVYAARSTLNKTPLWTQTLQHHTGYSEDQLMECAKILVSYHLDAAESKLKAIYRKFSSPDRGAVAFFPPARNLLPTTTTDAASSSS

SEQ ID NO: 14489 - protein, 358 aa, Staphylococcus epidermidis ATCC 12228
MSEKVKFEKRESLKEKPDTANLGFGQYFTDYMLSVDYDADQGWHDMKIVPYAPFEISPAAQGLHYGQAVFEGLKAYKHNGEVVLFRPDQNFKRINNSLARLEMPEVDEEALLEGLKQLIDVERDWVPEGEGQSLYIRPFVFATEGVLGVRSSHQYKLLIILSPSGAYYGGDTLKSTKIYVEDEYVRAVRGGVGFAKVAGNYAASLLAQTNANKLGYDQVLWLDGVEQKYVEEVGSMNIFFVENGKVVTPALNGSILPGITRKSIIQLAEDLGYEVEERRVSIEELFNAYDKGELTEVFGSGTAAVISPVGTLRYEDREIVINNNEPGKITQKLYDTYTGIQSGKLEDKYGWRVEVPKY

SEQ ID NO: 14490 - protein, 386 aa, Zea mays
RLGKMIALGVASYDGEKWAKHRRILNPAFHLEKLKRMQPAFLTCCTELIDRWDKEVAGGSDGSFELDVWPQFQSLTGHVISRAAFGSSFMEGRRIFQLQAEQAERVIKAFQYIYIPGFVFFPTPNNRRMKEINREIEATLRGMIDKRERAIENGEASGDDLLGLLLQSNLESGKGGLRMSTEDVVEECKLFYFAGMETTSVLLTWTLVILGMHPEWQDRAREEVFSVFGRDKRPDFDGISRLKTVTMILYEVLRLYPPAVTLNRRTFKDMQIGGITYPAGVILELPVIVVHHDPDVWGKDAHEFRPERFAEGISKATKDQQPAFFPFGWGPRICIGQNFALLEAKMALSMILQRFQFRLSPSYTHAPYTVLLLHPQHGAPIIFDRI

SEQ ID NO: 14491 - protein, 233 aa, Chlamydophila abortus S26/3
MKKDPYLEVKKQLALEAANLVEPGMLLGLGSGSTSREFIKAVAHKHKQENLDIRAVASSKESHSLAKSLGIPLVDDEEFTEIDLAVDGADEIDPQLRMIKGGGGAIFREKILLQSSRRRLILADESKHVQVLGKFGLPIEISPFGRSSIIATLKNLGYLGNLRKNSHGGFFITNNRNYIYDIHTPNVYPHPEEDLLKLLQIHGIIEVGFVIASVEVWFGYANGQIGKKNTGRV

SEQ ID NO: 14492 - protein, 182 aa, Coprinopsis cinerea okayama7#130
MPHNELLTLSSLKELVNLNGLYLAGFGWLFGMCVIAFRTLPRQQFGALQHKTFPVYFTQSIALSAALLSIWISKHPSVLANLHQPRLADVAQAYALATVILAQGSNLFVVGPWTSKVMFKRHKLEKEEGVQYNDPKASAQMKALTKQFGALHGVSSLFNLLAVIALGLHGLWLGNATSLSNI

SEQ ID NO: 14493 - protein, 76 aa, Glycine max
MSTKVKGILKGLRYISQIFEEKEEEFQIGLPTDVKHVAHIGSDDPSANAPSWMTDLKEEKNPHQETLLKQLKNVRK

SEQ ID NO: 14494 - protein, 612 aa, Arabidopsis thaliana
MASLSGLYSSSPSLKPAKNHSFKGIAGAISRFLLFPTYLQTHQSTLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQLSLRLGPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAHLQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHPYIQQLRDGVHNFFATFIEVLRYRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYA

SEQ ID NO: 14495 - protein, 680 aa, Burkholderia xenovorans LB400
MDHSSTSSAIMSAPAPAASRFAPGRSRDIVCLGRLAVDLYAQQVGARLEDVSSFAKYLGGSSANIAFGCARLGLASSMLARVGNDHMGRFLTETLTKEGCDVSHVRIDRERLTALVLLGLKDRDTFPLIFYRENCADMAVDEADFDEAFIASSKALLITGTHFSTEQVNRTSRRALDYARRNQVRTVLDIDYRPVLWGLTGKADGETRFVASEGVTAHLQRILPLFDLVIGTEEEFRIAGGKTELVDALAMVRAVTPATLVLKRGPLGCQIIDGQVPASLDNVPIHGGVEVEVLNVLGAGDAFASGFLSGWLRDQPLEACARAANASGALVVSRHGCAPAMPTPAELDYFLREAKADPQRMRRPDRDAALARLHRVSPARKQWDEVLGFAFDHRNQFFELAQQTGADEARIARLKGLFVEAVAQTESALGLQNRIGVLIDDRYGQDALNAATGRGWWIGRPVELPGSVPLVFDHGRSIGTTLIPWPQEHIAKCLVQFHPDEPIEQRLEQEAQLRALYDATQASGHELLLEVIPPKHAHLPQAPDVVYRALKRLYNIGIYPEWWKLEPMDAAQWRSVDALIAERDPYCRGVVLLGLSAGVEQLNEGFRAAAQSATCRGFTVGRTIFHEPSHAWLAGEIGDDELIARVRRTFETLIASWRATRGAGAAQPGTPNPVHQEQAA

SEQ ID NO: 14496 - protein, 174 aa, Mesorhizobium sp. BNC1
MENSTPPAVIMGVAGSGKTVIGSALAEALGVAFIEGDDLHPPENVAKMASGQPLTDEDRIGWLDAVGRAIAENRRPAGGAVTACSALKRSYRDQLRRLNPSLVFIYLAINPDTARIRVTNRKGHFMPPTLVASQFAALEQPGDDEAAFTLNGLSPIDELVEAAAELLRKQSGAS

SEQ ID NO: 14497 - protein, 899 aa, Photobacterium sp. SKA34
MISQGIKSACPYCGVGCGVVTKQSEIIGDVSHPTNRGALCVKGSSLAASMSQPNRLLYPQIKGEVVEWAQATTQIAETISRVIAESGPEAIGMYLSGQLLTEDYYVANKLMKGFIGSSHVDTNSRLCMSSAVAAHNRAFGEDIVATNYSDLDSTDLIVLVGSNLAWTHPIVFKRIQQAKTQNPSLKIVVIDPRKTVTAEQADLHLALANDTDIHIYNGLIRYFIENNAVDSDFIVQVTEGFDALQQEVMKDKYTLLEVSKSSGIAIEQLATFYQWMKEAPRAVTVFCQGVNQASCGTDKANSIINSHLVSGKIAKQGCGPFSITGQPNAMGGREVGGLANQLAVHRGFDDNSISQVKAFWQAPNIATKAGHKAVDLFKSVESGDIRILWIMATNPMISMPDSEQIRRALEKCEYVIVSDITPESDTAAYADCLLPAAAWGEKSGMVTNSERMMSRQRAFTAMPGEVKADWQIICDVAKQLGFSKAFKYQSEADIFREHAALSGINNSTDLLFDISCLALLSDDDYQTWQPQQWPLNPNGNRVFEQHNNLPLFSTPTRKAQLVVTPSPSENTSSNVMLAQDGPQSIFWLNTGRQRDQWHTMTRTGHVPALAQSEAEPSLYIHPTSAKHVGLVDGDFVCIESLESYQDLNKHLARVVFDSTLSQQQVFMSMHWAGKYGAKSAINQSVIVACDPISGQPSFKSAQVKLTPISMEFYGVSLGDIPAQLDYEYASFQTYKNEHYQQKGIWRYAGKACLDKTALLRSLSESKQQYLLVEQKWGFALVQLAKVINPDVKLNTTALHLFSDQPINVDMTTLINCVNQPFVMTDVLEALGCQHSKQTLVCSCFQITDLMIEQAIVINNITSLSDLTKQLKCGTNCGTCLPQVERHFSESQQLIPTVQL

SEQ ID NO: 14498 - protein, 247 aa, Coccidioides immitis RS
MSFVMHEVVYFGRSLPWIIIDRIKYFNRWKIQHNKIPTIQEQWNCAKLVLLSHFTVELPQIWLFHPMAQYFGLATGVPFPSIWKMMYQIAIFFVLEDTWHYFSHRAFHWGPLYKSVHKIHHQYSAPFGLAAEYASPIEVMALGFGTVGCPILWCAFTGDLHILTMYIWIVLRLFQAIDAHSGYEFPWSLHHFLPFWAGADHHDLHHEKFVGNYSSSFRWWDYLLDTEYSPEAVQRRREKSKVAKKTE

SEQ ID NO: 14499 - protein, 593 aa, Prunus persica
SVYWPGPGLSVYQNGRTDYNSSRIAVFDEMGNFVSSDDLIFSASDMGARVKRRLTTDYDGNLRLYSLNSTGSWVITWEALAQQCRVHGICGRNGICVYTPELKCSCLPGYEAVDTSNWNKGCKPKFKPTCSQSQRVKFKQIQYVDFYGFDLNYSESTSIQNCTKLCVEDCRCEAFVYRGQKCYTKGALFSGLRSPTIEGSLYLRLPEPLSMETSPAANLTVFNSCRTNAVKIGTSSMYDNPSKTVRWVYLYSFAAAIGAVEFLFILSGWWFFFRRSQGMSAPLVDKYRLISSNFRMYLYAELKKATRNFKEELGRGGSGTVYKGVLADERVIAVKALADIYQAEEVFWAEVSTIEKINHMNLVRTWGFCSEGKHRLLISEYVENGSLDKHLFPPNFLGWKERFKVAIGIAKGLAYLHHECLEWVIHCDVKPENILLDSNFEPKIADFGLAKLFQRGGLNAVSSHIRGTKGYMAPEWALNLSITAKVDVYSYGVVLLEIVKGIRLSNRVVDTAEEEEAEMKRFVRIARRKIQCGEDEWIEDMLDPRLEGQFGRNQAAKMVEVGISCVEEDRNKRPTMDSVVQMLLECEEESNIQ

SEQ ID NO: 14500 - protein, 661 aa, Neurospora crassa
MPPRRAKKEAAAPAKLPLEDCRIVFSGTFVGGQDQHKKTAESLGANTTGTTIVQSVTHVIYSDKSTDKISAKVKQAHGMSIPVVSIDWLLKTKETNTRHPEKDYALDLSSLDAASDTSVADADTTSQTNGDDTRGTKRKRSPSPAQDGAKADGEEEDTLKRSKLETKRAMGEGQILKDKTVQIPVDAGAPYGFAVHSSGWCAVWTRWGRVGESGQHALIDCQSLQDALQTFEKKFKDKSGLLWSNRGDNPKPKKYAFVEVNYKDESDDEEEAEGSAATKEEKEDQKPLICTLHPSVAKLMELIFNQQLMDNTMAALKYDRNKLPLGKLSKATIMRGFQALKNLSELFADPAKASQYGLPYQQAVEHLSNTYYSVIPHAFGRERPPVIAADEQLKQEIELLENLSDLKEASNIMKVDKTKFDVHPLDRQYQGLKMQEMTPLDRASTEFAQLADYLVETRGNTHGLNYQVEEIFRIERQGEFDRFDQSDYADGKMKLKKNRKLLWHGSRSTNFGGILSQGLRIAPPEAPVNGYMFGKGVYLADMSSKSAGYCCAYMSNGTALLLLCEAELGDPIQELTGADYNAGEHAKQKGMLSTWGKGGTGPLKWKDAGAVNPALQGVMMPDTSVKPGNTNVPGCSLLYNEYIAYDVAQIRLRYLFRVKIA

SEQ ID NO: 14501 - protein, 279 aa, Ralstonia metallidurans CH34
MHGSPLARSPSHLHRLSSASAFTPSAVAEGVFLELRPSGHLCHTDDPRRGEGHNPHRHHPDPVHHPVPARPPGGHRGVSGLLNVIATACKVIATAASRGALAGVLGSAEHENVQGEVQKKLDVISNAILVHATERGGHLVALASEEMDTIYPIPAAFPRGKYLLVFDPLDGSSNIDANISVGAIFSVLRSPDPEVPPTLEHFLQAGAGQVCAGYALYGPATMLVLTTGQGTHGFTLDRDVGEFILTHPMLRIPAATQEFAINTSRGLLVFSAISDGTQS

SEQ ID NO: 14502 - protein, 207 aa, Arabidopsis thaliana
MASVSPLAKYKLVFLGDQSVGKTSIITRFMYDKFDTTYQATIGIDFLSKTMYLEDRTVRLQLWDTAGQERFRSLIPSYIRDSSVAVVVYDVANRLSFLNTSKWIEEVRNERAGDVIIVLVGNKTDLVEKRQVSIEEGDSKGREYGVMFIETSAKAGFNIKPLFRKIAAALPGMESYSNTKNEDMVDVNLKPTSNSSQGDQQGGACSC

SEQ ID NO: 14503 - protein, 86 aa, Anabaena variabilis
  misc_feature (71)..(72): Xaa can be any naturally occurring amino acid
ADSVNGAKIFSANCASCHAGGKNLGVAQKTLKKADLEKYGAYSAMAIGAQVTNGKNAMPAFKGRLKPEEIXXVAAYVLGKAEAEWK

SEQ ID NO: 14504 - protein, 531 aa, Candida albicans SC5314
MTLTTLPQNAKVAVLGAGISGLTFTYFLSKLRPDLQFTIFEKSKRPGGWMSSPKLHVNNTNESILFEKGPRTLRGVKDGTLLMLDILRKLDLDSQIEVINEKCNANKKYILDSSGEIIQVPNSIGTTIEFLKNVKCVDRKLITGILKEPFVKPIKEDETIEQFFKRRLGSTVLTDNVASSIIHGIYAGDVGKLSIKSIMSFMKDIENQSGSIVKHIFKSLYSNKKKEEPQLSQELQIYNQLMSPKAELLTLQKTLKQYPMIKLHDGMETLPKYLAEYLINNTNTKIKYNTSIQDIDAVTGKINGESYDHIRSTINTHDLAKTLPTTDPLVPELKSIEYVSIFLTNVYSRSSNLIPKGKPGFGFLSPRYGNVWKNPDALLGTIYDSDIENNVEGLFVDTKPVHNPNNKITIMMGGHYYTNWTIPSNSVNLKIVKDVLTSKLKVDLSKFNLKVIKDGEPLQIDEINDNDLVISYSFHSNCIPQYNLGYQETKDKVNQLLDKGYKLSFGGTVFADGVGVPDCVLNGFKDALKLK

SEQ ID NO: 14505 - protein, 762 aa, Bacteroides fragilis YCH46
MAKITKEAALLYHSQGKPGKIEVVPTKPYSTQTDLSLAYSPGVAEPCLEIEKNPQDAYKYTAKGNLVAVISNGTAVLGLGDIGALSGKPVMEGKGLLFKIYAGIDVFDIEVNEKDPDKFIEAVKAIAPTFGGINLEDIKAPECFEIERRLKEELDIPVMHDDQHGTAIISSAGLVNALQVAGKKIEDVKIVVNGAGASAVSCTKLYVSLGARLENIVMLDSKGVISKARTDLNEQKRYFATDRTDIHTLAEAIKDADVFLGLSKGNTLSQDMVRSMAPMPIVFALANPTPEISYEDAMAARPDVLMATGRSDYPNQINNVIGFPYIFRGALDTQAKAINEEMKIAAVHAIANLAKQPVPDVVNEAYHVNNFTFGPEYFIPKPVDPRLITEVSIAVARAAMESGVARKNIENWDDYKTHLRELMGQESQLTRQLYDTARRNPQRVVFAEGGHPNMLKAAVEAKSEGICHPIILGNEERIEKLAKELDLSLDGIEIINLRHDREAERRERYAHILSQKRAREGATYEEANDKMFERNYFGMMMVETGDADAFITGLYTKYSNTIKVAKEVIGIRPEYKHFGTMHILNSKKGTYFLADTLINRHPDTSTLIDIAKLADQTVRFFNHTPVISMLSYSNFGSDQAGSPLKVHEAVAYMQQEYPELAIDGEMQVNFAMNRELRDSKYPFTRLNGKDVNTLVFPNLSSANAGYQLLQAMDPDTEFIGPIQMGLNKPIHFTDIESSVRDIVNITAVAVIDAIVEKKKANK

SEQ ID NO: 14506 - protein, 444 aa, Bacteroides fragilis YCH46
MNAAKVLEDLKRRFPNEPEYHQAVEEVLSTIEEEYNKHPEFDKANLIERLCIPDRVYQFRVTWVDDKGNVQTNMGYRVQHNNAIGPYKGGIRFHASVNLGILKFLAFEQTFKNSLTTLPMGGGKGGSDFSPRGKSNAEVMRFTQAFMLELWRHIGPETDVPAGDIGVGGREVGFMFGMYKKLSHEFTGTFTGKGREFGGSLIRPEATGYGNIYFLMEMLKTKGTDLKGKVCLISGSGNVAQYTAEKVLELGGKVVTMSDSDGYIYDPDGIDRAKLDYIMELKNLYRGRIREYAETYGCKYVEGARPWGEKGDIALPSATQNELNGDDARKLVANGVIAVSEGANMPSTPEAIKVFQDAKILYAPGKAANAGGVSVSGLEMTQNSIKLSWSSEEVDEKLKSIMKNIHEACVQYGTEPDGYVNYVKGANVAGFMKVAKAMMAQGIV

SEQ ID NO: 14507 - protein, 590 aa, Coprinopsis cinerea okayama7#130
MPLVIEPSSPASDSGNATYISNVSSVDSEKTIREDDKTQLAALLNNMNALMSSDRLPVSASETSMAVNDLSSSDESDYEGSGGTWIKPYQDRPPSARPELTKLRTDLPSTPDPADKVREERPNPSASQSQGYQNGGPSSQYQLPPPQRFPPGNQQHRDHRVSGFADGDDDWAPRPPPEDVYDRLEEFFPEHDLDKLVIEANSGGNSPTNPEPTTAIPTPVSANATVIMPQHPHRRHKKSIRIVAQEQKRKMNDQTSRVDPAPYGQNAMLRKRNTKMWGSKLEEVTTMQVRTSSTIPESPSSAGSPPTFKWVRGELIGKGTYGRVYLALNATTGEMIAVKQVELPQTPSDRNDSRQNTVVQALKLESETLKDLDHPHIVQYLGFEETPANLSIFLEYVPGGSIGSCLHKHGKFSENVTKSFTGQILSGLEYLHSKGILHRDLKADNILVEMTGICKISDFGISKRTDDLHGGAFTAMQGTVFWMAPEVINTQKKGYNFKIDIWSVGCVVLEMWGGRRPWTGQEMVTVMFKLYEAKLPPPVPDDVVLSELGDDFRRKCFAINPDERPPAAELRLHPYLELPPGWTFTSFTSD

SEQ ID NO: 14508 - protein, 722 aa, Candidatus Kuenenia stuttgartiensis
MNEITHMTEWPGKAYPLGATWDGAGVNFSLFSENATGVELCLFDGQDGNHEVARIRMAHHTDQVWHTYLPTVRPGQLYGYRVYGPYEPKSGHRFNPAKLLLDPYAKAISGTICWSDALFGYTPGHKEADLSKDDGDSAPNIPRCVVVDPAFTWGDDVSPGTPWHKTLIYELHVKGFTKQHPGVPKELQGTYAGLTCHAVIDYLHSLKITAVELMPVHHFVDEKDLIGRGLSNYWGYNSIGFFAPAARYSGSGIMGEQVNEFKTMVKTFHREGIEVILDVVYNHTAEGNHLGPTLSFRGIDNANYYHLASDNKRYYVDYTGCGNMPNMIHPRVLQLIMDSLRYWVLEMHVDGFRFDMASALARELHEVDRLGAFFDIIHQDPVLSQVKLIAEPWDLGPGGYQVGNFPILWTEWNGKYRDTVRQFWHGDKGVAGNLAYRLTGSSDLYEHGGRRPYASINFITAHDGFCLHDLVSYNEKHNEANGEGNKDGTDYNLSWNCGIEGPTDNQEVAKLRERQKRNFIATLILSQGVPMLLAGDEIGRTQKGNNNAYCQDNEISWIDWDLDKPRQELLEFTRLLTQLRHQHPVMRRRHFFQGRKITGSEVKDLTWFRPDGKEMTDEDWNNPSTHSLALCLAGYAIEEVDERGKQIVDDTLLILMNVHHESISFVLPAHNPKIQWKTLIDTREATGKRSIQLMKGGELYSLEARSLVLLQLVEERRSSPLA

SEQ ID NO: 14509 - protein, 365 aa, Ralstonia metallidurans CH34
MPLSHRQTLTRYLIEERRRFPEASGELNALILDVALACKALARVVSFGELGDALSDGSAAPTGGGINVQGEVQKPLDVQSNEMFIRMNEWNGQLAGMASEEMEEPYLIPSSYPRGKYLLVFDPLDGSSNIDVNVSIGSIFSILRAPADVVASGRDVTEADFLQPGAAQVAAGYTIYGPTTQLVLTVGNGVAAFTLDPNLGEFLLTRSDIRVPEQTQEFAINSSNSRFWEPPVKRYVDECLAGKTGPRGKDFNMRWVASMVAEAHRILMRGGVFMYPRDTKDPAKPGRLRLLYEANPVAMLMEQAGGRASTGREPILGVSPTALHQRIGLIFGSKDEVERIERYHQEPASNEAAAPLFAERSLFRD

SEQ ID NO: 14510 - protein, 429 aa, Listeria monocytogenes str. 1/2a F6854
MQNYSKSEKAFKEAKKVLPGGVNSPVRAFNSVDASPVFMDHGKGAYITDVDGNEYIDYVLSWGPLILGHADPAVVNAITKAALKGTSFGTPTEIETELAKLVIERVPSIEIVRMVSSGTEATMSAIRLARGYTKREKILKFEGSYHGHGDSLLIKAGSGVATLGLPDSPGVTKGLAADTITVPYNDIEGAKLAFEKYGEEIAAVIVEPVAGNMGVVPPIEGFLEGLRELTTKFGSLLIFDEVMTGFRVDYYSAQGYYVVTPDLTCLGKVIGGGLPVGAYGGKKEIMEQIAPAGSIYQAGTLSGNPLAMNAGFETVRQLTPQHYDVFRTLIKRMEEGLTEISARRQVPLSINKAGSMFGFFFTDQKVINFDTAKTSNLEFFRNYYREMLGQGIFLPPSQFEGVFISTMHTENEIDKTLEAFDTTCKILRG

SEQ ID NO: 14511 - protein, 684 aa, Ralstonia metallidurans CH34
MASTSADRVLRPESGRYDELANALRALAMDAVQQANSGHPGAPMGMAEMAVALWSGHLRHNPGNPGWPDRDRFVLSNGHASMLLYALLHLSGYDLPIEELQRFRQLHSKTPGHPEVGLTPGVETTTGPLGQGLANAVGMALAGKLLGDEFNRPGHVVVDHHTYVFLGDGCLMEGISHEVCSLAGVWRLNKLIALYDDNGISIDGAVDAWFRDDTAARFRAYGWNVIGPIDGHDVVAIGRSIADARRSADRPTLIVCRTTIGRGSPGRAGTAKAHGEPLGADEIAATRAAIGWHEAPFEIPDTVRARWSARDLGARREAQWRLGFEAYRSEYPALAAEFERRIAGDLPSSFHEAASAAMIELGQATTPVASRKASQQALAMLAPKIPEMLGGSADLTGSNLTDFPGCGAVRAGQPGGRHVNYGVREFGMAAIMNGLALHGGFIPYGGTFLTFSDYSRNGIRMAALMKLRVVHVFTHDSIGLGEDGPTHQAVEHAASLRLIPNLDVWRPCDAAETAVAWAFALEQRTRPSALLLSRQNLPPQARTAEQVAQIRRGGYVLSDRPEPQVVLIGTGSEVSIAMEAQRLLDAVGIAARVVSLPCSTLFDRQEAAWHEQVLGRGIPRIGVEAGVTSWWGQYHCVAALGVNSFGESAPGPQVYEHFGLDAKALADLAREVLAREVRFVRSRS

SEQ ID NO: 14512 - protein, 335 aa, Ralstonia metallidurans CH34
MTIRIGINGFGRIGRMVFRAAVQDFKNDIEVVAINDLLEPDYLAYMLRYDSVHGRFKGEVVVDGGTLVVNGRKIRLTAVKDPAALAWGDVGVDVVVESTGLFLTHDTCQKHLDAGARKVIQSAPSKDDTPMFVYGVNHTQYAGEKIVSNASCTTNCLAPVAKVLNDSFGIKRGMMTTVHAATATQKTVDGPSNKDWRGGRGILENIIPSSTGAAKAMGRVIPALNNKLTGMALRVPTSDVSVVDLTVELAQETSYEKICAAMKAASQGAMKGVLGYTQDKVVSTDFRGEACTAVFDAEAGIMLDSTFVKVVAWYDNEWGYSSKVLEMVRVMGASR

SEQ ID NO: 14513 - protein, 219 aa, Shewanella sp. ANA-3
MTTGTTSSCCQGPASAELVNSLDWEKQQGLIPAVIQNHLSGKVLMLGFMDKAALQHTLATGDVTFFSRSKQRLWTKGETSGHTLKLVAIDKDCDNDSLLVQVLPNGPTCHKGTESCWLDGNAHPFLNNLAELIASRKGQNPESSYTASLFARGTKRIAQKVGEEGLETALAAATHDKDELINEASDLVYHLLVLLEDQSLSLSDINANLLARHQKAQQK

SEQ ID NO: 14514 - protein, 396 aa, Ralstonia metallidurans CH34
MNVLRFADLVAQGRVCGQRVFIRADLNVPQDDAGNITEDTRIRASVLCIRMALDAGAAVMVTSHLGRPTEGEFKPEDSLAPVAARLAALLGRPVPLKSNWVGGVDVQPGEVVLLENCRLNKGEKKNSEALARQMAALTDIFVHDAFGTAHRAEASTYGIAQFAPVACAGPLLAAEIDAIGKALAAPKRPLVAIVAGSKVSTKLTILQSLAKNVDGLIVGGGIANTFLLAQGLPIGKSLAEPDLVDEARAVIDAMKARGAEVPIPVDVVCAKAFKADAPATVKAVAEVDDDDLILDIGPQTATLLAHKLAAAGTIVWNGPVGVFEFDAFANGTKTIARAIAASDAFSIAGGGDTLAAIAKYGIDKDVGYISTGGGAFLEVLEGKTLPAFEILARRAQ

SEQ ID NO: 14515 - protein, 348 aa, Arabidopsis thaliana
MEKPKFKTVQEVVAAGEGIPERYLQPPAVDDNGQHLNAAVPVMDIPAIDLSLLLSPSDDGREELSKLHSALSTWGVVQVINHGITKALLDKIYKLTKEFCALPSEEKQKYAREIGSIQGYGNDMILWDDQVLDWIDRLYITTYPEDQRQLNFWPEVPVGFRETLHEYTMKQRIVIEQFFKAMARSLELEENSFLDMYGESATLDTRFNMYPPCPRPDKVIGVKPHADGSAITLLLPDKDVEGLQFLKDGKWYKAPIVPDTILINVGDQMEIMSNGIYKSPVHRVVTNREKERISVATFCIPGADKEIQPVDGLVSEARPRLYKTVKKYVDLYYKYYQQGRRPIEAALI

SEQ ID NO: 14516 - protein, 363 aa, Shewanella sp. ANA-3
MNPVFTPNVAQKILFIDRDGTLIEEPITDKQVDSLAKLVFEPQVIPALLRLQKAGFRLVMVSNQDGLGTPSFPQEDFDAPHNMMMQILSSQGVKFEDVLICPHFNDENCSCRKPKLGLVKDFLTQGTIDFTQSAVIGDRHTDVELGNAMGIKSFQYQRGSLGWDAIADALLNKGRTATVVRTTKETDIRVTVDLDNPSKGAINTGIGFFDHMLDQIATHGNFKMEVNVDGDLEIDDHHSVEDTALAIGDALRQALGDKRGIARFGFSLPMDEAKGECLLDLSGRPFIKFAAQFEREKVGEMATEMVPHFFRSFADGLRCTLHVAAEGDNDHHKVEALFKVLGRALRQAVKVEGDVLPSSKGVL

SEQ ID NO: 14517 - protein, 112 aa, Oryza sativa (japonica cultivar-group)
MGKLYGLFWVMALVLATVAGTKSDEGCSRDLQDLIMECQKYVMNPANPKIEPSNACCSVIQKANVPCLCSKVTKEIEKIVCMEKVVYVADYCKKPLQPGSKCGSYTIPSLQQ

SEQ ID NO: 14518 - protein, 791 aa, Streptomyces avermitilis MA-4680
MSACVPTRAADSNRTKRIHQPHSPPPPQPRRFRIAGADWSASIAVFLIALPLSLGIALATGAPLQSGLVAAAVGGLLAGRLGGSPLQVSGPAAGLTVVTAELIHRYGWRTTCAITVLAGVAQLGLGCLRVARTALAVSPAIVHGMLAGIGVTIAVAQLHIVLGGTPQSSVLANLHALPAQLAHLQPAAVSMSALTLALLLAWPRLPGRVGRLLRTIPAALVAVAGATTAASLAALSLPKVDLPSWRSHALASLPEGPVLGIAAAVLTTTLVCSVQSLLGAVAVDKLTAGRPLPNRRSDLDRELLGQGTANIVSGALGGLPVAGVAVRTSANVRAGAVSRNSTMLHGVWVVVAALLMVPILELIPLASLAALVMAVGIQMVSLHHIRTVTRHREVLVYAVTTLGVVLLGVLEGVTLGVAVAVAVALNRLARTRITHDEQEGVHYVQVRGQLTFLAVPRLSRALHLVPHGADAVVELDGSFMDHAAYESLQDWQTAHTAQGGSVEFTGRAGTRISLPAMEAPAAERSTGLGEASACRCRPWTPWRNHQCARPQPAPPGEDPDESAATGPSGHQLARGISAFQRNTAPLVRGELARLAREGQRPSQLFLTCADSRLVTSMITSSGPGDLFVVRNVGNLVPPPGEESGDDSVAAAIEYAVDVLEVRSITVCGHSGCGAMQALLSSDPGSSQTPLKRWLRYGLPSLERMAAEDRARLAGRAAADAVEELCLTNVVQQLAHLRAHESVARALREGALELHGMYFHVGEAQAYLLSEDPAADGVFARVTETARDDMPA

SEQ ID NO: 14519 - protein, 244 aa, Glycine max
HITSSTIPWQTGFDSLGGTRAQSQYAMAYYVINYSTLRILEFVEYSKMIYLDGDIHVFDNIDHLFDLPDNYFYAVMDCFCEPTWGHTKQYQIGYCQQCPHKVQWPTHFGPKPPLYFNAGIFVYEPNLATYRDLLQTVQVTQPTSFAEQDFLNMYFKDKYRPIPNVYNLVLAMLWRHPENVELDKVKVVHYCAAGSKPWRYTGKEENMEREDIKMLVKKWWDIYEDETLDYNNPLNVDKFTAALM

SEQ ID NO: 14520 - protein, 508 aa, Coprinopsis cinerea okayama7#130
MIVSGKLDLANANLGDLQASACPTSDPTFQWIRGELLGKGSYGRVYLALNATTGEVMAVKQVELPKTPSDKMKPQQLDVMKALKFEGDTLKDLDHPNIVSYLGFEESQDYLSIFLEYVPGGTVGSLLVKNGRLREEVTKSWLRQILQGLDYLHGKGILHRDLKADNILVDHSGVCKISDFGISKKAGEINRAKAHTGMKGTSFWMAPEILSPGEKGYDVKVDIWSVGCVAVEMWTGKRPWYGHEWWPVLMKVAEDKSPPPIPEDIPMGHLAQSFHNQCFRPDPADRPHASVMLKHPYLEIQSPWVFNWDDLADNSRPPRIYPELVPPVVRERTVTQSTFKANGPPTEKPRAHKPPLEPLKIPAYGPTSTQRKPSVNGAGPPVVWITPPNTPRRTAKPEDSSASTSTSDAAPWKSTSKRRLVIVNPDLDDDIGPAPQNTPPKPKFVYTPPPLPDPPQPPTFFHADTPKATPEPLVSSPRSVPCTPPRLALPFKAKGIQPRQITHGTYYL

SEQ ID NO: 14521 - protein, 558 aa, Coprinopsis cinerea okayama7#130
MAETWFQREFLQARRLTFNVLFYGLHLAIFAYGWYSQATNQRLAGLNTLQWSVWVSRGAGLVLALDGGLILIPMLRNIIRVVRPKLTWLFPADENIWFHRQVAYSMAFWSVVHTTAHYVNFINVERTQIRKQTAQMIHYTQPGGITGHFMLLIMVVMYTTAHQKIRKQCFEAFWYTHHLAFFFMLGLYTHATGCFVRDSVHPNLTSTFPFYSTENCIGYLSWRFIIWPGIIYFGERVWREIRARRATRLSKVLVHPSGAMELRIVKPSFKYTAGQWLFLQVPELSRFQWHPFTITSAPEDPYVSVHIRQVGDFTNALGERLGVGPAAVASMTKAAVKGAEKDGPSLSRGDFVEIDPATMSITLPQVRIDGPYGAPAEDVFNNEVAVLVGAGIGVTPFASILKHIWYRQKKGKLGSLRRVEFFWVCRDAPSFGWFQSLLQEVEAAQADPNFLRINIYLTQKINEDMLWNIAVNDAGADYDPLTLLRSRTMFGRPDWNSIYSRIRQAVEGGQYIPGATAQLKTKVGTYFCGPSVLAKAIKEATIKNTNANVEFSFAKEHF

SEQ ID NO: 14522 - protein, 389 aa, Salmonella enterica subsp. enterica serovar Typhi str. CT18
MTDTTILQNNTHVIKPKKSVALSGVPAGNTALCTVGKSGNDLHYRGYDILDLAEHCEFEEVAHLLIHGKLPTRDELNAYKSKLKALRGLPANVRTVLEALPAASHPMDVMRTGVSALGCTLPEKEGHTVSGARDIADKLLASLSSILLYWYHYSHNGERIQPETDDDSIGGHFLHLLHGEKPTQSWEKAMHISLVLYAEHEFNASTFTSRVIAGTGSDVYSAIIGAIGALRGPKHGGANEVSLEIQQRYETPDEAEADIRKRVENKEVVIGFGHPVYTIADPRHQVIKRVAKQLSEEGGSLKMYHIADRLETVMWETKKMFPNLDWFSAVSYNMMGVPTEMFTPLFVIARVTGWAAHIIEQRQDNKIIRPSANYTGPEDRVFVPIEKRC

SEQ ID NO: 14523 - protein, 929 aa, Mycobacterium avium subsp. paratuberculosis K-10
MTTEFVRHDLATNPTGPAEPDRVRVIREGVASYLPDIDPEETSEWLESFDELLERSGPSRARYLMLRLLERAGEQRVALPSLTSTDYVNTIPTELEPWFPGDEDVERRYRAWIRWNAAIMVHRAQRPGVGVGGHISTYASSAALYEVGFNHFFRGKSHPGGGDQIFIQGHASPGIYARAFLEGRLTADQLDGFRQEHSHAGGGLPSYPHPRLMPDFWEFPTVSMGLGPLNAIYQARFNHYLHDRGIKDTSDQHVWCFLGDGEMDEPESRGLIQVAANEALDNLTFVINCNLQRLDGPVRGNGKIIQELESFFRGAGWNVIKVVWGREWDALLHADRDGALVNLMNTTPDGDYQTYKANDGAYVRDHFFGRDPRTKALVENMTDAEIWNLKRGGHDYRKVYAAYRAAVDHKGQPTVILAKTIKGYSLGAHFQGRNATHQMKKLALEDLKHFRDAMRIPISDAQLDENPYLPPYYHPGSDAPEIRYMLDRRRTLGGFLPERRTKAKALRLPGRDIYAALKKGSGTQEVATTMATVRTFKEVLRDKEIGPRIVPIIPDEARTFGMDSWFPSLKIYNRNGQLYTAVDAELMLAYKESEVGQILHEGINEAGSVGSFIAAGTSYATHNEPMIPIYIFYSMFGFQRTGDGLWAAADQMTRGFLLGATAGRTTLTGEGLQHADGHSLLLAATNPAVVAYDPAFAYEIAYIVESGLARMFGENPEDVYFYITVYNEPYVQPPEPENFDPEGLLRGLYRYHVATEQRANKAQILASGVAMPSALNAAKMLADEWDVAADVWSVTSWGELNRDGVAIDRARLRHPDRPAGVPYVTQALSDASGPVVAVSDWMRAVPEQIRPWVPGTYVTLGTDGFGFSDTRPAARRYFNTDAESQVVAVLEALARDGEIDPSVPVAAARQYRIDDVLAAPEQTSDPGVA

SEQ ID NO: 14524 - protein, 433 aa, Pseudomonas syringae
MSGMAGWVDLRHGVGQQANLPHSKVTKVILDMIAAMAGRGPDGQAVWLGPDLALGHCSTVASRYDFNEQPWIGEIRGATVAIMYTGQIYNMWQLQQELASFGPAPDRWSYAEIIRARLWRGYGTARSALRACSLLPLDGQKRELLLARDRLGLQPLYYTLTDGGIIFASVPTAIQAHPQFTAKLDRSALAIVLQPRMAMPGETPLKGLHELPPANVLSFSKRGHTQVRYWQLESAPHTDNFEQTSDHVRALLEGVVARQFEDQVPSAAMLSGGIDSTSVAALVMKQLATRGAGPALDTFCLKFDTDEDAFTSSELRPDIDAPFAALAAEYMGTRHTTLSATMQDLLNVIPATRTARGLPGWGQFDASMYLLFERMRDNFSVALTGEAADEIFGGYPYYFKPDLLARAQFPWLGDGPKLADYLSPALITAQQVA

SEQ ID NO: 14525 - protein, 272 aa, Ralstonia metallidurans CH34
MDPTPLPPHPVRGQRRRLLVAGNWKMNGSLAGVQALAAAIADGAVARLDRVQLVLFPPFTYLPEAQRRLGASGMAWGAQNVSGHEDGAFTGEVSAQMLREFGCACVLVGHSERRTLFGENDAVVARKFLAVRQAGMTPVLCVGESLPEREQGATEDVVARQLQAVLDLAGASAFADAVVAYEPVWAIGTGKTATPAQAQDVHAFIRGRLAEADPAIAASLHVLYGGSMKRANARELLAMPDIDGGLLGGASLNVDEFMAVAITAQRLAQENT

SEQ ID NO: 14526 - protein, 219 aa, Ralstonia metallidurans CH34
MTQDEIKAMVARAALPHVLPGSIIGVGTGSTVNHFIDALSSLREGIAGAVSSSNATTARLRGHGIRVLEAGEVEQLALYVDGADEIDPHGHMIKGGGAALTREKIVADLAQRFLCIADASKKVEVLGRFPLPVEVIDVAATRIARRFAAIGGRAVLRKGVVTDNGHPILDVHGLAIADPPALEAEINQWPGVVTVGLFARHRAHACLLGTPEGVLTLQF

SEQ ID NO: 14527 - protein, 525 aa, Burkholderia xenovorans LB400
MNKKLICATPVAIAAALSLYACGGSEVTQPDITSIKTVVVIYAENRSFDNLYGNFPGANGLQNVTAASATQVDRNGTPLATLPQVWNGLTQTGVTPVVTQAMTANLPNSPFAIDDPKGFNTPITATTRDLYHRFYENQMQINGGKNDKFAAWADSGGLVMGHYTLDADKLPLWKIAQQYTLADNFFMGAFGGSFLNHQWLVCACTPTYPNADKSPAAGSISSVESDGVTLKVAGNSPASALSGPPKYVNSGNLTPDFFAINTMQPPYQPSGNKAAAGGDANLADPTQATTLPAQTQQHIGDLLNNAKVSWAWYGGAWGAAVSAAQNGTSNVIYGANLTAPNFQPHHQPFNYFADLAPGTANRSQHLLDGGLAGSEFIKAIDTGTLPQVSFYKPQGNLNEHPGYTDVASGDQHIADVISHLQKSPQWNNMLVVVTYDENGGFWDHVAPPKADRWGPGTRIPALIISPYAKKGYVDHTQYDTTSILRFITHRFSLPTLPGIAARDAALVSNGSKPMGDLTGALDIRP

SEQ ID NO: 14528 - protein, 377 aa, Arabidopsis thaliana
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDMKEKLSYIALDFEQELETSKTSSSVEKSFELPDGQVITIGAERFRCPEVLFQPSMIGMENPGIHETTYNSIMKCDVDIRKDLYGNIVLSGGTTMFGGIGDRMSKEITALAPSSMKIKVVAPPERKYSVWIGGSILASLSTFQQMWIAKAEYDESGPSIVHRKCF

SEQ ID NO: 14529 - protein, 229 aa, Silicibacter sp. TM1040
MPAGYLFDMDGLLLDTERLTLDAFLDCAPEFDLDPGEMRAFFMTLIGSARTQGEAMVRDFIGPDRDFDALDLAWQHHSQRRLAAGIPVKPTVAETISALHASGAVMAVVTSTFGDKARHHLDRAGLLRCFRTVIGGDEVPANKPDPAPYVQAAEQLGVPPQNCAAFEDSDTGITAAARAGCFAVQIPDLRPSARAFPDVGQRFATTLTEAVTTAQAHFHHERRRQGRSL

SEQ ID NO: 14530 - protein, 624 aa, Synechococcus elongatus PCC 7942
MSPTAAPQKLSKVEDLKARSQYLLEPILSQLQEESTHFNEDGIQILKFHGSYQQDNRDNRVKGQEKDFQFMLRLRSPGGYIPPQLYLTLDQLADDYGNGTLRATTRQAFQLHGILKRDLKTVIRRIVENLGSTISACGDVNRNVMAPPAPFRDRPEYEWARTYANNIADLLTPESGAYYELWLDGEKVLSGEPDPAVLAARRNPKGRVADSVEPLYSDRYLPRKFKIAVTVPGDNSIDLFTQDIGLVVIGNDRGELEGFNVYVGGGMGRTHNKEETFARLADPLGFVPAADIYAAVQAIVATQRDYGDRSNRRHARMKYLIHDWGIAKFKEAVESVFGKAIAPVRELPPFRYRDYLGWHEQGDGKWFLGLPITSGRIKDDGNWQLRSALREIVSRWQLPLLLTGSQDVLIYDVQPGDRAAIDKLLRDRGVHTVEAIDSLQRYAMACPALPTCGLAITESERALPGLLVRIRRLLEEQGLPDEHFVVRMTGCPNGCARPYMAELAFVGSAPNTYQLWLGGSPDQTRLARPFIDRLADGDVETQLRPLFVFFKQSRQAGESFGDFCDRVGFDALRQFSESYQHEAAKPRYRVGLRADVHGRLKAEADKRGVSLTDLACEAIAAYLR

SEQ ID NO: 14531 - protein, 479 aa, Escherichia coli O157:H7 EDL933
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 14532 - protein, 348 aa, Thermus thermophilus HB8
MKGLILAAGRGTRLRPLTHTRPKPAIRVAGRPIIHYAVENLLEAGVREIGVVVSPETERDLKVALEGYPVRYVLQEEPQGLAHAVDVARGFLGESPFVLYLGDNLFQKGIRRFLEAFKPGVSAVIALVRVEDPRQFGVAVLEGNRVVRLLEKPKDPPSDLAVAGVYVFSPEVLEVVRGLKPSARGEYEITDAIQGLIDRGKTVVGVEVEGWWKDTGRHQDLLDANRLLLEELTPKVEGDVVESQLTGRVVVEKGAKVVRSTVIGPAHIGAGAVVEEAFVGPFTSVGPRARVVRSEVEYSLLEEEAVVEEVRLRLQECILGVRAEVKSRDGLPRAHRLILGDLSQVELA

SEQ ID NO: 14533 - protein, 1500 aa, Oryza sativa
MEKVWESGRRMSRSIGRGMGMEAWGVDEAFMPQNSGGGGGSRGRRRSGRGGTADDDEEALRWAAIERLPTYSRMRTAILSSAEEEAAAAAAGAGKQQYKEVDVRRLGVGERQEFIERVFRVAEEDNQRFLQKLRNRIDRVGIELPTVEVRFEELMVQARCHVGSRALPTLLNTARNIAEAALGLVGVRPGRQATLTILRGVSGAVRPSRMTLLLGPPSSGKTTLLLALAGKLDPSLRRGGEVTYNGFELEEFVAQKTAAYISQTDVHVGEMTVKETLDFSARCQGVGTKYDLLTELARREKEAGIRPEPEVDLFMKATSMEGVESSLQTDYTLRILGLDICADTIVGDQMQRGISGGQKKRVTTGEMIVGPTKVLFMDEISTGLDSSTTFQIVKCLQQIVHLGEATILMSLLQPAPETFELFDDIILLSEGQIVYQGPREYVLEFFESCGFRCPERKGTADFLQEVTSKKDQEQYWADKHRPYRYISVSEFAQRFKRFHVGLQLENHLSVPFDKTRSHQAALVFSKQSVSTTELLKASFAKEWLLIKRNSFVYIFKTIQLIIVALVASTVFLRTQMHTRNLDDGFVYIGALLFSLIVNMFNGFAELSLTITRLPVFFKHRDLLFYPAWIFTLPNVILRIPFSIIESIVWVIVTYYTIGFAPEADRFFKQLLLVFLIQQMAGGLFRATAGLCRSMIIAQTGGALALLIFFVLGGFLLPKAFIPKWWIWGYWVSPLMYGYNALAVNEFYSPRWMNKFVLDNNGVPKRLGIALMEGANIFTDKNWFWIGAAGLLGFTMFFNVLFTLSLVYLNPLGKPQAVISEETAKEAEGNGDARHTVRNGSTKSNGGNHKEMREMRLSARLSNSSSNGVSRLMSIGSNEAGPRRGMVLPFTPLSMSFDDVNYYVDMPAEMKQQGVVDDRLQLLRDVTGSFRPAVLTALMGVSGAGKTTLMDVLAGRKTGGYIEGDMRISGYPKNQETFARISGYCEQNDIHSPQVTVRESLIYSAFLRLPEKIGDQEITDDIKIQFVDEVMELVELDNLKDALVGLPGITGLSTEQRKRLTIAVELVANPSIIFMDEPTSGLDARAAAIVMRTVRNTVDTGRTVVCTIHQPSIDIFEAFDELLLLKRGGQVIYSGQLGRNSQKMIEYFEAIPGVPKIKDKYNPATWMLEVSSVAAEVRLNMDFAEYYKTSDLYKQNKVLVNQLSQPEPGTSDLHFPTKYSQSTIGQFRACLWKQWLTYWRSPDYNLVRFSFTLFTALLLGTIFWKIGTKMGNANSLRMVIGAMYTAVMFIGINNCATVQPIVSIERTVFYRERAAGMYSAMPYAIAQVVMEIPYVFVQTAYYTLIVYAMMSFQWTAAKFFWFFFVSYFSFLYFTYYGMMTVAISPNHEVAAIFAAAFYSLFNLFSGFFIPRPRIPKWWIWYYWLCPLAWTVYGLIVTQYGDLEQIISVPGQSNQTISYYVTHHFGYHRKFMPVVAPVLVLFAVFFAFMYAICIKKLNFQHR

SEQ ID NO: 14534 - protein, 408 aa, Brucella melitensis 16M
MATEIRVPTLGESVTEATIGKWFKKAGEAIAVDEPLVELETDKVTVEVPAPAAGVLAEITAKEGDTVEVGELLGQISSDGAAVAAAPAQKKEEAKPAAAAPAAAPVASASSGPAMQPAPAAAKLLAESGLSADQVEGSGKRGQVLKGDVLEAITKGVSAAPAAPVAARPASSADDASREERVKMTRLRQTIARRLKDAQNTAAMLTTFNEVDMSAVMELRNKYKDVFEKKHGVKLGFMGFFTKAVTHALKEIPAVNAEIDGTDIVYKNFCHVGMAVGTDKGLVVPVIRDADQMSIAEVEKELARLARAARDGSLSMADMQGGTFTITNGGVYGSLMSTPILNAPQSGILGMHKIQERPMVVGGQIVVRPMMYLALSYDHRIVDGKEAVTFLVRVKESLEDPERLVLDL

SEQ ID NO: 14535 - protein, 324 aa, Thermus thermophilus HB8
MALMTMVQALNRALDEEMAKDPRVVVLGEDVGKRGGVFLVTEGLLQKYGPDRVMDTPLSEAAIVGAALGMAAHGLRPVAEIQFADYIFPGFDQLVSQVAKLRYRSGGQFTAPLVVRMPSGGGVRGGHHHSQSPEAHFVHTAGLKVVAVSTPYDAKGLLKAAIRDEDPVVFLEPKRLYRSVKEEVPEEDYTLPIGKAALRREGKDLTLIGYGTVMPEVLQAAAELAKAGVSAEVLDLRTLMPWDYEAVMNSVAKTGRVVLVSDAPRHASFVSEVAATIAEDLLDMLLAPPIRVTGFDTPYPYAQDKLYLPTVTRILNAAKRALDY

SEQ ID NO: 14536 - protein, 801 aa, Streptomyces avermitilis MA-4680
MAGLSTPHQFDHPTALAAAVLTDDNRVIVMVIGVVALAALVVAGILVRQVLAAGEGTDSMKKIAAAVQEGANAYLGRQMRTLGVFAVVVFFLLMLLPADDWNQRAGRSVFFLIGALFSATTGYTGMWLAVRSNVRVAAAAREATPAEGEPEKDLTAVSHKAMKIAFRTGGVVGMFTVGLGLLGASCVVLVYAADAPKVLEGFGLGAALIAMFMRVGGGIFTKAADVGADLVGKVEQGIPEDDPRNAATIADNVGDNVGDCAGMAADLFESYAVTLVAALILGKAAFGDSGLAFPLIVPAIGVLTAMIGIFAVAPRRADRSGMSAINRGFFVSAVFSLALVAVAVYVYLPGKYADLDGVTDVAIRAKDGDPRILAMVAVAIGIVLAALIQQLTGYFTETTRRPVRDIGKSSLTGAATVVLAGISVGLESAVYTALLIGLGVYGAFLLGGTSIMLALFAVALAGTGLLTTVGVIVAMDTFGPVSDNAQGIAEMSGDVTGAGAQVLTDLDAVGNTTKAITKGIAIATAVLAASALFGSYRDAITTAANDVGEKVSGAGAPMNLMMDISQPNNLVGLIAGAAVVFLFSGLAINAVSRSAGAVVYEVRRQFREHPGIMDYTEQPEYGRVVDICTKDALRELATPGLLAVLAPIAIGFTLGVGALGAYLAGAIGTGTLMAVFLANSGGAWDNAKKLVEDGHHGGKGSEAHAATVIGDTVGDPFKDTAGPAINPLLKVMNLVALLIAPAVVKFSYGEDKNLGVRIAIAVLSILVIVGAVYISKRRGIAVGDEGNAERVTKSADPAVVS

SEQ ID NO: 14537 - protein, 467 aa, Brucella melitensis 16M
MSYDVVVIGTGPGGYVAAIKAAQLGLKVAVVEKRKTFGGTCLNIGCIPSKALLHASEVFAEAGHSFDTLGVEVTPKLNLTKMLAHKDTTVKANVSGVEFLFKKNKITPYIGTGKIVGKGKVSVTSEDGKVEEIEAKNIIIATGSDVAGIPGVKVDIDEKVIVSSTGALSFDKVPGSLIVVGGGVIGLELGSVWARLGAKVTVVEYLDKVLGPMDGEVSKQFQRLLEKQGIAFKLGAKVTGVEKVGKGAKITFEPVKGGDAETLEADAVLIATGRRPYTDGLGLQEAGVAVDERGRVAIDDHWRTNVEGIYAIGDVVQGPMLAHKAEDEGIAVAEIIAGQAGHVNFDVIPSVVYTQPEVASVGKTEEELKAAGINYKVGKFPFTANGRARAMLHTGGFVKILADKATDRVLGAHILGYNAGEMIHELAVLMEFGGSSEDLARTCHAHPTMSETVRESALATFAKPIHM

SEQ ID NO: 14538 - protein, 971 aa, Oryza sativa (japonica cultivar-group)
RVHFTNSSSPPLSPSLSAFSPFPPLASRHTPLSRPPPASAAASASVRVGLAAPASVGRWARRRRRPRARGGGGGGGGASRVWWGSGGRAAVFGVAMSQTNWEADKMLDVYIYDYFMKRNLQATAKAFQAEGKVSSDPVAIDAPGGFLFEWWSVFWDIFIARTNEKHSDVAASYIETQHMKAREQQQQQQQQPPQQRQQQPQHIQMQQMLLQRAAQQQQQQQQQQQQQQQQQQQQQQQQQQQRRDGTHLLNGTASGLPGNNPLMRQNQSTANVMATKMYEERLKLPSQRDGLDEVSIKQRYGENAGQLLDSNEALLKASASGQSSGQILHGTVGGLSGSLQQVQSRSPQIPGPAQSIKTEMNPILTPRSAGPEGSFIGVQGSNQAGNNLTLKGWPLTGLEQLRSGLLQQKSFVQNQQQLQQQIHFLTPQQQQQLMLQAQQNMASPTSSDVDSRRLRMMLNNRNVGQTNSGGDIIPNIGSPSLSGGDVDILIKKKIAQQQQLLQQQSNSQQHPQLQQPAVSSQQSQSSNQFLQQEKPGIGTMPVDGGMPNSFGGVDQTTKKRKKPGSSSGRANSSGTANTAGPSPSSAPSTPSTHTPGDAMSMPQLQQNGGSAKPLVMFGSDGAGSLTSPANALADVDRLLEDGSLDENVESFLSQDDMDPRDSLGRSMDASKGFGFAEVAKARASATKVTCCHFSSDGKLLATGGHDKKVLLWCTEPALKPTSSLEEHSALITDVRFSPSMSRLATSSFDKTVRVWDADNTSYSLRTFTGHSASVMSLDFHPNKEDMICSCDGDGEVRSWSINNGSCLTFVKVFKGGATQMRFQPQKGKYLAAASEKAIYILDGETQLACRNPLQGHTKNIHSLCWDSTGDNLASVSEDSVRIWSFAPGHDGEFVNELSCSGNKFQSCVFHPSYPYLLVIGCYESLELWDIREKNAMTVHSAHDGLVAALAASSATGKVASVSHDRFVKLWK

SEQ ID NO: 14539 - protein, 137 aa, Frankia sp. CcI3
MSVERTLILVKPDGVSRGLVGEVVGRLERKGLTLVALELRTLERSVAETHYGEHASKPFFGELVDFITSGPLVALVAEGPRAVEASRGLIGATDPVKAAPGSLRGDYALEIGQNLVHGSDSPESAKREIDLFFPGLS

SEQ ID NO: 14540 - protein, 246 aa, Candida albicans SC5314
MFKQIITSSSTKSTRLFTSSTLKYLSTSSSLLKPTLAAAAAASITTTTTTTDNSSEYLTTGGSTHSIPAKGFRLSQPKTWEESNESALSKATKFLFLSEIARGMYICLEMYFRAPYTIYYPFEKGPISPRFRGEHALRRYPSGEERCIACKLCEAICPAQAITIEAEERIDGSRRTYKYDIDMTKCIYCGYCQESCPVDAIVETPNVEYSTATREELLYNKEKLLENGDKWEQELQYCIDADAPYR

SEQ ID NO: 14541 - protein, 111 aa, Zea mays
  misc_feature (86)..(86): Xaa can be any naturally occurring amino acid
KTGHRQRRCRGRGKGGKGLGKGGAKRHRKVLRDNIQGITKPAIRRLARRGGVKRISGLIYEETRGVLKIFLENVIRDAVTYTEHAXRKTVTAMDVVYALKRQGRTLYGFGG

SEQ ID NO: 14542 - protein, 893 aa, Oryza sativa (japonica cultivar-group)
MMVSSRFVAVLLLVALAPAARGQGGGGGNSSAPAASPPGPFVPRDNILLDCGATGQANDTDGRLWTGDTGSKYLPANLAAAAATAQDPSVPQVPYLTARFSAAPFTYSFPVGAGRKFLRLHFYPANYSNRNAADALFSVSIPDPNITLLSNFSAYQTALALNFDYLVREFSVNVTASTLDLTFTPEKGHPNAFAFVNGIEVVSSPDLFGSSNPMEVTGDGSGTPFPIDAGTAMQTMYRLNVGGNAISPSKDTGGYRSWEDDTPYIPFASFGVSYANDTNVPINYPDSIPQYVAPADVYSTARSMGPDNNVNLQYNLTWAMQVDAGYQYLVRLHFCEIQSGISKINQRTFDIYINNQTAFSGADVIAWSTGLGIPVYKDFVVFPMGSGPMDLWVDLHPNVKNKPQYYNAILNGMEVFKLQLTNGSLAGLNPVPSIVPTASGGNSGKKSSVGPIIGGVIGGLVVLALGCCCFFVICKRRQRAGKDSGMSDGHSGWLPLSLYGNSHTSSSAKSHTTGSHASSLPSNLCRHFSFVEIKAATNNFDESLLLGVGGFGKVYRGEIDGGATKVAIKRGNPLSEQGVHEFQTEIEMLSKLRHRHLVSLIGYCEEKNEMILVYDYMAHGTLREHLYKTQNAPLSWRQRLDICIGAARGLHYLHTGAKHTIIHRDVKTTNILLDEKWVAKVSDFGLSKTGPTMDHTHVSTVVKGSFGYLDPEYFRRQQLTDKSDVYSFGVVLFEVLCARPALNPTLAKEEVSLAEWALHCQKKGILDQIVDPHLKGKIAPQCFKKFAETAEKCVSDQGIDRPSMGDVLWNLEFALQMQESAEESGSLGCGMSDDSTPLVIVGKKDPNDPSIESSTTTTTTTSISMGEQSVASIDSDGLTPSAVFSQIMNPKGR

SEQ ID NO: 14543 - protein, 121 aa, Glycine max
MASSMLSSAAVGTSPAQATMVAPFTGLKTSAAFPATRKANNDITSIASNGGRVSCMKVCPPDGKKKFETLSYLPDLTEVELGKEVDYLLRNKCTPCAEFQLEHEFVYRDHRSKPGYYDARY

SEQ ID NO: 14544 - protein, 138 aa, Arabidopsis thaliana
MVKALQGAAQNLPADVNQLIDQLERHCLAPDGSLVTKSVYSDLQLAREEMSRERLRYLEAMAIYCEAVAMVEEYQQAISVANHGGIRDVQGLYPQLGLKNSPQVYETLEHRLVVAEAAQKLRLPLISDGGEIHEEEIE

SEQ ID NO: 14545 - protein, 536 aa, Coprinopsis cinerea okayama7#130
MDKHRLWSRDAVAAAILDGDTLIVFRDHLLKIPDKWLNAHPGGNLALLHFVGRDATDEVEAYHLDDTLKLVPRYSVGRVVNSTEHPWKPFLPPIMAGWVRKRDAQGNPYWFREAHEHRPRNNATSSSPASEVLLVPNNSSPSPEKGPTLATITPPASDLSPAVQARHSKAYKELHKRITEAGLYSTRYITGYGPEILRYTFFACASVYAYWHQWFKTSALFLGLLWHQLVFSAHDLGHMGVTHNWAIDRIIAIIIADFIGGLSIGWWVNNHNVHHLVTNHPTHDPDIQHIPFFAISTNFFSSLWSSYYKRTMVFDRFAKFLISMQHKLYYIIMAFARFNLYANSYIFLYQKAFDTRRARGGTWAFRLEIVGLIFFWNWYLRVLYNTGSWQNAIVYLLISNIVPSPLHVQIVLSHFSMSTTDLGPTESFPHRQLRTTSDVICPESLAFIHGGLHLQVTHHLFPRLPRHNLRQASLLVKEYCEEQGLAYNEFGFIEGNKDVLGVLRNVAEQVKIVGKVAKAEVVEAVEKSIDGMVKEN

SEQ ID NO: 14546 - protein, 206 aa, Alkalilimnicola ehrlichei MLHE-1
MNPIYFQARFLTSAPDLRRMPPDQGREVAFAGRSNVGKSSAINTLTNQKSLARTSKTPGRTQLINVFPITDEAALVDLPGYGYAKVPAAVRRRWDQVLPEYLAGRRALRGVVLVMDLRHPLTDFDRQMLDWCGHIGVPLHVLLTKADKFKAGAARNRGQNVGRQLRAEWPGVTWQIFSASKRMGVDEAHARLDEWLGLGPAAGEGR

SEQ ID NO: 14547 - protein, 405 aa, Sinorhizobium meliloti 1021
MEEFHKVRRLPPYVFEQVNRLKASARAAGADIIDLGMGNPDLPTPQSIVDKLCEVVQDPRTHRYSSSKGIPGLRRAQAAYYARRFGVKLNPETQVVATLGSKEGFANMAQAITAPGDVVLCPNPTYPIHAFGFLMAGGVIRSISVEPDESFFPPLERAVRHSIPKPLALILNYPSNPTAQVATLDFYKDVIAFAKKHDIIVLSDLAYSEIYFDDAPPPSVLEVPGATDVTVEFTSMSKTFSMPGWRMGFAVGNERLIAALTRVKSYLDYGAFTPIQVAATQALNGDGSDIAEVRAIYKRRRDVMVESFGKAGFEVPPPPATMFAWAKIPEKFRHLGSLEFSKLLVEKADVAVAPGIGFGEQGDDYVRLALVENEHRIRQAARNIKRFLSSADETMHNVISLNAHR

SEQ ID NO: 14548 - protein, 520 aa, Neurospora crassa
MVHLTIIPKEDEIRDGLDIPLTGALKAVHLQLANDEDRFTTSVYGSKFAAADLPRHEMPDEEMPKEVAYRMIKDELSLDGNPLLNLASFVTTYMEEEAEKLMTESLPKNFIDYEEYPQTADIQNRCVSMIGRLFNAPVKDAEASSAVGTSSVGSSEAIMLGVLAMKKRWKNKRIAEGKPADKPNLIMSSAVQVCWEKATRYFEVEEKFVYCTPDRYVIDPKETVDLVDENTIGICCILGTTYTGEYEDVKAVNDLLVERGLDTPIHVDAASGGFVAPFVVPDLEWDFRLKNVVSINVSGHKYGLVYPGVGWVVWRSAEYLPQELVFNINYLGADQASFTLNFSKGASQVIGQYYQLIRLGKHGYRAIMSNLTRTADYLAESLAALGFIIMSQKSGQGLPLVAFRLKEDPDRTYDEFALAHQLRVRGWIVPAYTMAPKTEGLKMLRIVVREDFSRNRCDGLISDIRSCQGILEQMDKETVKKQQEFIHKHHVVSGKASHNHPKYHILWSESNSSRNQATPE

SEQ ID NO: 14549 - protein, 517 aa, Zea mays
  misc_feature (138)..(138): Xaa can be any naturally occurring amino acid
  misc_feature (210)..(210): Xaa can be any naturally occurring amino acid
  misc_feature (246)..(246): Xaa can be any naturally occurring amino acid
  misc_feature (253)..(253): Xaa can be any naturally occurring amino acid
  misc_feature (266)..(266): Xaa can be any naturally occurring amino acid
MATLPLLLHLLWEASPWARAGAATAAVVLVWLAAWTLEWAWWTPRRLDRALRAQGLKGTRYRLLTGDVRENARLNREARTKPLPLGSHDIIPRVLPMFHNAVKENGTNSFTWFGPIPRVIIPDPELMREVLVLTSFGXHFGKPLFSRVGKLLANGLANHEGEKWAKHRRILNPAFHHEKIKRMLPVFATCCTDMINRWDNSMSSKGPSDXWTCWPEFQNLTGDVISRTAFGSNYKERRRTSPSFQXELAERLXIQSVQTIFIPRWXLSTIRKSFSVEISTKNRETNNDDLLGLLLESNTRQSNGNASLGLTTEDVIEECKLFYFAGMETTSVLLTWTLIVLSMHPEWQERAREEVLSHFGRTTPDYDSLSRLKTITMILHEVLRLYPPATFLTRRTYKEMELGGIKYPAGVDLLLPVIFIHHDPDIWGKDASEFNPERFANGISSATRHQAAFFPFGGGPRICIGQSFALLEAKMTLCTILQRFSFELSPSYTHAPYTVITLHPQHGAQIRLKKLSP

SEQ ID NO: 14550 - protein, 1256 aa, Oryza sativa (japonica cultivar-group)
MKTFILQQMVQKGRAKRSSNFNRKEDIQLCISWQSISSDPIIGNEQPGKAYWQRIAEHYHANRDFESDRNANSLEHHWGNIQKEVSKFQGCYEQIERRHPSGIPHQELLRNSPKFQTLESHKRPRSRKSSTLIESAGEEDEEGDDARKSTTPDLLQPSAKKRPMGRKQAKEKMKNGEDGPYKEAMKDLLDAKEKEAKVKEERWKETKEIQERKLLFAEHVRTYVLAMRTQIAASKVAALNGGFDGSSGFGATASPSSRELAQRLLKKNAEHESRLRRSAQSKVPSDPNIWFQMRENYEKIILADHDFSEKREIEYLLWQLHYKRIEEFRAHIVSAGKNNANPDRIKRIRSSVRSFLSEATGFYHDLMLKIRSTYGLPLGYFSEGPDSSVVPDKDGKKVVGVKKGLLSCYRCLIYLGDLTRYKGLYGDVDYASREYAAASIYYKEAASLCPSNGNPHHQLAILASYAGDEVTAIYRYFRSLAVDNPFSAARENLILAFDKNHDIYAQLSGNSKVPNAKSLPSRSVGRARGRGETRFQPKGSSTEENSKEREHSIQEILKAFYIRFVRLNGILFTRTSLETFGELSATVISDLQILLSSGPYEELNFGVEAAENALSVVKLIAILIFTVHNANKDADNQSYAEIVQRRVLLQNAFAAAFEFVGYLLKRCAELHDVASSIYLPAILVFIEWLACHPDFVASSEMDEKQADARSFFWSQCVPFMNKLILTGLAHVDGDNDETCFFDMGTYEEGETGNRLALWEDVELRGFSPLVPAQGILDFSTKQGFGSDGGTKEKKARVERILAAGKALLNFVQIDQLRIYFDASSKKFLMASEPPPPASSVPLVVSSNAQTTNHIQQEPEVSSKIGSVAEDLGVLQSKAQLFLDGDDDEEIVFKPPVSEKLPRVTSEQTSNELLQPVVVSDVNWSNDGAPPPMTFQSNGPVLTPNVYVQSLPISSLGWAANAGQHVILDVGARSTSDIFESLKAPDHNWVSTGAPLVGSLDTVPMASFSNIISDQRTPPSSLGCFSNPDNTAILPGQDSFLLSALNNVNIGASGFLDQRVNGGLSGLQSVGNVPQVSAQATMNSTNPMIGQYKHTEVTIPSAFYSVLPSVVSSDGVSKKNPVSRPGRHVGPPPGFNNAPPKRQDDSILAGNGQHVQTNDGIWLDGYRSSLDYVNNQRFAHSNVTTASSTFTTPFPFPGKQAFSMHPRGSDEKQWQDFHLFGPTKQLPELNFQQGNQQNGPLAEQLPAQSAWSGNYLV

SEQ ID NO: 14551 - protein, 412 aa, Methanosarcina barkeri str. Fusaro
MTSRDFLTIDDFDTHGKTILVRVDLNSPMDPQGNILDDMRIRSHIATLKDLEDAKVVLLAHQSRPGKKDFTTMKPHANLMSKYLGKQVLYVDDIFGTYAKTRIASMENGDVILLENVRFYSEESLERTPAEQAKTYPVKKLAPFVDIFLNDAFAVSHRSQLSVVGFTEVLPTGAGRVMEKELTSLDRGIKGGERPTIFVLGGAKVDDSLHVAENVLSNGGADRVLLTGVVANVALAASGIDIGKVNLDFIKSQGYEDQIEKAKSILTKFKDKVGLPRDVALNDNKKRVELPVSELNSNSLPINDIGLETIVDFTSEIASAKTVILNGPAGISEVAEFALGTHEIIKAAIKSEFSIIGGGHISAEVEHLGLAHRFSHISTGGGALIDYLSGVKLPGVEALKSAAKRYEEAKKI

SEQ ID NO: 14552 - protein, 455 aa, Landoltia punctata
MARLVLAVMLLLNAAILCSGGITSEFVRLQESAVDMPLHADVFRMPPGYNAPQQVHITQGDHEGRSIIVSWITPSEKGSSTVFYGTSENKLDQHAEGTVTMYKFYTYTSGYIHHCVLTDLKYDRKYFYKVGEGSAARLFWFKTPPEVGPDVPYTFGLIGDLGQTFDSNVTLTHYESNPGGQAVLYVGDLSYADVYPDHDNVRWDTWGRFVERSTAYQPWIWTTGNHEIDYAPEIGEYVPFKPFTHRYHVPHKSSGSGSPFWYSIKRASAYIIVLASYSAFGKYTPQSEWLEQEFPKVNRSETPWLIVLMHSPLYNSYNYHYMEGETMRVMYEPLFVTYKVDVIFAGHVHAYERSYRISNVAYNITDGKCTPTSDLSAPVYITVGDGGNQEGLASSMTEPQPNYSAYREASFGHAIFGIKNRTHAYYNWYRNQDGNAVEADSLWFFNRVWNPREES

SEQ ID NO: 14553 - protein, 573 aa, Arabidopsis thaliana
  misc_feature (535)..(535): Xaa can be any naturally occurring amino acid
  misc_feature (544)..(544): Xaa can be any naturally occurring amino acid
MSESFKVCFCCSRSFKEKTRQPPVSIKRLFEAYSRNGKMSFDELLRFVSEVQGERHAGLDYVQDIFHSVKHHNVFHHHGLVHLNAFYRYLFSDTNSPLPMSGQVHHDMKAPLSHYFVYTGHNSYLTGNQVNSRSSVEPIVQALRKGVKVIELDLWPNPSGNAAEVRHGRTLTSHEDLQKCLTAIKDNAFHVSDYPVIITLEDHLPPKLQAQVAKMLTKTYRGMLFRRVSESFKHFPSPEELKGKILISTKPPKEYLESKTVHTTRTPTVKETSWNRVANKILEEYKDMESEAVGYRDLIAIHAANCKDPSKDCLSDDPEKPIRVSMDEQWLDTMVRTRGTDLVRFTQRNLVRIYPKGTRVDSSNYDPHVGWTHGAQMVAFNMQGHGKQLWIMQGMFRGNGGCGYVKKPRILLDEHTLFDPCKRFPIKTTLKVKIYTGEGWDLDFHHTHFDQYSPPDFFVKIGIAGVPRDTVSYRTETAVDQWFPIWGNDEFLFQLSVPELALLWFKVQDYDNDTQNDFAGQTCLPLPELKSGVRXPSGFTIEQXQGLQEHEASRQLRLGSSLYVSLNLVFFPK

SEQ ID NO: 14554 - protein, 138 aa, Brassica napus
FFPRDPDDVVFVNSLELLDDFLRENSCFSSSSSSSSGVNNGIDWKEFAPRIEDYNNVVAKAIAGGTGHIIRGMFKCSNAYTNQVNKGGETMVTKAEKKSGASSKRNANTNKNQINKNLQRVRKLSRATEKLSKTMLNG

SEQ ID NO: 14555 - protein, 463 aa, Pseudomonas putida GB-1
MNAQSSHQLKRGLSTRHIRFMALGSAIGTGLFYGSASAIKLAGPSVLLAYLIGGAAIYMMMRALGEMAVHNPVSGSFGHYASQYLGRYFGFLTGWSYAFSMLVVCLADVTAFGVYMGLWFPETPAWIWVLGIVFFIGALNLCSVKVFGEMEFWLSLLKVTAIVAMIVAGGAVLLLGIQLNDDAGTVAGISNLWSHGGFFPNGIGGMIASFTVVMFAFGGVEMIGITAGEARDPKRVLPKAINSVPLRILLFYILTLLVLMSIYPWTGIGSHGSPFVQIFSGLGISSAATVLNIVVISAAVSAINSDIFSAGRMMYGMAQNGQAPAGFASLSRFGVPWMTVAVMGVALLLGVVLNYLVPEGLFLVLAAVVTFSIVWVWLMILLSQVAMRRGMSKEEVAALDYRVPLWPVGPACAIAFMVFIFGVLGWFPASRTAMYVGVGWLILLSLGYWLWGVRTPRPVSASA

SEQ ID NO: 14556 - protein, 327 aa, Glycine max
  misc_feature (247)..(247): Xaa can be any naturally occurring amino acid
  misc_feature (249)..(249): Xaa can be any naturally occurring amino acid
MATEAEFEYEEASEAEIKYDEEYVQNSRGLKLFACRWLPANGSPKALIFLCHGYAMECSITMKSTGTRLAKAGFAVYGIDYEGHGKSEGVPGLVMNFDFVIDDCSQHFTRICEKAENKKKMRYLMGESMGGAVALLLHRKKPEYWDGAILVAPMCKIAEEMKPNTMVISVLSALSRVFPSWRIVPTPDIIDLAFKVPKVREEIRANRYCYKGNPRLRTAYELLRVSTEIEQSLHEVSLPFIVLHGEXDXVTDKAVSKQLYDEAPSSDKTLKFYPKMWHGLLYGDPPENLQIVFSDIIGWIDQKPHHGNSRLERELKEEHDHLVKSDL

SEQ ID NO: 14557 - protein, 438 aa, Pseudomonas putida GB-1
MNQSLAAFKRWRIQIFAITWLAYAAFYFTRKAFSVAKLGIAEDPSFMLDKAAMANLDAIYLAAYAVGQFTWGMLADRFGPRVVVLGGLLISAAAAVVMGSYATFPIFATCMLVQGLAQSTGWAGLCKNIGSFFPASQRGRVLGLWSSCYAFGGLVASPFAGWWAYTLVGTWHAAFFSSAAVVALVAVLFFFLQRNKPEDVGLPAVEPEPQSMAPADNLCSVWAPLREIMRNRTVLTLGLAYFLLKPARYAILLWGPVIVFEQMPSVGKVGAAIIPTAFELAGLLGPIMIGLASDKLFGARRMPACVISLVLLTVTLAAFMAAMHTGSVILVVALLFVMGLTLYGPDSMISGAAAIDFGTAKAGATAAGFVNGCGSVGAVLGGLLPGYFDGVTVFIVFAGCALFSALVLLPHWNSRPASSAQSNDVAPNTSMAIKPLRT

SEQ ID NO: 14558 - protein, 186 aa, Glycine max
INLFAQSFFLLLSKRKVENRWSELLGLLAFWVWYPLLVSFLPNWWERVLFVFVSFSVTGIQHVQFCLNHFSSEVYLGPPSGGDWFEKQTKGTLGVDCSPWMDWFHGGLQFQVEHHLFPRLPRCHLRKIAPLVKDLCKKHNLPYNCVSFWKANVLTIQTLRNAALQARDGSKPVPKNLVWEAVNTHG

SEQ ID NO: 14559 - protein, 473 aa, Arabidopsis thaliana
MEREGKSDPIPIDIILDILSRLSTNSIAKFGLASKFCGSILRGQDFIELFLITRPLSRPRLLFAVQNSDKWCLYSSPQSQFPDENHSLVVSADFHMELRRDMGQEIFGLVSGLLYFPNTRTGEVPVICNPSTGQYARLTQRSSMNNLSSLLGYDPIGKKYKVITPSSSHFDPENILTLGTGKVAWRSIRCLVDHYPESEGICINGVLYYMASNKFQFSGVKIASFNVRYETLKFLNADVDVTFCPALAKLINYKEDAEKEEWLKREYTLPVNIVHGNVSVVGVTATGQGSWKMIEVENIPSPSTRGICIDGVVYYGAQTAHGLRLVRFYVATEKFGDFIEIPVGASNVYDMNFGYSKLVNYQGKLALLAAKSMSMYDLWVLEDAGKQEWSKVSIVLTREMFSYDLVWLGAVGFVAGSDELIVTAHDRFYQIYLVYVDLKMKRSREVWLGGIRCSDRSSLVLTFTDYVESIMLL

SEQ ID NO: 14560 - protein, 294 aa, Oenococcus oeni PSU-1
MAEKGTNLVKRGMAEMQKGGVIMDVVNAEQAKIAEEAGATAVMALERVPSDIRKAGGVARMADPAIVEAVQNAVSIPVMAKARIGHIIEARILESMKVDYIDESEVLTPADDVYHIDKKAFTIPFVCGCRDLGEAARRIGEGAAMLRTKGEPGTGNIVEAVRHMRLVNNQVNKVLGMSPEEIMVFAKELGAPYDVLLEIKKSGRLPVVNFAAGGVATPADAALMMELGADGVFVGSGVFKSENPAKFAKAIVEATTYYKDYPRIAELSKGLGEPMKGIDMSILQPAEHMQERGI

SEQ ID NO: 14561 - protein, 192 aa, Coprinopsis cinerea okayama7#130
MASDDDYERLTKEEREKRDKEEREREAAEQATLPYRWTQELGEVDVTIPVPEGTRAKDLNVVIAKKKLRVGLKGQEPIMDGDLCKEIKVEDSTWTLQDQKNVLVHLEKLNNQTWWENVLTHHPKIDTRKIEPANSKLSDLDGETRGMVEKMMFDNQQKQMGKPTSDELKKMEALKKFQAAHPELDFSNAKIS

SEQ ID NO: 14562 - protein, 416 aa, Bacillus clausii KSM-K16
MEKQQEPTSMKTSMFKNKLKAIGPGAIVTASFIGPGTVTTATRAGASFGFALLWAVIFSIIATIILQEMCARLGIITQKGLGAAIREHFTHPLLKYASMFLVLVAILVGSSAYMAGDLLGTSMGISTLTGISPNVLAPLFGIVILALGLSGSYKLVEKLMIVLVVIMSITFVTTMVVAKPPLGELFQGAFIPTVPDQSIIMIIALIGTTVVPYNLFLHSENVIERWNKPAHLADSRWDIVISISVGGLITAAILITSATMMQGMEVENVSDLSVQLEPLLGSWALVFTSIGLFAAGFSSALASPLGAAITASSILKWSGGMRDTRFKIVFAAVILFGVVSSSLGFEPLDVLLFAQALNGMLLPFVSIMLLIIMNNKNRLGNYVNSLKMNIVGGIVVVLCTGLGIYSFVDAVRAFFG

SEQ ID NO: 14563 - protein, 148 aa, Zea mays
MEVAGACCHAGEERKVAVPIGNDAEVEPCVIAVDDSSVDRAIVTALLRRSKYRVTAVDSGKRALEILGSEPNVSMIITDYWMPEMTGYDLLKKVKESSKLKRIPVVIMSSENVPTRITRCLEEGAEDFLLKPVRPSDISRITTRMLLH

SEQ ID NO: 14564 - protein, 380 aa, Trichodesmium erythraeum IMS101
MTEIFKATTQCNLIDHVPVGLCLLREDFVVLYWNRCLENWTKIFRDDIIGKNLLDFFPHLKQPKYISRFQQVFFGGFPAIFSPQLHPSLIHCFLPHKQKAIQKTIVNAIPIEDTNNYYALICIQDITDFDLTDRIQSYQEKLKQRQSIQRELERSNAELENFAYLASHDLQEPLRMVTTFTQMLGQRYKDQLDEDANQIIDFAVDGAIRMQSLINDLLLYSRVGRQSQFFEQTDCEEVLDTALSNLQLLIEETNTHIYRDPLPTIMADKSQLIQLFQNILNNAIKYRREEPPKIEIGVRSEDYYCLFSIKDNGIGISKQYFERIFMIFQRLHTRQEYPGTGIGLAICQKITQRHQGKIWLESELGKGSTFYFTIPQYVTE

SEQ ID NO: 14565 - protein, 188 aa, Catharanthus roseus
MAAQVLDVGFHVLAVDDSLVDRKLIERLLKTSAYQVTVVDSGIKALEFLGLLDEEKEISGSNHQQVVEVNLIITDYSMPGMTGYDLLRKVKESSYLKDIPVVIMSSENIPSRINRCLEEGADDFFLKPVKQSDVNKLIPLVPNSFTGKPIKNHEQQQIFSSSTCKRKQHTDEYLSPTLRRKRYNQIFS

SEQ ID NO: 14566 - protein, 509 aa, Streptomyces avermitilis MA-4680
MAGQQARQAGQTQRTIHVGGEWREADSRATREILDPADAKPFAVVAEGDERDADAAVAAARRAFDSGEWPHTPVAERAALLRRVADLLVRDRESLGLLESRDAGKTLEEGRVDIDCVADAFRYFADLVVGEGGGRVVDAGSPDIHSVVVHEPVGVCAMITPWNYPLLQASWKIAPALAAGNTFVIKPSEITPLTTAALVDLLVEAGAPAGVANIVTGPGHTVGARLAEHPDVDLISFTGGLASGTKVAQAAAVSVKKVALELGGKNPNVVFADACATDEDFDTAVDQALNAAFIHSGQVCSAGGRLIVEESVRERFVAELVRRAGRIRLGRGTEDGVECGPLVSEQQRDKVEGYVASALSEGAVLRTGGRRPEPSDVRPAAGYFFEPTVLDQCHRGMKVVREEVFGPVLTVETFRTEDEAVALANDTEYGLAGAVWTSDAGRARRVAGRLRHGTVWINDFHPYLPQAEWGGFGKSGVGRELGPAGLAEYRETKHVYQNLAPKPVRWFAG

SEQ ID NO: 14567 - protein, 145 aa, Brucella melitensis 16M
MTDIIRQLEAEQAAKIEEKRKLPDFQPGDTVRVQVRVTEGTRTRVQAYEGVCIARSGAGLNENFTVRKISYGEGVERVFPVYSPIVEGVEVVRRGKVRRAKLYYLRGLTGKAARIAEKKDNRTKAERAADKLAAAKAEAAKTAAE

SEQ ID NO: 14568 - protein, 413 aa, Oryza sativa (japonica cultivar-group)
MRRCGSSSGGRFTGGGGQKGRWPGFEGKRAAPVVKWSHAEAMKKKPSGRGDAAVTGDGGGWMRRLEEEEAGLELDGSCWGSWSEAAATRASGTATGGAGKHVRFRPEAEAEAKRERPFDAGEWGGGGGGEVGGDGGEGRMYEWRWTEAVSPEILALILRGRVDADEVARGAARVCRAWREAAAAPDVWGDVDIEAWCRRVNCRPRADAAVRRLVALARGTLRQLSAYRVGDAALAYVAASGKLLNVLQIPMSEISDQAVKKYAEFLPALRVLDISNCLKISSSGIEALGRHCKLLVQLKRNMPPPDVPHGYNAVPNVVNDEALAIANTMPVLEHLELAYGLFSDTGLGAILTRCPRLQTLDILGCWNVRLEGDIELRCCALESFREPWEPMYSDCSSTGSDNDDDDEDNDSDN

SEQ ID NO: 14569 - protein, 139 aa, Nicotiana tabacum
LCVALLIMSVMMAMAAAQSATNVRSTYHLYNPQNINWDLRAASAFCATWDADKPLAWRQKYGWTAFCGPAGPRGQDSCGRCLRVTNTGTGTQATVRIVDQCSNGGLDLDVNVFNQLDTNGLGYQQGHLIVNYEFVNCND

SEQ ID NO: 14570 - protein, 831 aa, Rhodobacter sphaeroides
MTLTRRDLIKAQAAATAAAAAGLPVSALAQPVTGGAEALRIRWSKAPCRFCGTGCGVMVGTRDGQVVATHGDTQAEVNRGLNCVKGYFLSKIMYGEDRLTTPLLRMKDGVYHKEGEFAPVSWDEAFDVMAAQAKLVLKEKAPEAVGMFGSGQWTIWEGYAASKLMRAGFRSNNLDPNARHCMASAATAFMRTFGMDEPMGCYDDFEAADAFVLWGSNMAEMHPILWSRLTDRRLSHEHVRVAVLSTFTHRSSDLSDTPIIFRPGTDRAILNYIAHHIISTGRVNRDFVDRHTNFALGATDIGYGLRPEHQLQLAAKGAADAGAMTPTDFETFAALVSEYTLEKAAEISGVEPALLEELAELYADPDRKWMSLWTMGFNQHVRGVWANHMVYNLHLLTGKISEPGNSPFSLTGQPFACGTAREVGTFAHRLPADMVVTNPEHRAHAEEIWKLPAGLLPDWVGAHAVEQDRKLHDGEINFYWVQVNNNMQAAPNIDQETYPGYRNPENFIVVSDAYPTVTGRAADLVLPAAMWVEKEGAYGNAERRTHFWHQLVEAPGEARSDLWQLMEFSKRFTTDEVWPEEILSAAPAYRGKTLFEVLFANGSVDRFPASDVNPDHANHEAALFGFYPQKGLFEEYAAFGRGHGHDLAPFDTYHEVRGLHWPVVEGEETRWRYREGFDPYVKPGEGLRFYGKPDGRAVILGVPYEPPAESPDEEFGFWLVTGRVLEHWHSGSMTLRWPELYKAFPGAVCFMHPEDARSRGLNRGSEVRVISRRGEIRTRLETRGRNRMPRGVVFVPWFDASQLINKVTLDANDPISRQTDFKKCAVKIEAV

SEQ ID NO: 14571 - protein, 740 aa, Catharanthus roseus
MESCNCIEPQWPADELLMRYQYISDFFIALAYFSIPLELIYFVKKSAVFPYRWVLVQFGAFIVLCGATHLINLWTFTMHSRTVAVVMTTAKVLTAVVSCATALMLVHIIPDSLSVKTRELFLKNKAAELDREMGLIRTQEETGRHVRMLTHEIRSTLDRHTILKTTLAELSRTLALEECALWMPTRSGVELQLSYTLRLPNPVGFTVPILLPVINQVFSTNRAVKISPNSPVARLRPTGKYMPGEVVAVRVPLLHLSNFQINDWPELSTKRYALMVLMLPSDSARQRHVHELELVEVVADQVAVALSHAAILEESMRARDLLMDQNVALDLARREAETAIRARNDFLAVMNHEMRTPTHAIIALSSLLQETELTPEQRLMVETILKSSNLLATLINDVLDLSRLEDGSLQLDIATFNLHSLFREVLNLIKPITSVKRLFATLSLAPDIPEYAISDEKRLMQIMLNVVGNAVKFTKEGGISITAFVAKSDSLRDPRAPEFFPVPSDSHFYLRVQVKDSGSGINPQDIPQLFTKFAQSQTLATRNSGGGGLGLAICKRFVNLMEGQIWLESDGLGKGCTAIFMIKLGIPGRSSEAKLPLVSRVPADHVQTTFPGLKVLLMDDNGVSRMVTKGLLLQLGCEVTTVSAGDECLRVISNEHRVAFMDVSIPGKDIYEVAVRIHEKFSKRLDRPLIIALTANADRVMKENCLRVGMDGVVQKPISVDKMRSVLSELLDHGVLLEAQ

SEQ ID NO: 14572 - protein, 327 aa, Chlamydophila abortus S26/3
MSSQFEQLKLLSVLVCDTGDPELVKSSESQDATTNPSLILKVAQEPKYQELLTEAIAWGIRQNGDDVQTLTFVLDKIQVNFGLEILKHIPGRVSLEIDARLSFNTEAMVQRAIFLSELFAASGGDKKRLLVKIPGTWEGIQAVELLEKQGIACNVTLIFNLIQAIAAAKAKATLISPFVGRIYDWWIAAYGDDGYSIDADPGVASVSNIYTYYKKFDITTQIMAASFRSKEQVLALAGCDLLTVSPKLLDELKKDQSPVERKLDPAEAKKLDVQPVELTESIFRFLMNEDAMATEKLAEGIRIFSGDTQILEAAVTEFIKQIAAQDV

SEQ ID NO: 14573 - protein, 456 aa, Salmonella enterica subsp. enterica serovar Typhi str. CT18
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKMFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKVFAKTSRRGIPWVTVLVMTIALLFAVYLNYIMPENVFLVIASLVTFATVWVWIMILLSQIAFRRRLPPEEVKALKFKVPGGVVTTIAGLIFLVFIIALIGYHPNTRISLYVGFAWIVLLLIGWIFKRRRDRQLAQA

SEQ ID NO: 14574 - protein, 280 aa, Prochlorococcus marinus str. MIT 9303
MRAFQLAIADEYHNQKMRCPVHLSIGQEYWLPLVKKFFQKTDRCFSSHRSHSMYLALACDPESLIAELHGSAFGSLQGLGGSMHLKELDSGLEASIPIVGSSIALGVGSALSAKHSKNDVLTISYFGDGACEEGIFHECLNLAALYKLPILFICENNSYSCNTHYSNRQTANDMTRFPLSHGMTNFKINNFDPYLFIESTMEKCFSLARDRPVFLEISSYRLYEHCGHLIDLDRGDRTYDEYLYYQRIDPVNQMLSIYPNLKNDETIWKKYYIDLIRKYE

SEQ ID NO: 14575 - protein, 467 aa, Escherichia coli W3110
MQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 14576 - protein, 389 aa, Brassica napus
MNRGALESSPVQQLMVAGNPNWWNVSGSTRPPPPLMGHQQGPLPPQMTPNNNYLRPRMMMTSSSPSLLDNPSLSSWLESNDLPPESWSLSQLLLGGLMMGEEERLEIMNHHSHHDEQHHHSFQGKMRLENWEEQVLRHQQASMGVVDIKQESNINNNNGYLISSPNSPPNKSCVTTTTTTSLNSNDNTNNNNNMLGFSSNHNGLNLSEIRHTPPDRSSECNSLDIGGSTNKKPRLQPSPSSQSTLKVRKEKLGGRIAVLHQLVSPFGKTDTASVLSEAIGYIRFLQNQIEALSHPYFGTTASGNMRNQHLQGDRSCLFPEDPGQLVTDQCVKRRGVSSSSSENQNAKEEPKKDLRSRGLCLVPISYTLQVGSDNGADYWAPTLGSASFH

SEQ ID NO: 14577 - protein, 340 aa, Staphylococcus epidermidis ATCC 12228
MKAAVVTKDHRVSIEEKRLRELRPGEALVKTEYCGVCHTDLHVKNADFGDVTGVTLGHEGIGRVIKIADNVDSLKVGDRVSIAWMYAACGNCEYCTTGRETLCRDVLNAGYTVDGAMAEEVIVDANYAVKVPENLDPAAASSITCAGVTTYKAVKVSGIEPGQWLGVFGVGGLGNLALQYAKNVMGAKVVAFDINDDKLNFAKELGADAIINSTNVDPIEEVNRLTNNKGLDATVITAVAKTPFNQAVDVVKAGARVVAVGLPVDKMDLDIPRLVLDGIEVVGSLVGTRQDLREAFQFAAENKVIPKIQLRQLSEINDIFDEMEKGTITGRMVIDMKSTH

SEQ ID NO: 14578 - protein, 314 aa, Lactococcus lactis subsp. lactis Il1403
MNDKEHQRHRLIYHTNGKSLEEINGTVEVPKNVGFFKMLLTYSGPGALVAVGYMDPGNWSTSITGGQNFQYLLISVILMSSLIAMLLQYMSAKLGIVSQMDLAQAIRARTSKSLGIVLWILTELAIMATDIAEVIGAAIALYLLFNIPLILAVFITVLDVFLLLLLTRVGFRKIEALVICLILVILVIFAYQVALSNPDWKGIIEGFIPNSRTFASSPTVAGMSPLTGALGIIGATVMPHNLYLHSSISQSRKINHQDKSDVARAVRFSTWDSNIQLTVAFVVNSLLLIMGVAVFKTGVIDDPSFFNHSFVDVD

SEQ ID NO: 14579 - protein, 387 aa, Candida albicans SC5314
MGFSLSNFTSDPFAISTVSFGIMAWVVAIAGAASSKQENFPHFSWWGISYQIVIILIIFVLYANNNIELYKFTLVGLVSIAFIYTTNSTNNLIYNSNSAGNLCCAAGCILLSILNLIWILYFGGHPESPTNQFIDSFSLRGQGHEQLGSGSHNHNANNANNNIPIGAGNAIIGKGEMSPYNDRFAASGVNQPTSESLRLASGPQMGNGPFTTTGAIINPNLQQPLSDSIGGSAHHTPINVNNNNNNNNNTGYMTSSHLTGLENFSSPHVPGSGTGAGLGVGAGRDLTHNSNGGGGSGGGPASANNSNNTNKRNTIYTDSETGTGITFRYKAKALYSYDANPDDINEISFVKDEILEVDDIDGKWWQARRANGQVGICPSNYVKLLDT

SEQ ID NO: 14580 - protein, 259 aa, Frankia sp. CcI3
MDLQLAGKVVLVTGGSNGLGAALVRTLAAEGARVAFCGRDETRLREVAGQAQAGGGEVLAVPADVTSITDLERFVATAVDRWNAVDALVNNAGASAGGTFENQTDEVWNADLELKLHAAIRASRLVLPYLRRAGGGGIVNSLSVAARAPSAGSTPTSVTRAAGLALTKALSKELGPDRIRVNAVLIGLVESGQWDRAAARENITVDELYERMGRTSGIPLGRVGRAQEFADLVAFLLSARAAYITGATINLDGGLSPVA

SEQ ID NO: 14581 - protein, 241 aa, Candida albicans SC5314
MRQCFDLVTGYAVPKTNNPEEFKGTRWEMTEGKWLTRCIFLESVAGVPGSVAGFLRHLHSLRMLRRDKAWIETLLDEAYNERMHLLTFIKIGKPSWFTRSIIYVGQGVFTNVFFLLYLLNPRYCHRFVGYLEEEAVRTYSHLLDELAVPGKLPAFETMKIPEVAVQYWPELTPKSSFKDLILRIRADEAKHREVNHTFANLEQKTDRNPFALKIEGLNKPQPNHGINVMRPTGWEKQDLQL

SEQ ID NO: 14582 - protein, 616 aa, Arabidopsis thaliana
  misc_feature (277)..(277): Xaa can be any naturally occurring amino acid
MAARINTSLHNALSFLKPFNTPLNTKPFSFRRNSFRFSKKLPYYSQFSSGKRALYCTSSSQESTVDEGETFVLTTPLYYVNAPPHMGSAYTTIAADSISRFQRLLGKKVIFITGTDEHGEKIATSAAANGRNPPEHCDLISQSYRTLWKDLDIAYDKFIRTTDPKHEAIVKEFYARVFANGDIYRADYEGLYCVNCEEYKDEKELLENNCCPVHQMPCVARKEDNYFFALSKYQKPLEDILAQNPRFVQPSYRLNEVQSWIKSGLRDFSISRALVDXGIPVPDDDKQTIYVWFDALLGYISALTEDNKQQNLETAVSFGWPASLHLIGKDILRFHAVYWPAMLISAGLELPKMVFGHGFLTKDGMKMGKSLGNTLEPFELVQKFGPDAVRYFFLREVEFGNDGDYSEDRFIKIVNAHLANTIGNLLNRTLGLLKKNCESTLVVDSTVAAEGVPLKDTVEKLVEKARTNYENLSLSSACEAVLEIGNAGNTYMDQRAPWFLFKQGGVSAEEAAKDLVIILEVMRVIAVALSPVAPCLSLRVYSQLGYSEDQFNSITWSDTKWGGLKGGQVMEQASPVFARIELNPEKEEDEKKPKVGKKTGKAKVKVVEQTPTVAEA

SEQ ID NO: 14583 - protein, 379 aa, Candida albicans SC5314
MIGLSTYRNLPTLLTTTTVISTALRSKQLLRFTTTTSTKSRSSTSTAATTVGNSNPKSPIDEDNLEKPGTIPTKHKPFNIQTEVYNKAGIEANDDDKFLTKPTYRHEDFTEAGVYRVHVTHRPPRTIGDKISCYGTLFFRKCFDLVTGYAVPDPDKPDQYKGTRWEMTEGKWMTRCIFLESIAGVPGSVAGFIRHLHSLRMLTRDKAWIETLHDEAYNERMHLLTFIKIGKPSWFTRSIIYIGQGVFTNIFFLVYLMNPRYCHRFVGYLEEEAVRTYTHLIDELDDPNKLPDFQKLPIPNIAVQYWPELTPESSFKDLILRIRADEAKHREINHTFANLEQWQDRNPFALKIKDSDKPQPNYNLDVTRPQGWERKDLYL

SEQ ID NO: 14584 - protein, 247 aa, Thermosynechococcus elongatus
AAKQTLTYDDIVGTGLANKCPTLDDTARGAYPIDSSQTYRIARLCLQPTTFLVKEEPKNKRQEAEFVPTKLVTRETTSLDQIQGELKVNSDGSLTFVEEDGIDFQPVTVQMAGGERIPLLFTVKNLVASTQPNVTSITTSTDFKGEFNVPSYRTANFLDPKGRGLASGYDSAIALPQAKEEELARANVKRFSLTKGQISLNVAKVDGRTGEIAGTFESEQLSDDDMGAHEPHEVKIQGVFYASIEPA

SEQ ID NO: 14585 - protein, 468 aa, Bartonella henselae str. Houston-1
MSYDVVVIGAGPGGYVAAIKAAQLGLKTAIIEKRMTLGGTCLNVGCIPSKALLHASEVFAETQHGFETLGISIAKSKLNLEQMMAHKKAVVTANTSGVSFLMKKNKIDTFFGTAKILNAGQIEVVARDGNKQTIETKNIIIATGSESSGIPGVNVEIDEKVIVSSTGALALEKVPTRMIVVGAGVIGSELGSVWSRLGAKVTIIEYLNKVLGSMDGEVSRQFQKIMEKQGIEYKIGAKVTAITQSGSVAQVTFEAVKGGPSETLEADVVLIATGRFPYTEGLGLEEAGVQLDERGFITIDAHWQTNIPGVYAIGDVVKGPMLAHKAEEEGVAVAEILAGQKGHVNFDVIPSVVYTQPEIASVGKTEEELKAAGIDYNVGKFPFMANGRARAMQKSDGFVKILADKKTDRVLGGHILGFGAGEMIHEIAVLMEFGGSSEDLGRCCHAHPTLSEAVREAALATFAKPLHI

SEQ ID NO: 14586 - protein, 995 aa, Listeria monocytogenes str. 1/2a F6854
MGAKVSVQINGVARDVVEGTRILDYLNAEGIQHPHICYSEQIGPIQSCDTCMCEVDGELVRACSTNLTDGMEIKTNSELAKDAQLEAMDRILENHLLYCTVCDNNNGNCKVHNTTELLGVEKQERPYREKGYLNDFSHPFYRYDPDQCILCGRCVEACQQVQVNETLSIDWERSQPRVIWDDDRPANLSSCVSCGLCATVCPCNALMEKSMLGQAGFMTGLDEDMLEPMIDMVKKVEPNYQTVFAVSEMEAAMRETRTKKTKTVCTFCGVGCTFEVWTKDRKILKVEPTGEGPVNKFATCVKGKFGWDFVNSEKRITTPLIREGNEFVPASWEDAIHLVATKLREIQAKYGNDSIGFISSSKTTNEENYLMQKLARQVFETNNIDNCSRYCQAPASDGLTRTVGIGADSGTVEDIETAGLVIIVGASPADGHPVLASRIKRAQKTRGQKLIVSDLRKHEMAERSDLFIHPKQGTDFVWLTAVAKYMIDQGWHDEVFMENRISNVRDYLAFLEPFTLDYAEKETGLSAETLKLVAQMVHEADGTAVCWGMGVTQNIAGSHTSSAIANLLLVTGNFGRHGAGAYPLRGHNNVQGACDMGSLPNVLPGIQPLGNDEVRARFEEAYGVSISPEPGLKNNEMLDAIEAGTLHSMYVIGEEMAWVDSNSNHVQEILASLDFFVVQDVFLSKTAQFADVVFPAAPSLEKEGTFTNTERRVQRLYEVLEPLGDSKPDWWIIQEVARACGRTDWNYDHPSEIMDEIASLAPFFAGVRYDRMQGFNSLLWPVSADGKDMPLLYEERFNFPDGKAQFSTLPYIAPITFPEEYNLTLNNGRLLEQFHEGNLTDKSKGLDYKLPEVFVEVSHELAKERDIESGSLVRLSSPYGRIKLRAVVTERMKGYEVYVPMHSVSSETAVNLLTSSAGDVRTKTPAYKQTKVNLTVLEKTGKNPLPDHNPRNRKRFPQNGAEVARKWSREDYQPISKVNCACGGNCGCGGKGRNH

SEQ ID NO: 14587 - protein, 403 aa, Oryza sativa (japonica cultivar-group)
MEGWVATVAYTGTALACAAAATVVALRLVYRHLLHYAEPTHQRFIVRIILMVPVYAVMSFLSLVLPGSAIYFNSIREIYDAWVIYNFFSLCLAWVGGPGAVVVSLTGRSLKPSWFMMTCCFSAVPLDGRFIRRCKQGCLQFVILKPILVVITFILYAKGKYEDGNFSVNQSYLYITIIYTISYSMALFALALFYVACRDLLQPYNPVPKFIIIKSVVFLTYWQGVLVFLAAKSRFIKNAEEAAYLQNFVLCVEMLIAAIGHQFAFSYKEYAGSNARPFGGFRGSLFHALKFNDFYHDTVHQFAPTYHEYVLYSNEEEDEPTKYSSASVVSTVQDIQLVEVSVVDSKAPLASVILTHEADKTMPSHGMEETVAPSEPYDLSNLVDVELSNYSAEVPAIPDVGKQ

SEQ ID NO: 14588 - protein, 476 aa, Arabidopsis thaliana
MQISSSSFITKFTNLHMVRSTSDHHQWRHNYNLKQLFIPNLSVSNSQHLPLNQSVAAIVFGGGSDSELYPLTKTRSKGAIPIAANYRLIDAVISNCINSGITKIYAITQFNSTSLNSHLSKAYSGFGLGKDRFVEVIAAYQSLEDQGWFQGTADAIRRCLWVFEEFPVTEFLVLPGHHLYKMDYKMLIEDHRRSRADITIVGLSSVTDHDFGFGFMEVDSTNAVTRFTIKGQQDLISVANRTATRSDGTSSCSVPSAGIYVIGREQMVKLLRECLIKSKDLASEIIPGAISEGMKVKAHMFDGYWEDVRSIGAYYRANMESIKSYRFYDRQCPLYTMPRCLPPSSMSVAVITNSIIGDGCILDKCVIRGSVVGMRTRIADEVIVEDSIIVGSDIYEMEEDVRRKGKEKKIEIRIGIGEKSRIRRAIVDKNARIGKNVMIINRDNVEEGNREAQGYVIREGIIIILRNAVIPNDSIL

SEQ ID NO: 14589 - protein, 741 aa, Oryza sativa (japonica cultivar-group)
MGRNGSVKRTSSSGAAAAFTANPRDYQLMEEVGYGAHAVVYRALFVPRNDVVAVKCLDLDQLNNNIDEIQREAQIMSLIEHPNVIRAYCSFVVEHSLWVVMPFMTEGSCLHLMKIAYPDGFEEPVIGSILKETLKALEYLHRQGQIHRDVKAGNILVDNAGIVKLGDFGVSACMFDRGDRQRSRNTFVGTPCWMAPEVLQPGTGYNFKADIWSFGITALELAHGHAPFSKYPPMKVLLMTLQNAPPGLDYDRDRRFSKSFKEMVAMCLVKDQTKRPTAEKLLKHSFFKNAKPPELTMKGILTDLPPLWDRVKALQLKDAAQLALKKMPSSEQEALSMSEYQRGVSAWNFDVEDLKAQASLIRDDEPPEIKEDDDTARTIEVEKDSFSRNHLGKSSSTIENFFSGRTSTTAANSDGKGDFSFEAFDFGENNVDTKIMPNGYENARSENSSSPSTSKQDPESKYWRSTSGQKQQTSGTPAVHSGGVNSSTTEKGHGVERDATVQLASDKLRTETRRATNLSGPLSLPTRASANSLSAPIRSSGGYVDSLGDKSKRNVVEIKGRFSVTSENVDLAKVQEVPLSSLSRKSPQASPLKKSASVGDWLVNTKPMSNSHHVKELCNSSVSSSILIPHLENLVKQTMFQQDLIMNVLSSLQQNEKVDGVLSGISPQLRNTDSDTMVGSVNSEKERSLLVKISELQSRMITLTDELIAAKLKHVQLQQELNALYCREEIEDIRDDDNEET

SEQ ID NO: 14590 - protein, 985 aa, Bacillus subtilis subsp. subtilis str. 168
MAGKKTITINGVEMEASEEQTVLQLLNNSSIEVPQVCYHPSLGPIETCDTCIVSINGELKRSCSAELKDGDVIDTLSPDVKKAQVIGMDKILYNHELYCTVCDYNNGGCEIHNTVKEMKINHQSIPFDHKPYHKDESHPFYRYDPDQCILCGRCVEACQDVQVTETLTIDWERKRPRVIWDNDVPINESSCVSCGHCSTVCPCNAMMEKGMEGEAGYLTGINNETLRPMIEITKGVETGYGSILAISDMESAMRDERIKKTKTVCTYCGVGCSFDVWTKGRDILKVEPQEEAPANGISTCVKGKFGWDFVNSEERLTKPLIREGDHFREAEWEEALLLIASKFTELKEAFGPDSLAFITSSKCTNEESYLMQKLARGVIGTNNVDNCSRYCQSPATAGLFRTVGYGGDSGSITDIAQADLVLIIGSNTSESHPVLSTRIKRAHKLRGQKVIVADIRKHEMAERSDLFVQPRAGSDIVWLNAIAKYLIENGKADERFLRERVNGRDEYVKSLAPYTLEYAEEKTGIDQETLIQMAEMIGQADSVCALWAMGVTQHIGGSDTSTAISNLLLVTGNYGKPGAGSYPLRGHNNVQGASDFGSMPDRLPGYEKVTDEQVRQKYERVWGVPLPKEPGMTNHEMIEKIHSGQLKAMYVKGEEMGLVDSNINHVHAAYEKLDFFVVQDIFLSRTAEFADVVLPASPSLEKEGTFTNTERRIQRLYQVFEPLGESKPDWQIIMEVANKLGAGWLYEHPADIMEEAAKLSPIYAGVTYERLEGYNSLQWPVNADGKDSPLLFTERFPFPDGKAILYPVQWTEPKEFGEEYDIHVNNGRLLEHFHEGNLTYKSKGISEKTPEVFLEISPELAAERGIQDGTLVRLTSPFGNVKVKCLITDRVKGKEVYLPMNDSGEAAINLLTGSHADKDTDTPAYKETSAKMEILKHDGISPLPKINHRNGNPQPQIGVQVHKKWARKDYIFPGDAVKRGMGHNG

SEQ ID NO: 14591 - protein, 149 aa, Desulfitobacterium hafniense Y51
MEKTFIMLKPDAVQRGLVGQIIARFETKGCKLVGMKLMSVDQALAEQHYAEHKGKSFFEPTVQYIMSSPVVAMVWEGKNVVALARELMGATNPANANPGSIRGSFGMDISRNVIHGSDSVASAEREIALYFRPEELCDYRKAGEEWLSE

SEQ ID NO: 14592 - protein, 175 aa, Oenococcus oeni PSU-1
MDIDLHDYIATTPDFPEKGVMFRDINPLIGNGPAYRQAINELIDFARPLKPDIIAGPEARGFVVGSPMAYALGIGFVPARKYGKLPRKSVSSSYSLEYGKNELQMHVDSIKPGQRVFIVDDLLATGGTITATMDLVRQLGGQVVGTGFFIELADLQGRKKIMEVENVPFKSLLEY

SEQ ID NO: 14593 - protein, 178 aa, Glycine max
  misc_feature (140)..(140): Xaa can be any naturally occurring amino acid
MASFLQELLIGFPFTSAAYVGEKSKRYLPDPATQYNTSTTSSEQGRVNSVLTGMNRLGRKTNNLATGLKEHVKLGPKITDTVKGKLSLGARILQVGGVEKVFMQLFSVKDGGEKLLKACQCYISTTSGPLAGLLFISTDXVAFCSDRSIKAYSSKGHLIRIHYKVVIPLEKIRSINQS

SEQ ID NO: 14594 - protein, 288 aa, Chlamydophila abortus S26/3
MKLLTASVTPFLPDHSIDFLSFENLLRFQERESHGVVLLGSTGESLSMTAKEKESLVSYACSLNLKVPIIVGVPGTSLHEASEWIHTCQSYPIYGFLITTPIYTKPGVHGQTLWFESLLNKANKPAILYNIPSRSGTTLYLDTVRSLAAHPFFYGLKDSGGSIKHCQEYAQMSSDFVLYCGDDGLWPQMYECGARGLISVLSNIWPKEAREWVEDPHHQYRADLWREVSSWLNQTTNPIAIKALLAYKQVIAHNTLRLPLSIQDLQCAESIPEIIKKMAQWKYSCAHV

SEQ ID NO: 14595 - protein, 591 aa, Arabidopsis thaliana
MAFTFPPSYRTLVGLYYIFTLMHTAVSTPPDDPVKCVSGNTNCTVTNSYGAFPDRSTCRAANVAYPKTEAELVSVVAAATQAGRKMRVTTRYSHSITKLVCTDGTEGLFISTKFLNHTVQADATAMTMTVESGMTLRQLIVEAAKVGLALPYAPYWWGLTVGGMMGTGAHGSSLWGKGSAVHDYVTEIRMVSPGSVNEGFAKIRILSETTTPNEFNAAKVSLGVLGVISQVTFELQPMFKRSLTYTMRNDSDFEDQAVTFGKKHEFADFIWLPSQGKVVYRRDDRVAVNTSGNGLFDFLPFRSQLSAAIAIIRTSEETQERFRDANGKCVGATIISSTLFAPSYGLTNNGIIFTGYPVVGSQNRMMSSGSCLDSLQDGLITACAWDSRIKGEFFHQTTLSVPLTQVKSFISDIKSLVKIEQKSLCGLELHYGILMRYVTSSPAYLGKETEALDFDITYYRAKDPLTPRLYEDFIEEIEQIALFKYNALPHWGKNRNLAFDGVIRKYNNAPAFLKVKDSYDPKGLFSSEWTDQILGIKGNASIVKDGCALEGLCICSKDAHCAPAKGYLCRPGKVYKEARVCTRVDGIISVI

SEQ ID NO: 14596 - protein, 320 aa, Prochlorococcus marinus str. MIT 9303
MVVVVDDKKRMLGSITDGDVRRGLLRGESLQSKAYKIMNHNYRFMYNDSDESNAYEIMKKESLRYIPILDKDGVIKRIISLNEFLEPEKIRNPVVIMAGGKGMRLRPLTEDCPKPMLLVGGKPMLKILLEQFIASGFEEFYFSVNYLKDKIINHFENGERWGVNIRYINEDKPLGTAGSLKLLPSNIKRPFIVINGDVLTRLNTIQLLRFHIDHDALATICVREYEMKVPFGVVQVDGVELKGFKEKPRIRQLVNAGIYVINPALIESIKDGQVIDMPELLLNESNESRRVTVYPIHEYWLDVGRPESLEEAHATWEELK

SEQ ID NO: 14597 - protein, 160 aa, Oryza sativa (japonica cultivar-group)
MEDERNTESHQGGEAASVVTAAPTPAPAPVVTHGDHHHDTAVPVEKIEGDHAKTEATLPRAPEEEKKGFLDKIKEKLPGGHKKPEDATAVPPPAASPAAPATTPAPAHPPPATEEVSSPDGKEKKGILGKIMEKLPGYHKGSGEEDKTAAAATGEHKSSA

SEQ ID NO: 14598 - protein, 513 aa, Neurospora crassa
MTNSPTSSSSAAEDIAENTADEEDQEDYCKGGYHPVTIGEKFKDGKYTVVRKLGWGHFSTVWLSRDNTTGKHVALKVVRSAAHYTETAIDEIKLLNKIVQANPNHPGRRHVVSLLDSFEHKGPNGTHVCMVFEVLGENLLGLIKRWNHRGIPMALVKQITKQVLLGLDYLHRECGIIHTDLKPENVLIEIGDVEQTVKRVVKDEPNDKENTRNSRRRRRTLITGSQPLPSPLNASFNQGSMFPSPAPQSLGQMLAEGAKSQEGSPFHNKNGEDDQSRREKSADLLSKEVSGISLDKTATPPATSGDKRNLDDMQFDIISVKIADLGNACWVNHHFTNDIQTRQYRSPEVILGAKWGASTDVWSMAAMVFELITGDYLFDPQSGTKYGKDDDHIAQIIELLGAFPKSLCLSGKWSQEIFNRKGELRNIHRLRHWALPDVLREKYHFKAEEAQRIADFLMPMLELIPERRANAGGMAGHSWLEDTPGMKGIKIDKVEVGSRGEGIEGWASEVRKR

SEQ ID NO: 14599 - protein, 394 aa, Nicotiana sylvestris
MTTKNRQIKNFTLNFGPQHPAAHGVLRLVLEMNGEVVERAEPHIGLLHRGTEKLIEYKTYLQALPYFDRLDYVSMMAQEHAYSLAVERLLNCEVPLRAQYIRVLFCEITRILNHLLALTTHAMDVGALTPFLWAFEEREKLLEFYERVSGARMHASFIRPGGVAQDLPLGLCIDIDSFTQQFASRIDELEEMLTGNRIWKQRLVDIGTVTAQQAKDWGFSGVMLRGSGVCWDLRKAAPYDVYDQLDFDIPVGTRGDCYDRYCIRIEEMRQSVRIIVQCLNQMPSGMIKADDRKLCPPSRSRMKLSMESLIHHFELYTEGFSVPALSTYTAVEAPKGEFGVFLVSNGSNRPYRCKIRAPGFAHLQGLDFMSKHHMLADVVTIIGTQDIVFGEVDR

SEQ ID NO: 14600 - protein, 178 aa, Glycine max
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 14601 - protein, 297 aa, Dehalococcoides sp. CBDB1
MKELGRLITAMVTPFKTDGTVDYAQAQKLALGLLDSGSDGLVVVGTTGESPTVTWEEEHALFAAVKSAVGNRGKVIAGTGANSTQEALENTLKAEKIGVDACLLVVPYYNKPTQEGLYLHFKTIAEATKLPCILYNVPSRTITHMNPETVIRLSQIPNIVGIKEASGKLDDIAQIINNVRPDFTVWSGNDSDTLPMLAMGSYGVISVASHLVGNQIKDMITSFVSGNTEHAAAIHRHLTPLIRSLFVVSNPIPIKYALNYLGFEVGGLRLPMTEADEKTAALIRESLRGYTIDLPIK

SEQ ID NO: 14602 - protein, 315 aa, Rhodopirellula baltica SH 1
MPTEKHFGPQGWTPDRIGSLQGKTYVITGANAGAGFEATRALLSKGAKVVMMNRNADKSAAAIETLKREFGRDADVTFVRLDLAVLDSVREAASELLDTVPQIDALICNAAIAQVAKQEITVDGFESQLGVNHFGHFLLCGLLFDWIEQSHGRIVVVGSNAYKMGLKKIQFEDLNFDKNYTAWNAYAQSKLAQMMFAYELQRRVEASSKHVQVRVCHPGASRTNLLNDTASLPMKMLWKVISPFIAQSAERGSWPEVMCATEDGLKPQALYGPTKRAETVGPVGECPLEPLALNQEAATQLWSVSEQKVALTWSP

SEQ ID NO: 14603 - protein, 556 aa, Desulfitobacterium hafniense Y51
MKTDIEIAQEATMKPITEIAQGLDLLEDEIELYGKYKAKVNFSAWERLKDKPDAKLILVTAINPTPAGEGKTTTTVGLGQAMSKIGKNAMIALREPSLGPCFGVKGGAAGGGYAQVVPMEDINLHFTGDFHAITSTHNLLAALLDNHIQQGNLLNIDPRQIVFRRVMDMNDRALRKIVIGLGGRTEGIPRENGFDITVASEIMAILCLAKDLMDLKERFGRIVVAYTYDGKAITAHDLEAEGAMALLMKDAIKPNLVQTLENTPVFIHGGPFANIAHGCNSVVATRMAMKLADYVITEAGFGADLGAEKFYDLKCRFAELKPAATVIVATVRALKMNGGVAKEDLGPENLEALAKGIVNLEKHIENIGKFGVPAVVAINRFPTDTDAELEFVAERCRQLGAEFALSEVFTKGGEGGIELAKAVLNIVDNKESNFHVLYELDLPIAKKIETICKEVYGADGVNFTKEALTSMKKYEELGYGQLPICMAKTQYSLTDDQNVLGRPSGFTITVRELRLSAGAGFLVAITGAIMTMPGLPKRPAALRMDIDAAGRITGLF

SEQ ID NO: 14604 - protein, 222 aa, Methanosarcina barkeri str. Fusaro
MLMHVIDMGHDVYKANDKVAEKNKKKLDKYQVFSVNVMGAIGSGKTTLIEEAIRQLKDKYKIAVIAGDVVAEMDSSRFRKLDVPTIPINTGKECHLDAKLVEKALDEIDLSNTDLLIIENVGNLICPVDFKLGEHLRVVIVSVTEGDDIILKHPMIFKTSDLAVINKVDIAHAVDVDAEKMRDDILSLKPNVPVILTSKHDWESLETWISFIELGVKEAQNR

SEQ ID NO: 14605 - protein, 356 aa, Hypocrea lixii
MSRSNPPNNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPEDEPTAPPIPEEFFDFDKHKDTLSKEQLKQLIYQEIMR

SEQ ID NO: 14606 - protein, 392 aa, Bacillus subtilis subsp. subtilis str. 168
MSKHIVILGAGYGGVLSALTVRKHYTKEQARVTVVNKYPTHQIITELHRLAAGNVSEKAVAMPLEKLFKGKDIDLKIAEVSSFSVDKKEVALADGSTLTYDALVVGLGSVTAYFGIPGLEENSMVLKSAADANKVFQHVEDRVREYSKTKNEADATILIGGGGLTGVELVGELADIMPNLAKKYGVDHKEIKLKLVEAGPKILPVLPDDLIERATASLEKRGVEFLTGLPVTNVEGNVIDLKDGSKVVANTFVWTGGVQGNPLVGESGLEVNRGRATVNDFLQSTSHEDVFVAGDSAVYFGPDGRPYPPTAQIAWQMGELIGYNLFAYLEGKTLETFKPVNSGTLASLGRKDAVAIIGANSTPLKGLPASLMKEASNVRYLTHIKGLFSLAY

SEQ ID NO: 14607 - protein, 339 aa, Bacillus subtilis subsp. subtilis str. 168
MKAVQVRKAYDLVTAEVKKPVLSKDDEVLVKVKRVGICGSDMHIYHGTNPLATLPRVIGHEVTGQVEAVGANVQSLKPGDHVVIEPISYCGSCYACRKGRPNVCAKLSVFGVHEDGGMREYIVLPERQLHAVSKDLPWEEAVMAEPYTIGAQAVWRGQVEKGDTVLIQGAGPIGICVLKMAKLAGAAVMMTDLNNERLAFAKENGADAVVNVQAEHVAERVLEWTGNEGANVVIDAVCLPETFALSIEAVSPAGHVVVLGFDERAAQISQLPITKKEVTITGSRLQTNQFPKVVELLNGGRLMHNGLVTHTFSVDDVHHAFQFIKEHPDQVRKAVITFD

SEQ ID NO: 14608 - protein, 181 aa, Halobacterium salinarum
MGSSHHHHHHSSGLVPRGSHMTDHDERTFVMVKPDGVQRGLIGDIVTRLETKGLKMVGGKFMRIDEELAHEHYAEHEDKPFFDGLVSFITSGPVFAMVWEGADATRQVRQLMGATDAQDAAPGTIRGDYGNDLGHNLIHGSDHEDEGANEREIALFFDDDELVDWDRDASAWVYEDLADHD

SEQ ID NO: 14609 - protein, 1097 aa, Tuber borchii
MQLPLLPPSLTTKKPPPQWDPFTPMVTGLSKSACIHPIHTIVIIALLASTTYISLLEDSLFERSGNNWFGGAKRGALLNGSVRVGLGEETQWKWKEIGNQDMEDKSATELALLTLSFPVGSKFRYCARQQLRITLPRISRLLLCHSSSELNTFVDSVAELPTVDGFDNQGRRRRWVQVGLDRTKRGWGERVHEFINTFIGLVKNAEPLDIAIMFLGYLSMHLTFLSLFMSMRRLGSNFWLATTVLFSSTFAFLFASIATHKMGVPINMILLSEGLPFLVVTIGFEKPIILTRAVLEASQKKARQAGSSNGAPIQAAVVAAVRDKGFEIVRDYIIEIIILSLGAASGVQGGLRQFCFLAAWILAFDCILLFTFYTAILVIKLEINKIKHQVTPRKALEEDGDSRRVAENVARSSEWPRINMSEGDANDGGDVTAKVGDAGVFGNRVRDSSVGKFKVLMVTGFVLVNIFNLCTLPFRDNSSSTVIATESQAANVDVWALAGASLDSMISDKVPMVITVLKPIEYELRHLSVEVSPSATGSRGYDSNDSFDGLDLFVEGMGGKVVESLLKSLEDPVLSKWIFVALAMSLVLNGYLFNAARWSVKETGHSQEYEASTIANGSTDNALAPVVVERIVPVNCTCGGGAGTRHSIENGLPIGQETTNEVGRTLTECEEMLKEKRARELNDAELVELSLRGKIPGYALEKTLADTGRAVRIRRSVISRTPATMDKTSLLERSLLPHEHYDYDRVLGACCENVIGYMPLPVGIAGPLNIDGEIFYLPMATTEGVLVASTSRGCKAINAGGGAVTVLTGDGMTRGPVVEFPSVRRAGAAKNWIDSEEGQRRLKKAFDSTSRFARLQTIKTALAGTYLFIRFRTTTGDAMGMNMISKGVECALHVMSTECGFDDMFIVSVSGNYCTDKKPAAINWIEGRGKSIVAEAIIPAAVVKSVLKSDVDALVELNISKNLIGSAMAGSVGGFNAHAANIVTAVFLATGQDPPQNVESSNCITVMKKTVEGALQISVSMPSIEVGTIGGGTILEPQGAMLDLLGVRGAHQTNPGDNARKLARIVAAAVLAGELSLCSALAAGHLVKSHMAHNRKV

SEQ ID NO: 14610 - protein, 389 aa, Methanosarcina mazei Go1
MATKRDYYEILGLSKDSSVEDIKKTYRKLALQYHPDRNKEPGAEEKFKEISEAYAVLSDAEKRAQYDRFGHAGIDNQYSAEDIFRGADFGGFGDIFEMFFGGGRRGGPMGPRRGSDLQYDLYVTFEEAAFGVRKDIDIPRTERCSTCSGTGAKPGTSPKRCPNCGGTGQVRTTRSTLGMQFVSTTTCSACHGRGQVVESPCPTCSGAGRVRSRRKMSVNVPAGADSGMTLRLSGEGDAGEPGAPSGDLYIIVHVMEHKYFKRVDYDVISELPISFTQAALGADIMVDTLYGKVKMNIPSGTQTHSVFRLKDKGIQRLQGHGKGDQLVRVIIRTPTKLTQEQKDLLHQFEYLSNGKKPEAEERSRSDKQKSEKPRKSKGLFEKVKDAFES

SEQ ID NO: 14611 - protein, 662 aa, Cucumis melo
MAPLTFLILLFFIMPPYFFADSKFLYNGFREGKGLFLDGAAIVKSSGALCLTSNSQNVVGHAFYPDPVKLFDTNYPSNASSFSTTFVFAIDPSIPGHGGHGLAFTLAPSTKFDEAESGHYLGLFNPLNDGNSSNHIFAVEFDTVKGHGGVRNSRDNHIGININGVSSVASKYAASSYYIDDTFWKEIQIDSGDPIVAWIDYDGRSKNLSVTIGHLEQKPEKPLIIYSIDLTSVMKNQMFVGFAASTGIETSAHYILGWSFAVNAPARQLKYSLLPNVPKEQNLSSSSDNNPQLKAVLAVSSIVVIMTIVVLTFLFIRMKKAESLEDWEKDCPHRFNFKDIYTATNGFNDSAQIGIGGFGSVYKGKLSSTGAEIAVKRVRRDSSQGMKEFAAEIESLGRLRHKNLVNLQGWCKKKNDLLIVYDYIPNGSLYSLLHTPKQSVILKWEQRFNILKGIAAGLLHLHEDWEQVVIHRDVKPSNVLIDADMNARLSDFGLSRQYDHNEMSHTTRVVGTIGYIPPELFRTGKASKSADVFAYGVLLLEVACGRKPLGSNQFILVDWVMERYETGDILHVADPKLNSIYKVEEMEMVLQLGLLCTHWKQEARPSMKQVMRFLNGEDPLPAFDAWTNSQSIFGSSSRLTMTDRSSSLFVGPISSASINAGR

SEQ ID NO: 14612 - protein, 413 aa, Hypocrea lixii
MADLQGRKVFKVFNQDFVVDERYTVTKELGQGAYGIVCAAVNNQTNEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLRRIGSPRAQEYVRNLPFMPKKPFPALFPDANPDALDLLDKMLAFDPSQRISVEQALEHPYLHIWHDASDEPDCPTTFNFDFEVVEDVGEMRKMILDEVLRFRQLVRTAPASGNQGAAQQIQVPMPSAGGQWTAEDPRPQEYMGHPNGLEQDLQAGMDIRR

SEQ ID NO: 14613 - protein, 851 aa, Fusobacterium nucleatum subsp. nucleatum ATCC 25586
MKQVYEFKDGGKEMVALLGGKGANLAEMAKIDLPIPKGIIISTTACNEYFKNDKKLSTVLEEEILTNIRVLEYETGKKFQSTKPLLVSVRSGAPVSMPGMMDTILNLGFNDYVAEKMLEITKDEKFVYSSYLRFVQMFSEIAKGINRKKFMHLKATDYKAQIIESKNIYREECGEMFPENYKAQILIAVKSIFDSWNNDRAILYRKLHNIDNNMGTAVVIQEMVFGNFNDKSGTGVLFTRNPSTGEDKIFGEVLLNAQGEDIVAGIRTPDNIELLKTSMPNIYNELAETVKRLEKHNRDMQDVEFTIEDSKLYILQTRNGKRTAEASLKIAMDLVKEGIITKEEAILKVEPASINKLLNGDFEEKYLKGATLLTKGLAASSGVAVGRIMFDAKRVKIREKTILVREETSPEDLQGMALAQGIVTLKGGATSHGAVVARGMGKCCVTGCSEIKIDEINKTMTVGKYTLKEGDFISVSGHTGEIYLGKIPLKENSFSDELKEFVLWASEIKRMGVRMNADTPEDVEQGKAFGAKGIGLCRTEHMFFKKDKIWTIREFILSDRGEEKEKALRKLHNLQKEDFLNIFKILEGDEANIRLLDPPVHEFLPKTLEDKKKMAEILSISVENIEKRIYRLKDENPMLGHRGCRLGVSYPELYRIQARAIIEAAYECAKKGIKVHPEIMIPFIMEAKELAYIRAEIEEEVENFFKEVGVTVEYKLGTMIEIPRACLLADEIAEYADFFSFGTNDLTQMSMGLSRDDSVKFLDDYREKGIWEGEPFYSIDTKAVTKLVEIGVKNGKTTKPNLTIGICGEHGGDPKSIEFFEGQKFDYVSCSPFRVPTAILAAAQSYLKLKK

SEQ ID NO: 14614 - protein, 108 aa, Oryza sativa
PTRPPTRPVNWSYAQPTELPNPNSGIDGVKLKDGRVVLVYNSTSRGVLKVAVSQDDGDKWEDVLTLEETHGVEFSYPAVIQTSDGLVHVTYTYKRTQIKHVVLQPSEV

SEQ ID NO: 14615 - protein, 356 aa, Hypocrea lixii
MAEFVRAQIFGTTFEITSRYSDLQPVGMGAFGLVCSARDQLTNQNVAVKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRVTATQALAHEYLQPYHDPTDEPVADEKFDWSFNDADLPVDTWKIMMYSEILDYHNVEGAPNMEEQFPPQ

SEQ ID NO: 14616 - protein, 398 aa, Pylaiella littoralis
MALKKKEFNKKLKHFTINFGPQHPAAHGVLRLILELNGEVVQRADPHIGLLHRGTEKLIEAKTYFQALPYFDRLDYVSMMCQEHTYALSVENLLQVSIPRRAQFIRVLFAEITRILNHLLAVGCHAMDVGAMTPFLWAFEEREKLMEFYERVSGARMHASYFRPGGVSQDISVGLVDDIFAFVAQFGQRLDEIEEMLTDNRIWQERLVDIGVVSAQEAIDWGFSGVMLRGSGIRWDLRKNEPYEIYSDLNFQGVVGKTGDCYDRYLARVEEMRQSLSIIYQCLNKMPRGSVKIDDAKISPPSRSEVKQSMESLIHHFKLYTEGVFVPAGETYTATEAPKGEFGVYLVSKGSSRPYRCKIKAPGFSHLQGLNFMACSHMLADVVTIIGTQDIVFGEVDR

SEQ ID NO: 14617 - protein, 645 aa, Fusobacterium nucleatum subsp. nucleatum ATCC 25586
MYYNFNHYINLGANLEKDGCSFAIYAKNVNSLSLNIFHSSEDTVPYEKHILSPSEHKLGDIWSIFLENIKEGTLYNWEINGMAILDPYALAYTGNETIENKKSIVLARVGTETKHILIPKKDMIIYESHIGLFTKSSSSNTLNGATYSAFEEKIPYLKNLGINVVEFLPIFEWDDFTGNLDRESFFLKNVWGYNPINFFALTKKYSSSKDENSANEINEFKKLIFSLHKNGIEVILDVVYNHTAEGGTGGKVYNFKAMGENIFYTKDRENYFTNFSGCGNTLNCNHKVVKDMIIQSLLYWYLEVGVDGFRFDLAPVLGRDSNNQWARHSLLHELIEHPILSHAKLIAESWDLGGYFVGAMPSGWCEWNGAYRDTVRQFIRGDFGQVPELIKRIFGSVDIFHANKNGYQSSINFICCHDGFTMWDLVSYNLKHNILNGENNQDGENNNHSYNHGEEGFTENPHIISLRKQQIKNMILILYISQGIPMLLMGDEMGRTQLGNNNAYCQDNPTTWVDWDRKKDFEDVFLFTKNMINLRKSYSIFKKETPLIEGEEVILHGIKLYQPDLSFHSLSIAFQLKDIKSNTDFYIAFNSYTEQLCFELPILENKSWYILTDTSKVDTCNFQETKCQDTHCCVLPKSSVILISK

SEQ ID NO: 14618 - protein, 379 aa, Frankia sp. CcI3
MAVDYYAVLGVRREASNDEIKRAYRKLARELHPDVNPDPDAQQRFRGVTAAYEVLSDPEKRQIVDLGGDPLAPGGSGGGGSPFGAGFGGLGDIMDAFFGGGSSRGPRSRVRRGNDALLRIELDLSETAFGATREITVDTAAVCSTCTGAGAAPGTHPSTCGTCGGRGEVQQVTRSFLGQMVTSRPCPRCSGTGTVIEHPCRDCGGDGRVRKRRTLTVKIPSGVEDGMRIRLSGEGEVGPGGGPPGDLYVEVSEKQHPVFTREGDDLHCELPLPMTSAALGTSATLETLDGTETIAVKPGTQPGEVIKLAGRGVPHLRAAGRGHLHIHINVETPTKLDGEQERLLRELAKLRDEEAPAVVGGSAGGAAGLFRRRGTRRGR

SEQ ID NO: 14619 - protein, 447 aa, Escherichia coli
MDQTYSLESFLNHVQKRDPNQTEFAQAVREVMTTLWPFLEQNPKYRQMSLLERLVEPERVIQFRVVWVDDRNQIQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSLPVDIALPCATQNELDVDAAHQLIANGVKAVAEGANMPTTIEATELFQQAGVLFAPGKAANAGGVATSGLEMPQNAARLGWKAEKVDARLHHIMLDIHHACVEHGGEGEQTNYVQGANIAGFVKVADAMLAQGVI

SEQ ID NO: 14620 - protein, 553 aa, Oryza sativa (indica cultivar-group)
MGIGIGIGIGIGIGTGTGAALPFGEASPWSLLGGAVAALLLVWAAQMLEWAWLAPRRMERALRAQGLRGTQYRFLHGDLTEDLRLVTAARSKPVPMDRPHDFIPRVAPLLHRALEEHGRVSFTWFGPMPRVTITDPDLVREVLSNKFGHFEKTKLATRLSKLLVGGLVILHGEKWVKHRRIMNPAFHAEKLKVELNILELEINLVTLTFLRMLPAFSASCSELIGRWENAVAASVGKAELDIWPDFQNLSGDVISRAAFGVRHHEGRQIFLLQAEQAERLVQSFRSNYIPGLSLLPTENNRRMKAIDREIKSILRGIIEKRQKATKNGEASKDDLLGLLLQSNMDYYSDEDGKSSKGMTVEEIIDECKLFYFAGMETTAVLLTWTMVALSMHPEWQDRARAGDSAADLWQVTMVLHEVLRLYPPVVMMNRRTYKEIELGGVRYPAGVMLSLPVLFIHRDAAAWGHDAGEFDPGRFAEGVARACKDPGAGAFFPFSWGPRICIGQNFALLEAKVALGMILQRFAFELSPAYAHAPYTVLTLHPQHGVPVRLRRL

SEQ ID NO: 14621 - protein, 481 aa, Oryza sativa (indica cultivar-group)
MLMMLGAASQWILAAAAAAAVAALLWLAVSTLEWAWWTPRRLERALRAQGIRGNRYRLFTGDVPENVRLNREARKKPLPLGCHDIIPRVLPMFSKAVEEHGKPSFTWFGPTPRVMISDPESIREVMSNKFGHYGKPKPTRLGKLLASGVVSYEGEKWAKHRRILNPAFHHEKIKLPKTVVKNAPLRIVKLNYLTVLLEMYQWYDNYDLEYTKIWFLPTKNNRRLREIEREVSKLLRGIIGKRERAIKNGETSNGDLLGLLVESNMRESNGKAELGMTTDEIIEECKLFYFAGMETTSVLLTWTLIVLSMHPEWQERAREEVLHHFGRTTPDYDSLSRLKIVTMILYEVLRLYPPVVFLTRRTYKEMELGGIKYPAEVTLMLPILFIHHDPDIWGKDAGEFNPGRFADGISNATKYQTSFFPFGWGPRICIGQNFALLEAKMAICTILQRFSFELSPSYIHAPFTVITLHPQHGAQIKLKKI

SEQ ID NO: 14622 - protein, 429 aa, Cryptococcus neoformans var. neoformans JEC21
MSHLLPPNLLKLFAPRPQPPFLKPLTRDERIRGPNNLGGVAGLAKRIKEEAEDAEVKQGMGMNPEKALDEQKEENVKMELKQDGEDGEVAEDSGKEKKKKTARDKIAEMGIIGEEAVKMRKELRKKRQEEYKKNAESNYKPQDDAQAIGDPYKTLFISRLSKKANETDLRREFEMYGPIERIRIVRNRKGKSNGYAFIVYERERDMKAAYKDAEGIPIHHKKILVDVERGRTVKGWKPQRLGGGLGGRPKPVAPEASPAPYVAPSNLRGGRGGFRGGGRGGGAGFRGGFQGNRGGFGGGNRGGFGGGDDRGGFAGRGGFRGGFQNRGDRGPGGFGQQQGGFGGPGGPGGYGGQGGGYGGGGGGFGGPGQQNGVQGGQGGGGFGGGGGYKRDYDNAGGPGGYGGGGGGGGGGFGGGGGGYQDRDPKRMRY

SEQ ID NO: 14623 - protein, 253 aa, Xanthomonas oryzae pv. oryzae KACC10331
MAQPERSAPSVFLHHGFRPPLPSPLLCLWKTARMNELNHLLENNRAWSERIRREDPEFFSKLSTQQTPEYLWIGCSDSRVPANQIIDMAPGEVFVHRNIANVVVHTDLNCLSVIQFAVDVLKVKHVLVVGHYGCGGVFASLTQKRMGLVDNWIRHVTDVADKHEACLHDAGDLPIQHARLCELNVLEQVVNVCRTTIVRDAWERGQELYVHGWVYSLRDGRAHDLGMSIDRHELVQERYDAALAKIQADRAER

SEQ ID NO: 14624 - protein, 164 aa, Halobacterium salinarum
GSHMTDHDERTFVMVKPDGVQRGLIGDIVTRLETKGLKMVGGKFMRIDEELAHEHYAEHEDKPFFDGLVSFITSGPVFAMVWEGADATRQVRQLMGATDAQDAAPGTIRGDYGNDLGHNLIHGSDHEDEGANEREIALFFDDDELVDWDRDASAWVYEDLADHD

SEQ ID NO: 14625 - protein, 511 aa, Oryza sativa (indica cultivar-group)
MVYGLLGLALLWQVHRLLVRLWWQPRRLERALRAQGVRGTSYRFLTGDLKDYGRLSKEAWARPLPLRCHDIAPRVAPFVHRTIAEHGKACLSWFGPIPKVTIADAEIAKDVLSNKMGHFEKLKFPVLSKLLADGVANYEGEKWAKHRRILNPAFHLEKLKLMLPAFSACCEELVGRWAASLGSDGSNEIDVWPEMQSLTGDVISRTAFGSSYLEGRRIFQLQAEQQELFMGAIQKISIPGYMSLPTKNNRRMYQIKNEVESIIRDLVQKRMHAMKDGERTKDDLLGILLESSTRHADDNGHSGPGMTIEEVMEECKVFYFAGMETTAILLTWTMVVLSMHPEWQHRAREEVLSLFQKNKLDYEGLSKLKTVTMILYEVLRLYPPGIGFVRQTYKEMEIGGVKYPAGVMIELPLLFIHHDPDIWGSDVNEFKPERFAEGISRASNDHGAFFPFGWGPRICMGQNFALLEAKMALCMILQRFEFELAPSYTHAPHIVLMLRPMHGAPIKLRAI

SEQ ID NO: 14626 - protein, 550 aa, Oryza sativa (indica cultivar-group)
MEEATGMEVGVSLEAGKPAAAPWGMLYYGVPALLVLGALYRAAERCWLGPRRVAGALQGQGLRGTAYRFPAGDLPENARRSKEARAKPMPPCHDIVPRVAPLLQDVVKEYVNTSSYILQKVCACCYVQFTLFIELYLTAQNTELNVGNVCITWFGTTPRVVIAEPELVKDILSNKFGHFEKFTLKSLGKLIALGLASYEGEKWARHRRILNPAFHLEKLKRMLPAFSTCCSEMIDRWDSKLAGSDGPFELDIWQEFQNLTGDVISRTAFGSSFMEGRRIFQLQEEQADRIIKTIQYIYIPGYLYFPTENNRRMKENSREIEGLLRGIIEKRSRAVENGELSGDDLLGLMLKSNMDSGEPSNLRMSTEDVIEECKLFYFAGMETTSVLLTWTLVVLSMHPEWQHRAREEVTMILHEVLRLYPPAVTLSRRTFKEIQIGGITYPAGVGLELPIILIHHNTDVWGKDAHEFKPERFADGISKATKTNQRAFFPFGWGPRICIGQNFAMLEAKMVLCVILQNFEFQLSPSYTHAPYASVTLHPQHGAQIILTRI

SEQ ID NO: 14627 - protein, 528 aa, Oryza sativa (indica cultivar-group)
MVLGAWLMSPASVPWSLLAYGVLGLVLLWQAGRLLHSLWWRPRRLELALRAQGLRGTRYRFLTGDLGEHGRLNREAWARPLPLRCHDIAPRVAPFLHNAVREHGSACFTWFGPTPKVTITDPDLAKDVLSNKFGHFEKPKFPTLTKLFSDSLANHEGEKWVKHRRILNPAFHLEKLKLMLPAFSACCEELVSKWMESLGSDGSYEVDVWPEMQILTGDVISRTAFGSSYLEGRRIFQLQAEQTERLLKCMQKIVIPGYMSLPTKNNRKMHQIKKETDSILRGLVDKRMQAMKEGECTKDDLLGLLLESNMRHMEEDGQSNHGLTIEEVIEECKLFYFAGMETTSVLLTWTILLLSMHPEWQDRAREEILGLFGKNKPEYEGLSRLKIVTMILYEVLRLYPPAITFTRKTYKQMEIGGVTYPAGVIVELPVLLIHHDPNIWGSDAHEFKPDRFAEGISKASKNPGAFLPFGWGPRICIGQNFALLEAKMALCMILQCFKLELMPSYTHAPYSMVTLRPMHGAQIKLRAI

SEQ ID NO: 14628 - protein, 471 aa, Oryza sativa (indica cultivar-group)
MVLGAGLRCPASVPWSSLAYGLLGLVLLWQGGRLLHRLCWRPRRLELALRAQGLRGTRYRFLTGDLGEHGRLNREAWARPLPLRCHDIAPRVAPFLHSSVREHGKACFSWFGPIPKVTIANPDLAKDVLSNKFGHLEKHKFQGLTKLLSDGVASHEGEKWVKHRRILNPAFHLEKLKTLQRMLPAFSTCCEELISRWMESLGSEGSYEVDVWPEMQSLTGDVISRTAFGSSYLEGRRIFQLQAEQAERLLKCVQKIIIPGYMSLPTKNNRKMHQIKKEIDSILRGLIGKRMQAMREGESTKDDLLGLLLESNMRHTAEHGQSSQGLTIEEVTIILYEVLRLYPLAVTLTRQTYKQIEIGGVTYPAGVIIELPLLLIHSDPDIWGSDVHKFNPERFAEGISKASKDPGAFLPFSWGPRICIGQNFALLEAKMALCMILQHLELELALSYTHAPQSIITLRPTYGAQIKLRAI

SEQ ID NO: 14629 - protein, 484 aa, Staphylococcus aureus subsp. aureus N315
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQK

SEQ ID NO: 14630 - protein, 339 aa, Triticum aestivum
  misc_feature (293)..(293): Xaa can be any naturally occurring amino acid
MAAIATKWTSGPVPFTDVDDGTVPKRPAKEEFGSLVAALPRKNQAGLELRLYQGFWLPDHWVAGTVVFQRRFVPRADDVILASYPKCGTTWLKALAFATMTRDAYPAPAQHPLLRLNPHDCIPFLDEIFADGQEAKLERLPSPRLMNTHMPHTLLPESVTGADVAGCKVVYVCRDPKDMVVSLWHFLRRRQPDLPFAELFEHVCDGAVAVGPIWDHVLSYWRASLARPDRVLFLRYEDLLLDTGKHVRRLAEFMGRPFSPAEEGAGAVEAVVELCSFEKMKGLEVNKKGSAGXYHAMPRDSFFRKGVAGDWVNHMTPEMATRLDEVVRDKFRGTGLAAP

SEQ ID NO: 14631 - protein, 116 aa, Triticum aestivum
MAAASGTAATFSIRTPAPGLRRPCARAAAAGGGAKWWAPLLGWSGQPDYIDSQPAAEPAPKEERGKRRFGVLTEEKARQLRLRMMETESFHDVMYHSAIASRLASAPPDTARRTKP

SEQ ID NO: 14632 - protein, 132 aa, Zea mays
  misc_feature (125)..(125): Xaa can be any naturally occurring amino acid
MATGPRSLHALLGGGAVADLLLWRRRNASAAAVVGATTVWFVFERAGYSFPSVLSNALLLLVAILFFWAKSASLLNRPLPPLPNLEVSDAIVEKAANHALVWINRLLAVGHDIAIKRDRKVFIKXVILILWV

SEQ ID NO: 14633 - protein, 395 aa, Bradyrhizobium japonicum USDA 110
MHDATLRNRLGQWLEPSRRSDVPPFMVMDVMAAAARIEAAGGHVIHMEVGQPAAGAPKTAIAAAHAALEAGRIDYTSALGIPSLRERIARHYRDAHGCDVSAERIVVTTGSSGGFILAFLSMFEPGDRVAVTVPGYPPYRHILTALGCEPVLIETTNETRHALTGEALLAAHRKAPLKGVLVGSPANPTGTMMSREALSGLIAAAEDAKIRFISDEIYHGLDYAFPAVTAAALSDHALVINSFSKYFCMTGWRVGWMVVPELLVRPIERLQQNLSISVPSLSQIAAEAAFDGTAEMGEIKHGYQENRRILIEGLPKAGLTRFLPADGAFYLYADVSDFTSDSFEFAKQMLEQAHVAATPGLDFDPIHGRSFIRFSYARSAAEMREAVDRIAHWLK

SEQ ID NO: 14634 - protein, 308 aa, Aspergillus nidulans FGSC A4
MTRTHPSSFQQLEKLGEGTYATVYKGRNCQTGEMVALKEIHLDSEEGTPSTAIREISLMKELHHDNILSLYDVVHTENKLMLVFEYMDQDLKKYMDTHGNHGQLEPAIVKSFAFQLLRGIAFCHDNRILHRDLKPQNLLINSKGQLKLADFGLARAFGIPVNTFSNEVVTLWYRAPDVLLGSRTYNTTIDIWSIGCIIAEMFTGRALFPGTTNEDQLQKIFRVMGTPSERTWPGVSQFPEYKSDFPVYPPQDLRQVVPRIDPYGLDLLRCMLRLQPDLRISAVDALRHPWFNDPVSDLPIDHGMEALT

SEQ ID NO: 14635 - protein, 106 aa, Glycine max
IHSLATMSPSANTNGTSATNGSSKPRPTFAVKAGLAQMLKGGGIMDVVNVEQAKIAEAAGACAVMALQRIPSDIRKDGGVARMSDPHMIKEIMEAVSIPGMAKSRI

SEQ ID NO: 14636 - protein, 174 aa, Triticum aestivum
MAPAVMASSATTVAPFQGLKSTASLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 14637 - protein, 472 aa, Oryza sativa (japonica cultivar-group)
MPPPPPSKNRGHVPAPRPPPGKPPGRRMASRDAAERAAFFARREAAAVLRRVLRGDASRRAAGSIKSLVYSPSVRNKRATFALVCQTLKYLPILKEVLASTGVLTSKWKKQEELVFVTAYDILFGQETAASGSVEQLIMLHKDTIMAALEKMCIRRKVRSVEDLVSKKRTVKPKPRFLRVNTLRTSTDSVIEELNKIHKGKASCMVAVALCPEPGWKVIDACAAPGNKTVHLAALMNGEGSITACELNKERTKTLQNTIRRSGANNIETINGDFLDIDSNDPSYAEVRAILLDPSCSGSGISTERLDHLLPSHSRGNQDDASTSSRIRKLSAFQRKALSHALSFPSVERVVYSTCSIHQAENEDVVSSVLPLASSLGFELATPFPQWRRRGLPVFEGSEHLLRTDPEDGLEGFFISLFVRKAAAAADAVKPSNGGLGVSKQVFKRRNGLMAFGSSRLSRMMMLCSTRGLSRR

SEQ ID NO: 14638 - protein, 415 aa, Oryza sativa (japonica cultivar-group)
MVIASNKHELMKYLSLTLERHRLQKQQLCRWIRHDDLDMLTDELERKRYRTLILMADTFLANDLRQFPSAKRKASLYTSTLANIFILMLKGSTGIQLLSLFSGYMKDDVSSAVETQLAESCRLESGVETCRLLVSSVAVKCEASNSPSTTVGFDRMIAADYDLFHHMSFSPSLQNLQSPTFFTTRSSESYLGESSIYGGGARPALAQFSYSQPIAATSAAHLVRWTAAGEPMTGDGGFRSSKRLKTATTATTQPPRHGVKCHAKPRNQTTKATCKKRSQKLGDRITALQQLVSPYGKTDTASVLHEAAACIRQLHQQIQILTAPYPGTSSSSASSQQQVVFSVLESCSHVMSFFTAIATVLWLQDAGGGGGTATELRRRGLCVAALSPAVVSLAAEGGRRRTDVEDQKRIWFSNQ

SEQ ID NO: 14639 - protein, 377 aa, Escherichia coli
GTGLRQAPRESISQLIDHANSHPAPIVAVDIPSGLLAETGATPGAVINADHTITFIALKPGLLTGKARDVTGQLHFDSLGLDSWLAGQETKIQRFSAEQLSHWLKPRRPTSHKGDHGRLVIIGGDHGTAGAIRMTGEAALRAGAGLVRVLTRSENIAPLLTARPELMVHELTMDSLTESLEWADVVVIGPGLGQQEWGKKALQKVENFRKPMLWDADALNLLAINPDKRHNRVITPHPGEAARLLGCSVAEIESDRLHCAKRLVQRYGGVAVLKGAGTVVAAHPDALGIIDAGNAGMASGGMGDVLSGIIGALLGQKLSPYDAACAGCVAHGAAADVLAARFGTRGMLATDLFSTLQRIVNPEVTDKNHDESSNSAP

SEQ ID NO: 14640 - protein, 507 aa, Escherichia coli
MTQLAIGKPAPLGAHYDGQGVNFTLFSAHAERVELCVFDANGQEHRYDLPGHSGDIWHGYLPDARPGLRYGYRVHGPWQPAEGHRFNPAKLLIDPCARQIDGEFKDNPLLHAGHNEPDYRDNAAIAPKCVVVVDHYDWEDDAPPRTPWGSTIIYEAHVKGLTYLHPEIPVEIRGTYKALGHPVMINYLKQLGITALELLPVAQFASEPRLQRMGLSNYWGYNPVAMFALHPAYACSPETALDEFRDAIKALHKAGIEVILDIVLNHSAELDLDGPLFSLRGIDNRSYYYWIREDGDYHNWTGCGNTLNLSHPAVVDYASACLRYWVETCHVDGFRFDLAAVMGRTPEFRQDAPLFTAIQNCPVLSQVKLIAEPWDIAPGGYQVGNFPPLFAEWNDHFRDAARRFWLHYDLPLGAFAGRFAASSDVFKRNGRLPSAAINLVTAHDGFTLRDCVCFNHKHNEANGEENRDGTNNNYSNNHGKEGLGGSLDLVERRRDSIHALLTTLLLS

SEQ ID NO: 14641 - protein, 897 aa, Frankia sp. CcI3
MARYVYGFHQGNKDMKDLLGGKGANLAEMTNLGLPVPPGFTISTQACREYLAGGEPVGLRAEIDHHLATLETARGRRLGQADDPLLVSVRSGAKFSMPGMMDTILNIGLTDQAVLGLAEQSGSPRFAWDSYRRLLAMFGRTVLGVGEPSFDAALEAAKRAKGTSSDLDLDENDLRALVATYQRIVLERTGRPFPQDPREQLDLAIRAVFDSWNGPRARLYRRTERIPDDLGTAVSVVAMVFGNLGTDSGTGVAFTRDPGSGEPGVYGDYLPNAQGEDVVAGIRNPVPLAELERIDPASFTELREIMTRLEKHYRDLCDIEFTIEHGRLWILQTRVGKRTAAAAFRIAAMLAEGGVIDDDEALCRVSGDQLATLMFPRFDDTARPAPIATGVNAAPGAAVGEAVFDAAEAVRVAAEGRPVILVRRETNPDDLAGMLAARGILTSRGGRTSHAAVVARGLGRTCVCGAEEIEVDPAGRRLTTGRGVVVREGDILSIDGTIGAVYPGSVPLVPSPVVEYFEAGRPDHPRPGGDLVAAVDRLMRHADRSRRLRVRANADTGPDAARARRFGAAGIGLCRTEHMFLGDRRTLVEQMILAGTPAERTEALSRLLPPQREDFVEIFTAMDGLPVTVRLLDPPLHEFLPDLTELSVSIAAADAAGRPVDDADRERLAVLRSMHETNPMLGRRGVRLALTVPGLVELQARAIAEALVRCRRVGGDPRPEIMVPFISTATELDAIRDRVRGVLAEVGTESGLEIDLPIGTMIEVPRAALTADQIARRAEFFSFGTNDLTQLLWGFSRDDVEASLLPRYLDLGILAGSPFASVDRDGVGALMRTAVRAGRGARPDLGLGVCGEHGGDPDSVHFFAELGLDYVSCSPFRVPVARLEAGRAAVLGRSTVG

SEQ ID NO: 14642 - protein, 650 aa, Oryza sativa (indica cultivar-group)
MPDYKVPGIEIVSNVISMTSSGLPVESRRLKVWAFVSDVRGHWASASPAQSWSRGWRCPLLPAAATSPAAHLAAAAAGGASLLRDSPAGAEREAPLAAAAAPAGRGVGRVGRRRGESTAMVFGELFSRASLPPPWSLLAYGLVGPVLLWQAGRLLDRLWWRPRRLERALRAQGLRGTAYRFLLGDLREFGRLNEEAWSSAPLPLGCHDIVPRVTPFVHRNVRDNGRPCCFSWFGPIPSVTITDPAQVRDVLSNKLGHFEKPKLPALTKLLADGLTSHDGEKWVKHRRIMNPAFHLEKLKLMLPAFSTCCEELVGKWMDSLGPDGSCELDVWPEMQSLTGDVISRTAFGSSYSEGRRIFQLQTEQAELFIGAIQKIVIPGYMYLPTKKNRRMRRINSEVESILRGIIGKRMQAIAEGESTNDDLLGLLLESNMRHADENGRSSPGMTTEDVIEECKLFYFAGMETTSVLLTWTMVVLSMHPEWQDRAREEVLGLFGRDKPEYEGLSRLKTVTMVLYEVLRLYPPAIVFSRKTYKEMEIGGVVYPRGVILELPVLFIHHDREIWGRDVHEFRPERFAEGISRASNDRGAFLPFGWGPRVCIGQNFALLEAKMALCMILQRFEFELAASYTHAPHTVMTLHPMHGAQMKLRMI

SEQ ID NO: 14643 - protein, 531 aa, Oryza sativa (indica cultivar-group)
MGMVVFAAGDERPLMLVWAVVAGAVLAWCAVRAMEWAWWRPRRLERALRAQGLRGTPYRSPAGDAPLNVQLSAEARARTMPLGCHDVVPRAMPLFHQAMKEHGKVSITWFGPVPRVTITKPELVREVLSNKFGHFEKLKFGRFQRLLHNGLGSHEGEKWAKHRRIINPAFHLEKLKRMLPAFAACCTELVDKWEGLAKGGDEPYEVDVWPEMQSLTGDVISRAAFGSSYLEGKRIFQLQGEQIELIVATMNKIHIPGYIHLPTKSNRRMKQIAAEIEGMLKRIIAKRESALKAGEASSDDDLLGLLLESNLDHSKGNGGAASSGISIDDVIGECKLFYFAGMETTSVLLTWTMVVLSMHPEWQDRAREEVLHVFGSRAPDYDGLSRLRIVTMVLYEVLRLYTPLTALQRKTYKPMELGGVRYPAGVVLTLPLLCVHHDKDVWGADADEFRPERFAEGISKASREAPAFFPFGWGPRICIGQNFALLEAKMGLSMILQRFSFDLSPSYTHAPFPVGLLQPEHGAQVRLTRLN

SEQ ID NO: 14644 - protein, 590 aa, Pseudomonas syringae pv. tomato str. DC3000
MCGLAGELRFDHQPADLAAVERITHELAPRGPDAWGFHSQGPIALGHRRLKIMDLSDGSAQPMIDSNLGLSMAFNGAIYNFPELRAELESLGYQFHSGGDTEVLLKGYHAWGAEMLPKLNGMFAFAIWERDSKQLFIARDRLGVKPLYLSKTDKRLRFASSLPALLKGGDISGMLDPVALNHYLNFHAVVPAPRTLLAGVEKLPPASWMRIDASGKVEQKVWWTLPYGPHEDEKNLTLEDWRDRVLDSTREAVAIRQRAAVDVGVLLSGGVDSSMLVGLLREVGVEDLSTFSIGFQDAGGERGDEFQYSDLIAKHYGTRHHQLRIQESEIIEQLPAAFRAMSEPMVSHDCIAFYLLSREVAKHCKVVQSGQGADELFAGYHWYPQVDGASDPVAAYRYAFVDRSYAEYADTVQPKWRTANDAAGDFVRDHFAQPGASAAVDKALRLDSTVMLVDDPVKRVDNMTMAWGLEARTPFLDYRLVELSARIPGKFKLPDGGKQVLKEAARLVIPSEVIDRKKGYFPVPGLKHLQGDTLNWVRELLTDPSQDRGLFNPTMVDKLLTNPEGQLTPLRGSKLWQLAALNLWLSEQGL

SEQ ID NO: 14645 - protein, 340 aa, Nostoc punctiforme PCC 73102
MSDLMNKQIILKSRPVGEPKESDFALVETPTPEPGEGEILSRTIYLSLDPYMRGRLSASESYAASVELNSAIVGGTVSQVVKSNHPQFQVGDFILSNNGWQTYAVSKAETLRKLDPTQAPLSYSLGVLGMPGLTAYAALLDIGQPKEGETVVVSAASGAVGAVAGQIAKIKGARVVGIVGSDDKRDYIVKELGFDVGINRKTQELDSALKEAAPNGIDVYYDNTAGVILETVLQQINLGARIPLVGLISEYNATSTPSGPNLMPLLVKRALIKGFLVTDYQHRFNDFLRDVSGWLQSGQLKYKEDVVMGLENAPHAFIGLLRGDNFGKLIVKVNDDPTAK

SEQ ID NO: 14646 - protein, 547 aa, Oryza sativa (indica cultivar-group)
MEIVDGASPPLHPWSLLLYALGALAALWWAWRALDRFWLRPRRLGRALRSQGLRGTDYRFPSGDLKEFARLLAAALAAPMPPLSHDVASRALPFELAAIKQHAYTHAPANVRDQTEVAWNAGNVCVTWFGPEARVIVSDPKLFREILANKNGRFGKQKSILWVQNLLADGLTSHQGEKWVAHRRIMNHAFHLEKLKRMLPAFAACSSELISRWQDSVGADGAQEIDVWPEFQNLTGDVISRSAFGSSFSEGRRIFQLQSEQARNVMKMAKALYFPGYRFLPTELNRRTKANAREVRELLKGIITKRESAMKDGHAVNDDLLGLLLETNIKESQEAGSSKPTMTTKDIIEELKLLYFAGSDTTAVLLTWTMVLLSMHPKWQDRAREEVLRVFGKNSPDFEGINHLKVVTMILHEVLRLYPPILLLGREAYEETELGGVTYPPGVTFALPIACIHHDPDVWGEDVGEFKPERFAEGVSRASKDSPALVPFSWGPRICVGQNFALLEAKMALSMILQRFSFGLSPSYTHAPFPIPTLQPQHGAQIKLTKL

SEQ ID NO: 14647 - protein, 79 aa, Rhodopseudomonas palustris CGA009
MLAVLLPVRAIGVMGDGRTYDYVVGLRVVTSTNGMTADFYPFDIFLLGANAMRNLNEVKDVNRLVSDIISKPPGKIGWV

SEQ ID NO: 14648 - protein, 329 aa, Frankia sp. CcI3
MSAATMVRALNAALRDSLREDARVHILGEDVGTLGGVFRVTDGLAAEFGAQRCLDTPLAEAGILGTAVGMAMYGLRPVVELQFDAFAYPAFEQLASHVAKMRNRTAGKTTLPITIRIPYGGGVGGVEHHSDSSEAYYAHTPGLHVVTPATVADGYGLLRSAIASDDPVVFLEPKRLYWSTDERSTDDFSAAEVPPIGRAVVRRTGTSATLLTYGPSLPVCLQAAAAARSEGWDLAVVDLRSLVPFDDETVCEAVRATGRAVVVHEAAGFGGVGAEIAARVSERCFHHLAAPVLRVTGFDIPYPPPMLEHHYLPSVDRILDAVARLQWEQ

SEQ ID NO: 14649 - protein, 888 aa, Vibrio angustum S14
MSEVMKSDVDVLETQDWLEALESVVREEGVERAQFLLEQVLEKARLDGVDMPTGVNTNYINTIPAAQEPAYPGDVTLERRIRSIIRWNAIMIVLRASKKDLDLGGHMASYQSASAFYEVCFNHFFRAPNDVDGGDLVYYQGHISPGIYSRAFVEGRLTEEQLDNFRQEVDGKGIPSYPHPKLMPEFWQFPTVSMGLGPISAIYQARFLKYLEGRGLKDTSAQRVYAFLGDGEMDEPESRGAISFAAREKLDNLCFLINCNLQRLDGPVMGNGKIIQELEGLFKGAGWNVVKVIWGNNWDALLAKDTSGKLLQLMNETIDGDYQTFKSKDGAYVREHFFGKYPETAALVSDMTDEQIFELKRGGHDSSKLFAAFNNAKETSGKPTVILAKTVKGYGMGEAAEGKNIAHGVKKMDMTHVQYLRDRLGLQDLISEEELKTLPYLKLEEGSAEYNYLHARRDALHGYTPKRSPKFTQEFKVPELDAFAPLLSEQKREISTTMAYVRTLNILLKDKAIGKNIVPIICDEARTFGMEGLFRQVGIYNPDGQTYTPEDKGIVSFYKEATSGQVLQEGINELGSMASWVAAATSYSTNDLPMIPFYIYYSMFGFQRIGDMAWLAGDQQARGFLLGATAGRTTLNGEGLQHEDGHSHILANTVPNCISYDPTFAYELAVIMQDGIRRMYGENQENVYYYLTVMNENYAMPAMPEGAEAGIRKGIYKLESHAGDKSKVQLMSSGTIMNEVRKAAQILSEEYGVASDVYSVTSFNELTRDGQDCERYNMLHPTAEKKVPYLTTAMGSEPAIAATDYMKNYAEQVRAFMPSESYKVLGTDGFGRSDSRANLRRHFEVNAGYVVVAALSELAKRGDIDNAVVVDAIAKFDIDADKINPLYA

SEQ ID NO: 14650 - protein, 476 aa, Vibrio angustum S14
MSKEIKAQVVVLGSGPAGYSAAFRCADLGLDTVLIEKFNTLGGVCLNVGCIPSKALLHVAKVIEEAKAMAEHGVVFGEPQTDINKIRLWKDKVITQLTGGLGGMAKMRKVNVVNGYGKFTGPNSIVVEGADGPTTVNFDNAIIAAGSRPIELPFIPHEDPRIWDSTDALELKEVPEKLLVMGGGIIGLEMGTVYHALGSQIDVVEMFDQVIPAADKDIVKVFTKRIAKKFNLMLETKVTAVEAKEDGIYVTMEGKKAPAEPVRYDAVLVAIGRVPNGKLIDAEKAGINVDERGFINVDKQMRTNVAHIHAIGDVVGQPMLAHKGVHEGHVAAEVISGKKHYFDPKVIPSIAYTEPEVAWVGKTEKEAKAEGINYEVATFPWAASGRAIASDCADGMTKMIFDKDTHRVIGGAIVGTNGGELLGEIGLAIEMGCDAEDIALTIHAHPTLHESVGLAAEVFEGSITDLPNAKAVKRKK

SEQ ID NO: 14651 - protein, 600 aa, Rhodopseudomonas palustris CGA009
MLDTAPNGKVTTLLGQLDDALSAGDIDRAVDLFQTDCYWRDLIAFTWNIKTMEGKDQVRDMLKARLTDTKPSHWRIADGEDAAEADGIVECFIQFDTALARGVGHLRIKEGRIWTLLTTMAELKGFEEPQGFQRPMGVKHGADPSRKTWKEERDAEAAELGITRQPYCVIIGGGQGGIALGARLRQLGVPTIIIEKNERPGDSWRKRYKSLCLHDPVWYDHLPYLPFPPNWPVFAPKDKIGDWLEMYTKVMELNYWGSTVCKRAAYDEAAKQWTVVVERDGQEITLTPKQLVLATGMSAKPNMPKFEGMDVFKGDQHHSSQHPGPDAWKGKKAVVIGSNNSAHDICAALWEAGADVTMVQRSSTHIVKSNSLMELGLAGLYSEQAVQNGITTAKADLIFASLPYKILHEFQIPIYNAIRERDADFYKRLEAAGFMLDYGEDDSGLFMKYLRRGSGYYIDVGASELVADGRIKLKSGVDVQRLTEHSVILSDGTELPADLVVYATGYGSMNGWAADLISKEVADKVGKVWGLGSNTRKDPGPWEGEQRNMWKPTQQEGLWFHGGNLHQSRHYSQFLALQLKARMEGLPTPVYGLQQVHHQG

SEQ ID NO: 14652 - protein, 158 aa, Brassica napus
EAGSYGSFQVAADSEQKEEDASNFKEQESYVNDQSEQPKDESVVTEGEVVQGQQEQGYTQVEGGRSKRDYQQQQYVPRGSHQNQRGHRGARRGYSNAPRGGRGGGGGYSNGRYESYDNSGGNGYQRSHYNNRGRGRGGGGNGHSYNNNHQDSDVSVAS

SEQ ID NO: 14653 - protein, 447 aa, Methanosarcina acetivorans C2A
MVQMKKCTTKEDVLEAVKERDVKFIRTQFTDTLGIIKSWAIPAEQLEEAFENGVMFDGSSIQGFTRIEESDMKLVLDPSTFRILPWRPATGAVARILGDVYLPDGKPFQGDPRYVLKTAISEAEKMGFSMNVGPELEFFLFKLDANGNPTTELTDQGGYFDFAPLDRAQDVRRDIDYALEHMGFQIEASHHEVAPSQHEIDFRFSDVLNTADNVVTFKYVVKSIAYHKGYYATFMPKPLFGENGSGMHSNQSLFKNGKNAFYDPDTPMQLSQDAMYYIGGLMSHIKEFTAITNPVINSYKRLVPGYEAPIYITWSSKNRSSLIRIPATRGEGTRVELRCPDPSCNPYLAFALMLRAGLDGIKSKIDPGEATNVNIFHLTEKERAERSIHSLPGDLKEAIDEMKGSQFVKEVLGEHVFSHYLCAKEMEWDEYKAIVHPWELEKYLPML

SEQ ID NO: 14654 - protein, 408 aa, Vigna unguiculata
FGGGGGGGAGGGFGGGSGGGFGGGAGGGGGAGGGFGGGAGGGVGGGAGGGFGKGGGIGGGAGGGFGKGAGVGGGIGKGGGLGGGGGFGKGGGVGGGIGKGGGLGGGGGFGKGGGVGGGIGKGGGLGGGGGFGKGGGVGGGIGKGGGGGFGKGGGVGGGIGKGGGLGGGGGFGKGGGVGGGIGKGGGGGFGKGGGVGGGIGKGGGLGGGGGFGKGGGVGGGIGKGGGGGFGKGGGVGGGIGKGGGLGGGGGFGKGGGVGGGIGKGGGGGFGKGGGVGGGIGKGGGLGGGGGFGKGGGVGGGIGKGGGLGGGGGFGKGGGVGGGIGKGGGFGGGGGFGKGGGIGGGIGKGGGFGGGIGKGGGIGGGIGKGGGFGGGGGFGGGGGFGGGSGGGGGFGGGGGAGGGGGIGHP

SEQ ID NO: 14655 - protein, 490 aa, Gibberella zeae PH-1
MASPKLSDPSLIKNACYVNGQWVAAKSGKDFSVENPASLEKLGSCPEFDANDTEAAIAAADAAYKTYRKTPARQRARYLRRWYDLMMENADDIARLITLENGKVWSDAKTEAVYAANFFEWFSEEAPRIYGETIEASNPSCRLSTIKQPVGVCGLIAPWNFPAAMITRKAGPALAAGCTVVIKAPAEAPLTALALAELAHRAGIPAGVVNIITALDNTAEVGKVLTTHPKIKKVSFTGSTGVGRLLMNQSSSTVKKLSFELGGNAPFIVFEDADLEKAVKGIITSKFRNSGQTCVCANRIFVHRSIYDKFVQMVLDVVKTFVIGDGFGEKTTHGPLIHGRAVAKTAEHVEDAISKGAKLIHGGERLADLGPNFFGLTMLTDMTPDMKIFSEETFGPVAAFFAFDTEEEVIELANDSEVGLGGYFFSENVNRCYRVAEALEVGMIGVNCGVLSDPAAPFGGIKQSGFGREGSKYGIDEFTVTKMVMTNIDP

SEQ ID NO: 14656 - protein, 336 aa, Streptococcus pyogenes MGAS315
MVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHTNGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 14657 - protein, 459 aa, Fusobacterium nucleatum subsp. nucleatum ATCC 25586
MEKIYDLLVIGWGKAGKTLSAKLGAKGKKVAIIEENPKMYGGTCINVGCLPTKSLVHSAKILAEVKKYGIDGDYSFKNNFFKEAMKKKEEMTIKLRNKNFGLLDTNENVDIYNGRASFVSNNEVKITSSDNKEIVLKADKIVINTGSVSRTLNTEGIDNKNVMTSEGILELKKLPKKLLIIGAGYIGLEFASYFSNFGSEVSVFQFDDAFLAREDEDETKIIKEILENKGVKFFFNTSVKKFEDLGDSVKAICMKDGQEFSEEFNKVLVAVGRKPNTDNLGLENTSIQLGKFGEILVDDYLKTNAPNIWAVGDVKGGAQFTYVSLDDFRIVFPQILGENNRRKLSDRVLIPTSTFIDPPYSRVGINEKEAQRLGINYTKKFALTNTIPKAHVINEIDGFTKILINENDEIIGASICHYESHEMINLLALAINQKIKSKVLKDFIYTHPIFTESLNDILG

SEQ ID NO: 14658 - protein, 284 aa, Desulfitobacterium hafniense Y51
MELWYTEEHTENVRFSIKVDRQLYSGQSEFQRIDVFESKEFGTFFTLDGLMMVTQKDEFIYHDMIVHVPMATNPQIKDVLVIGAGDGGTVRELTRYDSIVNIDMVEIDKLVVDVCKEYLPQTACKLEDPRVRLFFEDGLRFIRTKENSYDLIIVDSTDPFGPGEGLFTKEFYGNCYKALKDDGILVNQHESPYYETYAQNMGRAHQRIKEFFPVCRVYQAHIPTYPSGHWLFGFASKKYDPLIDIDEQAWNDLGIKTQYYNTEIHKGCFALPNYVKEQLADAVE

SEQ ID NO: 14659 - protein, 431 aa, Escherichia coli
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGVRCTVVCMPVPIEEASAFGVMAVDENDKTIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVSKLDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 14660 - protein, 695 aa, Aspergillus nidulans FGSC A4
MAIPAHRSLALRPIVMGLGKLLALSFSHISLVSAAPTSQFLAPRHDAHAETHALPANDATLWLYLGVAAALVLTGGAFAGLTIALMGQTSGDSPSERKNAASVLRLLKRGKHWVLVTLLLSNVITNETLPIILDRSLGGVIFGEIVPQSICVRYGLPIGAWMAPCVLGLMYLMAPVAWPVAKLLDRLLGEDHGTIYKKAGLKTLVTLHKTLGEAGEQLNSDEVTIISAVLDLKEKSVGAIMTPMEDVFTMSADTVLDEPTMDLILSQGYSRIPIHSPENPRNFIGMLLVKMLITYDPEDCKPVSHFALATLPETRPETSCLDIVNFFQEGKSHMVLVSEFPGEDRGALGVVTLEDVIEELIGEEIIDESDVFVDVHKAIRRMNPAPYSRVPKGRFVEDPPALSSQGPLVDLGGDSPSTTDQAVTRRRSSVEAPLARFQLRRSQGDKERHSMDALVTRLGSTDEIREHLKHLGPSNLASRPRQTRYQNVKIKRSSISSPAPSGQTDIDSVEHARHPSSGLTTTSDATTLKPSGLNPRDGAHAVLINSTNQKSPEPLVKTGPTLSIPEPVNEEQDSAPRSANSRRTGSAGSDVDPAYSSSYFHRGPARSGSITEHIVDVNGVRKVVLHTTSSNSSSEGEGPSSVPKTKFPIRQGSEIIDLNDTDSGATEQTKKKRRHRRHKKSKDSTNRDEETPLLP

SEQ ID NO: 14661 - protein, 574 aa, Oryza sativa (indica cultivar-group)
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 14662 - protein, 503 aa, Triticum aestivum
MVAPAAIPQRQLFIDGDWRAPALGRRLPVINPTTEVTIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGEGGIDNYLSIKQVTEYTSDAPWGWYKAPAN

SEQ ID NO: 14663 - protein, 145 aa, Zea mays
MMRGVGGPLLTIGDLLSDLAVDDPLVGVGDASVPSSPSAAQQAGKANPSDLSRLFEEHYDDLMKALQEKDPSWPSLMLKLCATLKTADRLMSCADTNAEQLLEKVKALEGVLDRSGHAVAEIVEALQRLGLANDGHGSQSKSASK

SEQ ID NO: 14664 - protein, 282 aa, Triticum aestivum
  misc_feature (68)..(68): Xaa can be any naturally occurring amino acid
  misc_feature (232)..(232): Xaa can be any naturally occurring amino acid
  misc_feature (244)..(244): Xaa can be any naturally occurring amino acid
  misc_feature (247)..(247): Xaa can be any naturally occurring amino acid
AYLGDTTEQVCTKKQAGTGPEFPGYRRPTRPLLGNLLGKKKAEEDKEKQEELVTGMEKVSVEEPEVKXEEHEDGEKKETLFSKLHRSSSSSSSSSDEEEEEVIDDNGEVIKRKKKKGLKEKLKEKLPGHKDTEGEHVTGLPAPAAPASVQTHHDTDVVVEKIDGDVKTEAAPAVPEEEKKGFLEKIKEKLPGGHKKPEDAAPVPVTHAAPAPVHAPAPAAEEVSSPDAKEKXGLLGQIMGQLPXYHXTGGEDQAAAAAGEPNPPLDPRRARDSGPNLIELLA

SEQ ID NO: 14665 - protein, 755 aa, Oryza sativa (indica cultivar-group)
MGEGEFVDVERGVVAEGALDDDASPIEEVRLTVPVTDDPSLPVWTFRMWTLGLLSCVLMSFLNQFFSYRTEPLIVTQITVQVASLPLGHILARVLPRRKFKAPALLGGGECSLNPGPFNMKEHVLVSIFANAGCAFGSGSAYAVMIVDIIRAFYGRSISLFPAWLLITTTQVLGYGWAGLMRRYVVEPAQMWWPGTLVQVSLFRALHGKGEEKEENKEGSGGGMSQAKFFLIALACSFLWYAVPGYLFPTLTSVSWVCWIFSKSVTAQQLGSGMKGLGLGAFTLDWTAVSAFLYSPLISPFFATANILAGYVLLMYVVVPVSYWGLDLYNARRFPIFSSHLFTATGSTYDITAIVNDRFEIDMDGYHRMGRINMSTFFALSYGLGFATIAATVTHVALFHGKEIYRRFRASQRDKPDVHTRLMKSYRDVPSWWFYAMLALSMAVSLLLCTVLRSAVQLPWWGLLFACAMAFVFTLPISIITATTNQTPGLNIITEYVIGLMLPGKPIANVCFKAYGYMSMSQAVSFLSDFKLGHYMKIPPKSMFLVQLVGTVVASTVNLVVAYWLLGSIPNICQDALLPADSPWTCPNDRVFFDASVIWGLVGPRRIFGPLGNYGAFNWFFLAGAVGPVIVYLLHRAFPSKTWIPMINLPVLIGATSYMPPATAVNYNSWLIIGIIFNFFVFRYRKLWWKRYNYILSAALDAGVAFMAVLLYFSLSMENRSISWWGTAGEHCPLASCPTAKGINLGADSVCPVVL

SEQ ID NO: 14666 - protein, 331 aa, Vibrio parahaemolyticus RIMD 2210633
MTIKVGINGFGRIGRFVFRAAQERADIEVVGINDLIDVEYMAYMLKYDSTHGRFNGTVEVEGGNLIVNGKTVRVTAERNPADLKWDEIGVDVVAEATGLFLTDETARKHIEAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELKGVLGYTEDQVVSQDFIGEVQTSVFDAKAGIALTDNFVKVVSWYDNEIGYSNKVLDLIAHISK

SEQ ID NO: 14667 - protein, 294 aa, Vibrio parahaemolyticus RIMD 2210633
MDLKTLPPLTVLSDNVTVVEIDNVKIVRIIHDKATAGIALHGGHVVSYAPQGQEDLIWMSEKAIFDGKAALRGGIPVCWPWFGRIAAPAHGFARTSEWELVEHRENENGVIVELALFPTEETHQIWPHMFDARLLVEVGDELKVTLKVLNIDDEAWTFSGALHTYLNVGDIKQAQTTGMGNEYIDSLKNSEVCQGGEVLQLTDTIDRVYTQPEAQILVKDPVLNRTLSVANRGHNSAVLWNPWAEGAQGMGDMADNGYETMLCVESALHAPSIEEGKTLEPGESYELVTVIAAQ

SEQ ID NO: 14668 - protein, 442 aa, Mycobacterium smegmatis
MVDGQDVVADVHDVLDRMGDFTDRLRSGEWTGATGERITTVVNIGIGGSDLGPVMVYDALRHYADAGISARFVSNVDPADLVAKLDGLEPAKTLFIVASKTFSTLETLTNATAARRWLTDALGDAAVAKHSSRCPPTRSWSTKFGINTDNMFGFWDWVGGRYSVDSAIGLSVMAVIGKERFAEFLAGFHIVDEHFRTAPLHQNAPALLGLIGLWYSNFFGAQSRAVLPYSNDLSRFAAYLQQLTMESNGKSVRADGTPVSTDTGEIFWGEPGTNGQHAFYQLLHQGTRLVPADFIGFSQPTDDLPTADGTGSMHDLLMSNFFAQTQVLAFGKTADAIASEGTPADVVPHKVMPGNRPTTSILATKLTPSVVGQLIALYEHQVFTEGVIWGIDSFDQWGVELGKTQAKALLPVLTGDKSPAAQSDTSTDALVRRYRTERGRPA

SEQ ID NO: 14669 - protein, 385 aa, Nicotiana tabacum
KLKVAINGFGRIGRNFLRCWHGRKDSPLDVVVVNDSGGVKNASHLLKYDSMLGTFKADVKIVDNETISVDGKHIKVVSSRDPLKLPWAELGIDIVIEGTGVFVDGPGAGKHIQAGAKKVIITAPAKGADIPTYVVGVNEQDYSHEVADIISNASCTTNCLAPFVKVMDEELGIVKGTMTTTHSYTGDQRLLDASHRDLRRARAAALNIVPTSTGAAKAVSLVLPQLKGKLNGIALRVPTPNVSVVDLVVNVAKKGITAEDVNAAFRKAADGPLKGVLAVCDEPLVSVDFRCSDVSSTIDSSLTMVMGDDMVKVVAWYDNEWGYSQRVVDLAHLVANNWPGSCSTRKWRSHWMSFARQILLMRNAKSMNNRFCYVSSFEMDDFRSQ

SEQ ID NO: 14670 - protein, 146 aa, Arabidopsis thaliana
VTNKPKILDIDESDKDNHLAAVEYVEDMYSFYKEVEKESQPKMYMHIQTEMNEKMRAILVDWLLEVHVKFELNLETLYLTVNIIDRFLSVKAVPKRELQLVGIRALLIASKYEEIWPPQVNDLVYVTDNAYNSKQILVMEKTILGN

SEQ ID NO: 14671 - protein, 379 aa, Corynebacterium glutamicum ATCC 13032
MYLSGSRCTLKSMTSLEFTVTRTENPTSPDRLKEILAAPKFGKFFTDHMVTIDWNESEGWHNAQLVPYAPIPMDPATTVFHYGQAIFEGIKAYRHSDETIKTFRPDENAERMQRSAARMAMPQLPTEDFIKALELLVDADQDWVPEYGGEASLYLRPFMISTEIGLGVSPADAYKFLVIASPVGAYFTGGIKPVSVWLSEDYVRAAPGGTGDAKFAGNYAASLLAQSQAAEKGCDQVVWLDAIEHKYIEEMGGMNLGFIYRNGDQVKLVTPELSGSLLPGITRKSLLQVARDLGYEVEERKITTTEWEEDAKSGAMTEAFACGTAAVITPVGTVKSAHGTFEVNNNEVGEITMKLRETLTGIQQGNVEDQNGWLYPLVG

SEQ ID NO: 14672 - protein, 336 aa, Nicotiana tabacum
KLKVAINGFGRIGRNFLRCWHGRKDSPLDVIAINDTGGVKQASHLLKYDSTLGIFDADVKPVGTDGISVDGKVIQVVSDRNPVNLPWGDLGIDLVIEGTGVFVDREGAGKHIQAGAKKVLITAPGKGDIPTYVVGVNADLYNPDEPIISNASCTTNCLAPFVKVLDQKFGIIKGTMTTTHSYTGDQRLLDASHRDLRRARAAALNIVPTSTGAAKAVALSSQALRGSSMALPLRVPTPNVSVVDLVVQVSKKTFAEEVNAAFREAADKELKGILDVCDEPLVSVDFRCSDVSSTVDASLTMVMGDDMVKVIAWYDNEWGYSQRVVDLADIVANQWK

SEQ ID NO: 14673 - protein, 86 aa, Brassica napus
  misc_feature (10)..(10): Xaa can be any naturally occurring amino acid
  misc_feature (52)..(52): Xaa can be any naturally occurring amino acid
MPLSATMVGXALLGLGTQMYSNALRKLPYMRHPWEHVVGMGLGAVFANQLVXKWDVKLKEDLEVMLNKARAANERRYFELSSFIWQ

SEQ ID NO: 14674 - protein, 185 aa, Saccharomyces cerevisiae
MGHHHHHHGSLVPRGSEYDYLFKLLLIGNSGVGKSCLLLRFSDDTYTNDYISTIGVDFKIKTVELDGKTVKLQIWDTAGQERFRTITSSYYRGSHGIIIVYDVTDQESFNGVKMWLQEIDRYATSTVLKLLVGNKCDLKDKRVVEYDVAKEFADANKMPFLETSALDSTNVEDAFLTMARQIKES

SEQ ID NO: 14675 - protein, 289 aa, Listeria innocua Clip11262
MEKRISGSTRLLSLIGTPVDHSKSPIMYNYSFQKAGLDYAYLAFDIPVSKVADAIAAIKTFNLRGSNVTMPCKSEVLKYMDELSPAARMIGAVNTIINEDGKLTGHITDGLGFASNLRDSGVDVAGKKMTIIGAGGAATAIQVQCALDGAKEIAIFNIKDDFYEKAKQTIASIKQEVPDCIVHIYDLNDAAKLHEEIATSDILVNATLVGMHPHENETPVKDTTVFRKDLIVTDVVYNPKKTRLLLDAEAAGSKTIGGLGMLLWQGAEAYKLFTGKDMPVSEVKDLYFN

SEQ ID NO: 14676 - protein, 766 aa, Arabidopsis thaliana
MELVSGKVVPGCSNAGNPFHECTAICFERVNSPDVHKKEKKLFGFGKRTPSRDQTPPASPARGSRSPLASYFAKKKVESSAESSPSSYDHTNGNFLSRLSPLQGRKIEPSSNVDSLPVSPSLALYSGGDYFARRADQRGDEDDDVSPRPFGTQPKTPEHPLRTPQHRPRTPQHRSAHQEDAFSLETRPRTPERRSNTSDTRPRTPIHESAATGRRPQTPETRPRTPDHRYATYDNRPRTPIHESAATERRPQTPETRPRTPEHRSAIPDTRPRTPIHESAATGRRPQTPETRPRTAQRRGRSPEFMERSPGPRSKTPEPQPTYFEPSSRTPKQRSKTPEPSPRIPQTQPMSHRSLDNAALKMPRTVETRPRTPEHQPRTVETKPRIHESRPKTAVYGGRSPDHREKISQEMGQRSSHAYNYLGSKAESVYIEKNEESVLLFPELILSPQERPPSRLITLNHRGYETPNKQKEHCDEMDDSASTDDDKFSFVDDHDEHTVSIYAETTSKSGSSEQEEQHKANNEPPELPDESQSFSLAEISRMKGIITNNEIRDVMQSILSESYVSVGQYKVRASVSTTLQHILQKHGDIASGSKLQSLATRSYYLDMLASVVFELQTTPLKYLKESRVVEMVAIVKDIESVKIKAGWLKPVLEEIVEAVKHYDEHKMSVVEKEVWERDVLLAKQETEKQVKELGEKEKKIKEWRAKMTEMAAKLGDLDMKRARLHKSFTFLSSKVDQVSKGNPFFKASCNQPISLDILLFILLPAK

SEQ ID NO: 14677 - protein, 183 aa, Coprinopsis cinerea okayama7#130
MADVDLIKSRLTSHPDFPKKGIVFLDIFPILRDPLVFETLISHIVQHIASHTLALTPTKKIDAIVGLDARGFLLGPIIALRLGAAFVPVRKKGKLPGETTSVTYEKEYGADSFEIQTDAIKPGQTVVIIDDLIATGGSAKAAGELVEKLGGKTLEYIFIIELLFLKASSKLNAPVYSIVQSED

SEQ ID NO: 14678 - protein, 422 aa, Brassica napus
MSTFRSSLFSAATVYTASLSLVAMASATFSVAKPSLQGFSDFSGLRNSSALPFGKKSSSDEFVSFVSFQTSAMGSNGGYRKGVTEAKLKVAINGFGRIGRNFLRCWHGRTDSPLDVIAITDTGGVKQATHLLKYDSTLGIFDADVKPSGDSALSGDGKIIKIVSDRNPSNLPWGELGIDLVIEGTGVFVDREGAGKHIQAGAKKVLITAPGKGDIPTYVVGVNAELYSHEDTIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDAAANELKGILDVCDEPLVSVDFRCSDVSSTIDSSLTMVMGDDMVKVIAWYDNEWGYSQRVVDLADIVANNWK

SEQ ID NO: 14679 - protein, 469 aa, Escherichia coli
MSAEHVLTMLNEHEVKFVDLRFTDTKGKEQHVTIPAHQVNAEFFEEGKMFDGSSIGGWKGINESDMVLMPDASTAVIDPFFADSTLIIRSDILEPGTLQGYDRDPRSMSKRAEDYLRSTGIADTVLFGPEPEFFLFDDIRFGSSISGSHVAIDDIEGAWNSSTQYEGGNKGHRPAVKGGYFPVPPVDSAQDIRSEMSLVMEQMGLVVEAHHHEVATAGQNEVATRFNTMTKKADEIQIYKYVVHNVAHRFGKTATFMPKPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 14680 - protein, 369 aa, Escherichia coli
MKSRAAVAFAPGKPLEIVEIDVEPPRKGEVLVKITHTGVCHTDAFTLSGDDPEGVFPAVLGHEGAGVVVEVGEGVTSVKPGDHVIPLYTAECGECLFCKSGKTNLCVSVRATQGKGLMPDGTTRFSYKGQPLFHYMGCSTFSEYTVVAEVSLAKINPQANHEHVCLLGCGVTTGIGAVHNTAKVQPGDTVAIFGLGGIGLAAVQGARQAKAGRIFAIDTNPEKFDLARSFGATDCINPKDYDKPIQDVLIELTGWGVDHTFECIGNVNVMRSALEAAHRGWGQSVVIGVAGAGKEISTRPFQLVTGRVWKGSAFGGVKGRTQLPGMVEDAMKGEIDLAPFVTHTMGLEEINDAFDLMHEGKSIRTVIHY

SEQ ID NO: 14681 - protein, 377 aa, Cryptococcus neoformans var. neoformans JEC21
MATEFDDVLTNQPVVIDNGSGNIKAGFAGEEQPSCYIPSFVGRPKHPRVMAGAIQDNLFIGRRAQEFRGLLKIKYPMEHGVVMDWDDMERIWGWVYGEGLKALSEEHPVLLTEAPLNPRQNRDIAAQIFFETFNVPAFFTSVQAVLSLYSSGRTTGIVLDSGDGVTHAVPVFEGFSMPHAVRRIDLAGRDITDHLQLLLRKAGHNLHTSAEKEVVRTIKEKTCYLALNPAKVEKDQGGAWEEFKLPDGKVIQLGTERFLAPEILFNPELVGQEYPGVHQVIVDSINRTDLDLRKSLFSNIVLSGGSTLCTGFGDRLLNEVKKLAVKDVKLKIYAPPERKYSTWIGGSILAGLSTFKKMWVSADEYKEDPDIIHKKAF

SEQ ID NO: 14682 - protein, 347 aa, Salmonella enterica subsp. enterica serovar Typhi Ty2
MKLALVNRQVILPESGTESFQCHASTLVRLPCGTLVAAWFAGLCEGSEDTAIWLSRYEHNIWTTPQRVAAREGEAHWNPVLFYPSDKLWLFYKVGSGVHVWKTWFITSSDRGFTWSTPAPLVNDDILPRGPVKNKLLLASNGAWIAPGSIESPERWRAFVDRSSDEGKHWNISFVPLEPDNAISGTNVALWDGVKKGMLWECCLENLLRWDGVIQPTLWESSPGHIHMLLRSTRGAIFRSDSIDYGATWSVARATFLPNNNSGIDLVSMQDGTLILALNPVNGNWGKRYPLSLIASQDNGESWLPLLDLESDHGEYSYPAIISKGGVVHITYTWNRKNIVYCRLQTV

SEQ ID NO: 14683 - protein, 229 aa, Vibrio angustum S14
MADIKQLFANNLSWSENIKNEDPDYFTELAKGQHPQYLWIGCSDSRVPAERLTGLVSGELFVHRNVANQVIHTDLNCLSVVQYAVDVLKVKHIIICGHYGCGGVTAAIENPQLGLINNWLLHIRDLYLKHRTDLGSLPRQEWDDKLSEINVASQVYNLGNSTILQQAWERGQEVKIHGWIYGTSNGVLKDLGVTSTSRETLEVGYQSAMTSLLPPLEQSINDHITEKTN

SEQ ID NO: 14684 - protein, 203 aa, Salmonella enterica subsp. enterica serovar Paratyphi A str.
MLTEQQRRELDWEKTDGLMPAIVQHAVSGEVLMLGYMNPQALDKTIESGHVTFFSRTKQRLWTKGETSGHVLNVVSIAPDCDNDTLLVLANPVGPTCHKGTSSCFGDASHQWLFLYQLEQLLAERKTADPASSYTAKLYASGTKRIAQKVGEEGVETALAATVNDRFELTNEASDLMYHLLVLLQDQDLNLTTVIDNLRKRHQ

SEQ ID NO: 14685 - protein, 382 aa, Picea glauca
MSALVLSLAFSTPARGGGESRFAEGKALRRRLNASSCNASSKNAQLMCERRILSWCYGIRRRNSAGLWGKATRVQVSAVAEEEGGRILLSDVVVKKKRKPFLLELREWSLGDIGAAGTVFGMHALCLLAPFTFTWKAFGVFAVLYVVTGLLGITLSYHRNLSHRSFRLPKWLEYLFAYCGVQAVQGDPLDWVSTHRYHHEYCDSVKDPHSPNEGFWYSHMSWMFDEKTMFDRVGTRNNVSDLEMQPFYRFIRDTYIIHPIAMGLLLYALGGPPFVIWGMAVRIVWVYHITWLVNSAAHVWGYQAWNTGDLSRNNWWVAALAFGEGWHNNHHAFQYSARHGLEWWQFDPTWYVIKILEALGLAKDVRAPLEQHKTRMSSKPGL

SEQ ID NO: 14686 - protein, 738 aa, Arabidopsis thaliana
MSSPVKKMKKKTTTSPILSPTPHSTQILSLPVDLLISILARVSRLDYPILSLVSKSFRSLIASPELYETRSLLGRTESCLYLCLGIPSDFNPRWFTLCRKPKPSGHVMAAISIPNSRPVHCSGLVAVGSDIYNIGGSIINEHSSSVSILDCRYHTWRDAPNMLVERNSHAANVIDGKIYVAGGSRDSNSSNWMEVFDIKTQTWEPVLNPIADGCDRRIRKSAVIEEAICLFGNIDGIKLYDSKIGCWMKLKGLEGLPEFASYSYVRLADYGGKMAVLWDKLPTTGNNNMVIWCAVITLEKRHNENIWGRVEWFDAVLTVPEPYEFVGVFTFVARTNTEVDRRLYSPMSSPEKKRKTTKKPSPTPQSTTPNPSLPDDLVVSCLARVSRLYYPTLSLVSKSFRSLIASPDLYKTRSLLGRTESCLYVCLQEKDSDPNPRWFTLCLKPNRTLTNDITEKKKKKKKKKKMSSGYVLAAIPVLHSRPAYWSGLVAVGSNIYNIGGPIDKAHSSIVSVLDCQSHTWHEGPGMRVERRYPAANVVEGKIYVTGGCKDCSNSSNWMEVFDPRTQTWESVSSPGAEIGGCSIHKSAVVEGEILIANSHGLIYKPKEGRWERMKWDMDIGWVWYSYCVVENVLYYYYKGVFKWYDTMARLWRDLKGVKGLPRFARCGGKMADYGGKMAVFWDKIVTSDDGCKNKMILCAVIALERRNSEEIWGKVEWHDAVLTVPLSYEVVYALSPTV

SEQ ID NO: 14687 - protein, 421 aa, Gibberella zeae PH-1
MALKDHGRQYDIVIFGATGYTGKLTAEYIATHLPTDLKWAVAGRNESKLDALVEDCKKRNSDRLQPAIEIANLNDADLSALAKKTCVLLTTVGPYSLYGEHAYKACAEEGTHYVDVTGEAAWVHKMIKKYEATAKKTGAILIPQAGIESAPADLITWALAKTLRIELGSQTKDVTVSLHDVKSAPSGGTLATALNIWDVFTLKEMKDASSPYAQSPIPHKEPTRPKSTMLEMILGVRSVSNLGLLTTSIAGTTDVAVVERTWGLLSETPSRKEEFYGPNFVWQERMKARNWLHGIFIHWLLIIGGVLLVSVAPLREFLKKRVVQPGQGASSEDTAKDYVEYRGIAYPDSEKQATKAAFGRMWHHGGMYLLTAVLLSEIAATILEDNVELDGGSYTPACLGQGLIDRLDKSGLKLDVKTIDV

SEQ ID NO: 14688 - protein, 317 aa, Prochlorococcus marinus str. MIT 9303
MNQTILDVDLLAFEQGTKRQQAAVVDGLMRSLGTGFVVTTSDLPSAVLDEAYGMLSHFFALETTTKRQFNMPEAFGQTGYTDTLVETAAGEKLPDWKEMLNWSLHLPDNHPLRRRFPTLYPEQLLPEVAVPGITGVLQTFHQAIAELQCRVLRIIATGLGCHHDFFTDLIQDAPTLTRAIRYPPMSEAPAKGHMWAAAHGDINLITAMPRATAPGLQVYIDGSWVDAIAPEGQVIVNSGLMLERISNGLIPTGWHRVLAPSEWDCERLSVVQFCHPKPSTLLTPLSSCIDAKHPQRFAGVMAADALEEVLYQIKLMA

SEQ ID NO: 14689 - protein, 346 aa, Prochlorococcus marinus str. MIT 9303
MTGTNPVHSNEPEVICLGEALVDRLGPLGGDPVVDQPVEDCLGGAPANVACGLARLGSKVAFLGRLGDDSIGARFRELFDTRGVNLAGLQTDLRRPSRIVLVRRDLDGERVFQGFAGDRGDGFADQALSLDELAASWPLLVGKASWLLIGSIPLATPASAQALLWCVEQAQTAGIEIALDVNWRSTFWDPGRSPDSGPDEKALQAIAPLLERASLLKLAREEAVWFFDTDDPAVIARSLPQQPDVVVTDGARPVRWWIGGCVGELAALSPPSVVDTTGAGDAFTAGLLHQLLMDVSSQRDSIKVREMVRFAAACGALVCGGAGGIDPQPSQMQVEEFLGSVAGDVN

SEQ ID NO: 14690 - protein, 113 aa, Brassica napus
KFVGGCRFPKDGFPAKALKFVGSLVPHVHRPLFYGGIFLSPVAKKSPNGKLRVLFEVFPRAFLMDQAGGQALTGKKRALDLVPKKIHERSPIFFGGFDHVKEIKALFAAGENN

SEQ ID NO: 14691 - protein, 126 aa, Vibrio parahaemolyticus RIMD 2210633
MKELISSEHAPAAIGPYSHGTSYGDLIFTSGQLPVDKATGKVVEGGISAQSHQSLTNLKHVLEAGGGSVDTVLKTTCYLSNINDFAEFNKVYAEFFQQDCPARSCFAVKDLPLGVLIEVEAIAHKK

SEQ ID NO: 14692 - protein, 449 aa, Colwellia psychrerythraea 34H
MEILYQVEDKPPIGTSILLAAQHLLAALGAIITVPLVVGGVLNLPVEDIVVLVNAAMLVSGVVTIIQCKGVGPVGIRLPCVMGTSFTFVGVSIAIGFEHGVAGILGSALVASLVMIIGSFFMPMIRRFFPPIVTGTVVTLIGLSLIPVAVDWFAGGQVGQEGYASLPNLAIGLFVLTTVILLSIFGKGILSAAAVVIGMALGFMACVVLGLVDFKPVQDSPLFALPSPFHFGLTFPISGIIGMSIAYLVTIVESTGDFLALSNVTKTKLTGKKLSSGILCDGLGSALASLFSTTPFSSFSQNVGIVGMTGVASRYVVAITGAMLILAGLFPIIGALVVAIPLPVLGGAGLVMFAMIITAGVNILSHTKHTKRNGIIIAVSIGAGMAVTVRPELLSHLPDFLKIILASGITTGSVIALLLNAVLPDGDIIVETEEENPSNNEVESSPNLI

SEQ ID NO: 14693 - protein, 275 aa, Zea mays
MSLFLKDDSIQIREVWSDNLQEEMDLIREVVDDFPYVAMDTEFPGIVVRPVGTFKSNADYHYETLKLNVNILNIIQLGLTFSNEQGNLPTCGTDSKYCIWQFNFREFDLDSDIFAVDSIDLLKQSGIDFAKNTRQGIESSRFAELLMSSGIVLNGNVHWVTFHSGYDFGYLLKLLTCKNLPDSQTSFFELINVYFPTVYDIKHLMKFCNSLHGGLNKLAELLEVERVGICHQAGSDSLLTSCTFRKLKENFFVGPLQKYAGVLYGLGVENGQVAL

SEQ ID NO: 14694 - protein, 544 aa, Aspergillus nidulans FGSC A4
MAPIPWGMLYVSVVGYSVLTSNLFTFFVLATALTALKIVYASFLYPEYLTPIKHIPTPPLTAQKRSWVRGNTDTYVVISPFEGMLNWTKSVPNNGLLRYYIIGNIEQVLVTTPKALSELLVQNAYDYQKPESIRISLARIAGEHGILLVEGQEHKRHRKNLMPAFSYRHIKDLYPTFWAKSVEMVKCIEKDLQDRRDTGDITVTVRPWASRATLDIIGLAGMDRDFGSLADPQNELAAQYHRILEDPPLWLKLLFAAAFVLGNEELVMALPVKRNRDIAEGAKYVRQVAQQLISEKRERIKHNPEKAEGGGGGKDILSVALNSGNFTDIELIDQMMTFLAAGHETTSSALQWSVYALCKHPDIQTRLRQEIRSNLPSVSSNDPKPITAEAVDSLPYLHAFCNEVLRFHPSVPITFRTTTRDTTLAGTLLPKGTQLTISPEVINHDPDLWGPDAHIFNPDRWLGPGRANTGGASSNYALMTFLHGPRSCIGQGFAKAELACLVAAMVGRFEMELADPGKKLAVRRTATISPVDGVVARLTPLDGW

SEQ ID NO: 14695 - protein, 164 aa, Coprinopsis cinerea okayama7#130
MSLPPIDPKKSVAGIAVDPQTLERVVPESRRPDGSVRKQLKIRPGFTPQEDVQRFRGTRQAQADANKLPKGHIIGWAPPTASETSTSKPMSKGAKKNAKRKEKKEKERAEAAAAATPVRDNWEDDSDGEQPGAPTTAEEKKDPPPATTSESTDSVTNKLEKLTI

SEQ ID NO: 14696 - protein, 491 aa, Zea mays
  misc_feature (398)..(398): Xaa can be any naturally occurring amino acid
  misc_feature (467)..(467): Xaa can be any naturally occurring amino acid
FRKPTRPKIHSPTCNSIRGNPSLQPCGLSTLSSPLVNARALSEADNNPPADNTAPDDNGNGGGFSKIEIASITSASAIVAVLLALVILYIYTRKCASRPSRRSLRREVTVFVDIGAPLTYEAVLRASGSFNASNCIGSGGFGATYKAEVAPGKLVAIKRLAIGRFQGIQQFQAEVKTLGRCRHSNLVTLIGYHLSDSEMFLIYNFLPGGNLERFIQERTKRPIDWRMLHKIALDVARALAYLHDNCVPRILHRDVKPSNILLDNDYTAYLSDFGLARLLGNSETHATTGVAGTFGYVAPEYAMTCRVSDKADVYSYGVVLLELISDKKALDPSFSPYGNGFNIVAWACMLLQKGRAREFFIEGLWDVAPHDDLVEILHLGIKCTVDSLSSRPTMKQVXGDLRNSDHRLTRNSKQRLACFCIMRPRLLAVWVTATASNVPNKLVATGKQFKCHFSRDPQAGHSWYLIXLVVMVTVWNADIASMPLQASIKDA

SEQ ID NO: 14697 - protein, 308 aa, Lactobacillus acidophilus NCFM
MSSKISILGSINLDSTYHVDKIPLPGETIHVNKKTFAAGGKGANQAVAAKRSGATVSFIGAVGNDAAGKYMLNELEKEKINLSNVQIKDTAQTGTATVLLDENGQNSILVYAGANGLIDSSQINKAEDTIANSDYIIAQFETPISAIISAFTIAKKHGVTTILNPAPATTIDNKLLKVTNIIVPNETESAAITGINVTDEESMQRTARYFREKGVKVTIITLGSRGVYYSSPTENRFISAYKVNAVDTTGAGDTFIGAMTSVLTTDLLNISAAIDYGQQASSITVQGIGAQPSIPTKEKIKQVYRMSD

SEQ ID NO: 14698 - protein, 146 aa, Brassica napus
MGVVEDTEPPLKRAKRDEETNGFSGSNSSVRVSSSVNNSLGDLMARPLTSSQGDDETIGSKGVIKKSEFVRIITRTLYSLGYGKAGAMLEEESGIPLHHSFVETFMEQVRDGKWDESVVTLHRIGLWDEKDVKAASFLLLEQKFLE

SEQ ID NO: 14699 - protein, 182 aa, Xanthomonas oryzae pv. oryzae KACC10331
MPELIFSAQPGELFVYRNIGNVVPPYSQHVSGVVAAIEYAAAVLGVRHIVICGHTDCGAMKAVLKPEPLQDVPSVAAWLKHTDAARHVTAHHGHDPHSQDALSCMTEENVVSQLDHLRTQPVVAARLAAGTLRIHGWIYDIAHGEIRAFDAEKGGFRPLLAESTPEATPRPRFQQVVRAELA

SEQ ID NO: 14700 - protein, 1212 aa, Oryza sativa (indica cultivar-group)
MQFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQVYVLGLFWNGNSIIGILKFAPLSQQTCPVICFACLMCLRFFNSHLLATYETEELMGEVNSCKEMKSVCNWFALARQLIILLSVLVSCPGCQDFLSSLKMSHSSDEDSEISDSEIDEYADKFYARLVAGEFKVKDGQSYSCPFCSGKKKKDFNINNLIQHASGVGAASNRQAKDKATHRALAKHLKNGLTKSSGQQSQTAVVEPQPLPNRDEKFVWPWMGVLVNVPTEWKDGRQIGRSGNHLKEQLSRFCPLKIIPLWNFRGHSGNAIVEFGKDWHGFRNALAFEDYFGKEGYGKRDWKEKQNQGSNLFGWVARAEDHTSPGLIGDHLRKNGDLKTINDLENEGARKTDKLVANLANQIEVKNRHLQELEVTYNERTTSLEKMMGQREQLLQKYNEEIRKMQQLAQRHSQKIIDENQKLRSELESKMSELNTRSKELDEIAAKSDYDRRIIDQEKQKNAIKSSHLKLATLEQERADENVLKLVREHKREKEAAVKKILKLEQQVDAKQKLELDIQQLKGKLEVMKHMPGDEDSALKNKIDELSEELQEKMDELDAMESLNQTLVIKERKSNTEMQDARKELENGLLDLLDGQSHIGIKRMGELDLEAFSKACRKMSSEEDAEITAAILCSKWQAEIKNPDWHPFRFVLVDGQEKEIIEDDAKLQELKEEHGEDIYRLVRDALCEINEYNPSGRFPVGELWNFKDKRKATLKETVQFVLRQWRANRRKR

SEQ ID NO: 14701 - protein, 186 aa, Zea mays
MTLSLRIAPSPVSFRYSPAPSTPSGVGLRPAKQRCRIPNSGVAAKTGSCSSGGVLDLRKRIAGSCVARCSLETVNVSVGEVTEVDKDTFWPIVKAAGDKLVVLDMYTQWCGPCKVMAPKYKELSEKYQDMVFLKLDCNEENKPVAQELGIRVVPTFKILKDNKVIKEVAGAKFDELLSAIEAARSG

SEQ ID NO: 14702 - protein, 306 aa, Vibrio angustum S14
MKPTAALLNEVLDEVRPLIGQGKVADYIPALANVPASKLGIAVCYNDGEVIQAGDSQEGFSIQSISKVLSLTLAMTLYEPEELWSRVGKEPSGHAFNSMIQLELEKGIPRNPFINPGAIVVSDLLHSRLCAPQYRMLELVRELSCNPHIVYDKVVASSEMQHSDRNASIAYLMRSFGNFDNEVMPVLTNYFSYCALKMSCVDLARTFSYLANKGLPLGAKKRIISQTQSKHINALLATCGLYDGAGEFAYRVGMPGKSGVGGGIVAIVPGEMTIAVWSPELDQSGNSVAGTAALEKLSERIGRSIF

SEQ ID NO: 14703 - protein, 490 aa, Corynebacterium glutamicum ATCC 13032
MTINVSELLAKVPTGLLIGDSWVEASDGGTFDVENPATGETIATLASATSEDALAALDAACAVQAEWARMPARERSNILRRGFELVAERAEEFATLMTLEMGKPLAEARGEVTYGNEFLRWFSEEAVRLYGRYGTTPEGNLRMLTALKPVGPCLLITPWNFPLAMATRKVAPAIAAGCVMVLKPARLTPLTSQYFAQTMLDAGLPAGVLNVVSGASASAISNPIMEDDRLRKVSFTGSTPVGQQLLKKAADKVLRTSMELGGNAPFIVFEDADLDLAIEGAMGAKMRNIGEACTAANRFLVHESVADEFGRRFAARLEEQVLGNGLDEGVTVGPLVEEKARDSVASLVDAAVAEGATVLTGGKAGTGAGYFYEPTVLTGVSTDAAILNEEIFGPVAPIVTFQTEEEALRLANSTEYGLASYVFTQDTSRIFRVSDGLEFGLVGVNSGVISNAAAPFGGVKQSGMGREGGLEGIEEYTSVQYIGIRDPYAG

SEQ ID NO: 14704 - protein, 474 aa, Arabidopsis thaliana
MDLVSSLPDDVRCHILSFLTTKESALTSVLSKKWRNLFTLVPNLDLDDSEYLHPEETKWEREEILDSFLDFVERVLSLQGNGPIRRFSLRCESGVPPARLNRWLCKVLQRGVADLELIIDFEDGYLLPRELFVSETLVNLRLKSEFGCIHWWPGAEGTFLPRLQSLDISSAMVFCDDKLQKLLPCFPVIEELRLVGMEWIDSHVTVSCATLTNQLLLSSTGSRTSKNPKSVSFDTPNLLSLAYSDLVAEDYPLVNMKSLFKARIILGVDDDQIARMRAPTNYLSEDDVVRRFGNVVKLMKGIQNVQQLHLHSDTLEVLSMCCESMPVFNNVKTLGIKSDYDRGWQAVPALLRNCPHLETLTFEGLVHHVTDKCGDACDCIFRKDKGRSLKSCPVKVVEIKEFRVTMKEMHLIEHFLDNFPCLKEMKIYREEYDPSPFGNDPQVDDLILDMIEEYKDIYSCNVQLLEPCDKWDEQ

SEQ ID NO: 14705 - protein, 181 aa, Vibrio parahaemolyticus RIMD 2210633
MTTETISLIKSSIKSIQDYPKPGILFRDVTSLLEDAKAYQATIGLLVERYKDMGFTKVVGTEARGFLFGAPLALELGVGFVPVRKPGKLPRPTIAQSYELEYGIDTLEIHTDAIVEGDKVLVVDDLLATGGTIEATTKLIRQLGGEVEHAAFVINLPEIGGDKRLEALGLNVFSICDFEGH

SEQ ID NO: 14706 - protein, 376 aa, Triticum aestivum
MDTSGGGTAAGGAAQIQGMATHGGRYVLYNVYGNLFEVASKYAPPIRPIGRGAYGIVCAAVSSDTGEEVAIKKIGNAFDNHIDAKRTLREIKLLRHMDHENILAIKDLIRPPRRDDFKDVYIVTELMDTDLHQIIRSNQSLTDDHCQYFLYQLLRGLKYVHSANVLHRDLKPSNLFLNANCDLKIADFGLARTTSETDLMTEYVVTRWYRAPELLLNCSQYTAAIDVWSVGCILGEIITRQPLFPGRDYIQQLKLITELIGSPDDSSLGFLRSDNARRYMKQLPQYPRQDFRLRFRNMSDGAVDLLERMLVFDPSRRITVDEALHHPYLASLHDINEEPTCPAPFSFDFEQPSFTEEHMKELIWRETLAFNPDPPY

SEQ ID NO: 14707 - protein, 476 aa, Campylobacter jejuni RM1221
MGKFVNNIDDFFKFCKQNEVLFVDFRFTDMIGTWHHITYNLHAINEETFQTGIPFDGSSIHGWQPIEKSDMILKPDAQSAFLDPFTADPTIIVFCDVYDIYKGQMYEKCPRSIAKKAMEHLKNSGIADTAYFGPENEFFVFDSVKIVDTAHCSKYEVDTEEGEWNDDREFTDSYNTGHRPRNKGGYFPVQPIDSLVDIRSEMVQTLEKVGLKTFVHHHEVAQGQAEIGVNFGTLVEAADNVQIYKYVVKMVAHLNGKTATFMPKPLYGDNGNGMHVHMSLWKNGVNLFYDKDGYSGLSQTAINYIGGILKNARSVAAFTNPSSNSYKRIVPGFEAPCILTYSCQNRSASCRVPYGIGKNSARIEIRFPDSTANPYLAFVSLLMAGLDGIKNKTIPVGPMDENLFDLTLDEIREKGIEQLPHTLRGSLEALIRHNSYLKPVMSDIFIDDYQHLKFETQVWPVEARPTAYEFKTCYSC

SEQ ID NO: 14708 - protein, 149 aa, Streptococcus pneumoniae
QPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDRLVVLYDSNDINLDGETKDSFT

SEQ ID NO: 14709 - protein, 359 aa, Gibberella zeae PH-1
MKVTFKDLKQQKFTLDVEPSELFQGKILKDDETVGSYNIEEKGFVVCMVNKPKPTKPAESSAAPPATPAAPPTRTPAAPAAPAQSASQQAAVPATPTPQRSADAGSEEPSGLAMGSQRTEAIANMEAMGFERSQIEAAMRAAFNNPDRAVEYLLNGIPDNIRQEQQQREAAPAAHAAQPSQPAAAAPQGGEEGGVNLFDLAAQHGGTNARGGSGGNEAAAAAAAAAAGQGGDLGNLDFLRHNAQFQQLRQIVQQQPQMLEPILQQLGAGNPQLAELIASNPDQFLQLLGEYADDDVPLPPGAQAISVTEEERDAIERLCRLGFDRDAAIQAYFACDKNEELAANFLFDQPEDDEPAPNN

SEQ ID NO: 14710 - protein, 661 aa, Thermococcus kodakarensis KOD1
MNEKEVLLSKFIAHLKELVEMERRAEIEAMRLEMRRLSGREREKVGRAVLGLNGKVIGEELGYFLVRYGRDREIKTEISVGDLVVISKRDPLKSDLVGTVVEKGKRFLTVAIETVPEWALKGVRIDLYANDITFKRWMENLDNLRESGRKALELYLGLREPEESEPVEFQPFDKSLNASQRGAIAKALGSGDFFLVHGPFGTGKTRTLVELIRQEVARGHKVLATAESNVAVDNIVERLADSGLKVVRIGHPSRVSKALHETTLAYLITQHDLYAELRELRVIGENLKEKRDTFTKPAPKYRRGLSDREILRLAEKGIGTRGVPARLIREMAEWIRINQQVQKTFDDARKLEERIAREIIQEADVVLTTNASAGLEVVDYGEYDVAVIDEATQATIPSVLIPINRAKRFVLAGDHKQLPPTILSEKAKELSKTLFEGLIERYPEKSEMLTVQYRMNERLMEFPSREFYDGKIKAHESVKNITLADLGVSEPEFGNFWDEALKPENVLVFIDTSKREDRFERQRRGSDSRENPLEAKLVTETVEKLLEMGVKPDWIGVITPYDDQRDLISSMVGEDIEVKTVDGYQGREKEIIVLSFVRSNRRGELGFLTDLRRLNVSLTRAKRKLIAVGDSSTLSNHPTYRRFIEFVRERGTFIEIDGKKH

SEQ ID NO: 14711 - protein, 387 aa, Fusobacterium nucleatum subsp. nucleatum ATCC 25586
MIRSYMAIIYLGDSKKNISPLTKVRALASIPVGGSYRIIDFSLSNVVNAGIRNVGLFCGNEELNSLTDHIGMGAEWDLARKKDGIFIFKRMLDDNFSLNQARISKNMEYFFRSTQQNIVVLNAHMVYNLDVSDLIEKHEASGKEITMVYKKVKKANEHFNHCSSVKIDENNRVIGIGQNLFFKEEENISLDAFVLSKELMLKLLVDSIQEGKYNVLSELIARNLPSLNINAYEFKGYLQCINSTREYFNFNMNLLNQKIRDDVFGIKSGRKIFTKVKDTPPTLFKETADVENSLVSNGCIIEGTVKNSILSRGAIIEKDVVLEECVILQDCHIKKGAHLKNVIVDKNNIIHENEKLSASKEYPLVIEKSMKWDTKQYQDLMDYIRNK

SEQ ID NO: 14712 - protein, 226 aa, Thermococcus kodakarensis KOD1
MKVKKHRFPGVYIVIDDDGSEKIATKNLVPGQRVYGERVVKFEGEEYRIWNPTRSKLGAAILNGLKNFPIKPGSTVLYLGVASGTTASHVSDIVGWEGKVFGVEFSPRVLRELVPLVEERRNIVPILGDATKPEGYRALVPKVDVIFEDVAQPTQAKILIDNAKVYLKSGGYGMISVKSRSIDVTKEPEQVFKEVEKELSTYFEVVERLSLEPYEKDHALFVVRKP

SEQ ID NO: 14713 - protein, 245 aa, Zea mays
  misc_feature (102)..(102): Xaa can be any naturally occurring amino acid
MTGFGSPCGACKFLRRKCVRGCVFAPYFCHEQGAAHFAAIHKVFGASNVSKLLAHLPLADRAEAAVTISYEAQARLRDPIYGCVAHIFALQQQVMTLQAQLXASLKAQAAQGQQGVHEDAKGYVGSAAAEQLGYGYPWCSGNGGAAAAAAGAVGAPAAQPGAYGNGAHESLTALLGSSDYMQQSLYHAFEQAGADDDDGRQGYAFEAAAESSSLGAEESGWRSSSGYQDCEDLQSVAYAYLNHRS

SEQ ID NO: 14714 - protein, 124 aa, Glycine max
QYAISPRKLQYNTKLSDFFEILATSEDRDGKTFVSTARGRKYPVTVNLWQPEKNAFEWATSLKAPHTEDAIRVTQSTANFFISEARKSTNTPDAQKVRDNLIYNYKPTFGGTAGKGYDQVYLFE

SEQ ID NO: 14715 - protein, 445 aa, Lactobacillus acidophilus NCFM
MSKQYTAEEIKTEVEDKNVRFLRLCFTDINGTEKAVEVPTSQLDKVLTNDIRFDGSSIDGFVRLEESDMVLYPDFSTWSVLPWGDEHGGKIGRLICSVHTTDGKAFAGDPRNNLKRVIGEMENAGFDAFDIGFEMEFHLFKLDDNGNWTTEVPDHASYFDMTSDDEGARCRREIVETLEDMGFEVEAAHHEVGDGQQEIDFRFDNALATADRCQTFKMVARTIARKHGLFATFMAKPLEGQAGNGMHNNMSLFKGKKNVFYDKDGEFHLSDTALYFLNGILEHARAITAIGNPTVNSYKRLIPGYEAPCYIAWAAKNRSPLVRIPSAGEINTRLEMRSADPTANPYLLLAACLTAGLNGIKEQKMPMKPVEENIFEMTEEERAKKGIKPLPTTLHNAVKAFKEDDLIKSALGDHLTRSFIESKELEWSKYSQSVSDWERQRYMNW

SEQ ID NO: 14716 - protein, 310 aa, Oryza sativa (indica cultivar-group)
MKLKRKQCIKRRHDAERNLRKPSSCLVRKPPGIPCVARNKKVKYSSLCVGLVMDLHGIRGKVALNPVLKLPQGELVVFTDQFEPGIGRRTSAGLQHFLQELLRLKMQGITKALRFHGKQLKLTVLQHMNKGIFSWATLISRIQTESPTVIIPHIGLENIRVREILNAKGEAKAGAVYWCCTSHFVHEAIKHMTAHNVGALVVLKSGDEKQLAGIVTERDFARKILLPGRPSEETRVGDIMTEEDKLITVSSNTNILQAMELMTERHIRHVPVFDEKVVGMITIGDVVKTIVDQQHQEVKQLKKYIRGDYY

SEQ ID NO: 14717 - protein, 209 aa, Zea mays
MAVTVEKGAMGEPALLLERSRAITLHGRDRKGRAVVRIVGNYFPARALGGRAEEALRSYLRERVLPEIGDREFVVVYMHSRVDRGHNFPGVGAIRGAYETLPAAAKERLRAVYFVHPALQSRIFFATFGRFLFSSGLYEKLRYMSRLEYVWAHIDKEQLEVPDCVREHDDELERRPLMDYGIEATETRCMYDAASMDTSASLHSLRCVS

SEQ ID NO: 14718 - protein, 149 aa, Streptococcus pneumoniae
QPNWINRDRFILSAGHGSMLLYALLHLSGFEDVSMDEINSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFT

SEQ ID NO: 14719 - protein, 498 aa, Bordetella bronchiseptica RB50
MTLHDSAYWRAQAAALAPEGRAYIDGAYCDAADGATFAAHSPIDGRKLADVAACGAADVDRAVAAARRAFEAGVWSGLAPRERKHRLLRLAALITKHQEELALLETLDMGKPIRDALAFDLPETARCYAWYGEAIDKRYDEIAPTGADALATITREPLGVVAAVVPWNYPLMMAAWKVAPALAVGNSVILKPAEQASLSALRLAALAEQAGIPPGVFSVVPGLGAQAGQALGLHPDVDCIAFTGSTATGKRFMTYSGQSNLKRVWLECGGKSPHIVFADCPDLDRAAQVAALAIFSNQGEVCIAGSRLYVQHGIYDAFMEKVAAFAATLRPGNPLDPDSALGAMVDERQTQAVMARIAAGAQEGARLRLGGRQVLTNSGGYYIEPTIFDCPGQDNSLVREEIFGPVLAAQGFADEDEAVALANDSIYGLGAGLWTADLGRAHRLSRRLRAGLVWVNCYADGDITVPFGGVKQSGFGRDKSLHAMDKYSDLKTTWISLR

SEQ ID NO: 14720 - protein, 286 aa, Arabidopsis thaliana
MENKTQEEASTIKVSSLTCIDLANPNFQQSAVSLKQSKKFFALPLEEKMKVLRNENHRGYSPVLDQILDPENQVDGDYKESFFIGIEVVLPGWRATMEKYHQEALRVCKAIARLLALALDLDTNYFDKPEMLGNPIAVMRLLRYEGMSDPLKGIFGCGAHSDYGMLTLLATDSVTGLQICKDKDVKPRKWEYVPSIKGAYIVNLGDLLERWSNGIFKSTLHRVLGNGQDRYSIPFFIEPSHDCLVECLPTCQSENNLPKYPAIKCSTFLTQRYQQSHVNLSIYKQP

SEQ ID NO: 14721 - protein, 384 aa, Fusobacterium nucleatum subsp. nucleatum ATCC 25586
MVMKKKRIIAMILAGGQGTRLKELTEDLAKPAVAFGGKYRIIDFTLTNCSNSGIDTVGVLTQYEPRILNNHIGRGSPWDLDRMDGGVTVLQPHTRKNDEKGWYKGTANAIYQNIKFIEEYDPEYVLILSGDHIYKMNYDKMLQFHIQKDADATIGVFKVPLVDAPSFGIMNTKDDMSIYEFEEKPKEPKSDLASMGIYIFNWKLLKKYLDEDEKDPNSSNDFGKNIIPNMLNDGKKMFAYPFKGYWRDVGTIQSFWDAHMDLLSEDNELDLFDKSWRVNTRQGIYTPSYFTKESKIKNTLIDKGCIVEGEIEHSVIFSGVKIGKNSKIIDSIIMADTEIGDNVTIQKAIIANDVKIVDNIVIGDGKKIAVVGEKKIIDSQSLVK

SEQ ID NO: 14722 - protein, 505 aa, Arabidopsis thaliana
  misc_feature (498)..(498): Xaa can be any naturally occurring amino acid
MVVINSLRRLARTTQVHLHSKYATCMSGNSTSRRIFTTEAAPEKKNTVGSKGHDMLAPFTAGWQSADLDPLVIAKSEGSYVYDDTGKKYLDSLAGLWCTALGGNEPRLVSAAVEQLNTLPFYHSFWNRTTKPSLDLAKVLLEMFTANKMAKAFFTSGGSDANDTQVKLVWYYNNALGRPEKKKFIARKKSYHGSTLISASLSGLPPLHQNFDLPAPFVLHTDCPHYWRFHLPGETEEEFSTRLAKNLEDLIIKEGPETIGAFIAEPVMGAGGVIPPPATYFEKVQAVVKKYDILFIADEVICAFGRLGTMFGCDKYNIKPDLVTLAKALSSAYMPIGAILMSQEVADVINSHSSKLGVFSHGFTYSGHPVSCAVAIEALKIYKERNIPEYVAKVAPRFQDGVKAFASGSPIIGETRGTGLILGTEFVDNKSPNEPFPPEWGVGAFFGAECQKHGMLVRVAGDGILMSPPLIISPEEIDELISIYGKALKATEEKVKEXLKAQHKK

SEQ ID NO: 14723 - protein, 188 aa, Thermococcus kodakarensis KOD1
MIVIMDNGGQYVHRIWRTLRYLGVEAKIIPNTTPLEEIKAMKPKGIIFSGGPDINKTGNCSAILEHYDEFNVPILGICLGHQLIAKHFGGKVGRGEKAEYSLVEIEILDENDIFRGLPRKLRVWESHMDEVKELPPGFKLLARSETCPVEAMKHESLPIYGVQFHPEVAHTEHGADIYRNFAELCGEL

SEQ ID NO: 14724 - protein, 307 aa, Thermococcus kodakarensis KOD1
MWENFIEEKVKEIRETVGDGKAIIALSGGVDSSTAAVLAHRAIGDRLHAVFVNTGFMRKGEPEFVVKTFRDEFGLNLHYVDASERFFRELKGVTDPEEKRKIIGRVFIEVFEEVAKEINADFLIQGTIAPDWIESHGKIKSHHNVGGLPERLNLKLIEPLRDLYKDEVRELAKELGLPEKIYNRMPFPGPGLAVRVLGEVTPERVAIVREANAIVEEEIEKAGLKPWQAFAVLLGVKTVGVQGDIRAYKETVAVRVVESLDGMTANAMNVPWEVLQRIAFRITSEIPEVGRVLYDITNKPPATIEFE

SEQ ID NO: 14725 - protein, 440 aa, Aspergillus nidulans FGSC A4
MKVTITPALVLALSTLALTAPVEREVRSLETRDLSVDARHLGKLPVVKHKFGIEGGVKGGFGLGKKGKEDDKKDDKKGGKWDDDKKDDDDWDDDHWDNDDWDDDKKDDKKDDDKKDDDKKDDNGNSGGFGFGVGSSNGFDSKNPKGKPDYDPHHGKGPEGKPGYIVDHKHDDKKDDKNGGFLRARGEPKKDDDKHGGYKPDDKKDDHDHGYGYGKGDDKYDDKYDDKKDDKKDDKGKGKGFGFGFGFGAGVHGGGKGGGKGFGFGLGHGKGYGHGKGEDEGKGKGGGFGFGLGLGLGGKGSHGGHGGYGGGEGGNGGNGGGFGGGGGGGGGGGFGGGSGGFGGGEGGFGGGSGGHGGHEGGHGGHGGHEGGHGGNGGGFGGGGGGGGGGFGGGEGGFGGHGGGEGGHGGGHGGGFGGGFEGGFEGKGGYEGKGGYGKGGY

SEQ ID NO: 14726 - protein, 387 aa, Vibrio angustum S14
MSVIKMTDLDLAGKRVFIRADLNVPVKDGKVTSDARIIASLPTIKRCLEAGAKVMVTSHLGRPTEGEYAEEFSLQPVVNYLNDALDCDVKLAKDYLNGLELNAGELVVLENVRFNKGEKKNEDELSKQYAALCDVFVMDAFGTAHRAQASTYGVGMFAPVACAGPLLAGELEALGKAMDNPARPMVAIVGGSKVSTKLTVLESLSKIADQIVVGGGIANTFIAAEGNDVGKSLYEADLIPTAKELMASTDIPVATDVVCAKEFSDTAEATVKSASDIAADDMVLDLGPDSAQALADIIMNAKTILWNGPVGVFEIEQFGKGTEVVANAIAESAGFSVAGGGDTLAAIDKYGIKDKVSYISTGGGAFLEFVEGKKLPAVEMLESRAKA

SEQ ID NO: 14727 - protein, 369 aa, Zymomonas mobilis subsp. mobilis ZM4
MKTRAAVAFAEKQPLEIVELDLEGPKDGEVLVEIMATGICHTDAYTLGGFDSEGIFPVVLGHEGAGIVREVGKGVTSVKAGDHVIPLYTPECRQCKSCLSGKTNLCTAIRETQGRGVMPDGTTRFSYKGQPIYHYMGCSTFSNFTVLPEIAVAKIREDAPFKAACYCGCGVSTGVGAVINTAKVEAGANVVVFGLGGIGLNVIQAARMVGADKIIGVDTNDSKAEWGRRFGMTDFVNPNKIDEDIVPHLLRLTEGGADYTFDCTGNTDVMRQALEACHRGWGVSVVIGVAEAGKEISTRPFQLVTGRVWKGSAFGGVKGRTGVPKIVDWYMKGKIEIDPMITHILSLEEINKAFDLMHEGKSIRSVVLF

SEQ ID NO: 14728 - protein, 111 aa, Hyphomonas neptunium ATCC 15444
MTDQATLDAIEKAVKSNDVVLFMKGTPTFPQCGFSSTVVQILDYLGVEYVATNVLEDQNVREGIKQYANWPTIPQLYVKGEFVGGCDILKEMFENGELRDLMAENGIELAE

SEQ ID NO: 14729 - protein, 495 aa, Burkholderia pseudomallei K96243
MTTTTNTTANTTTEPAAPGAARAAPATPPIRDCLDRYCIIGGGAAGIATAKNLREHGIAFDLIEREDDIGGTWYYGKPCSAIYQSVHMISSREFSEYTDYPMPADYPTYARGDQALAYLRDYARRFGVYEHAQFNRTVLEVAPLAHGGAWRVELDGHDVRHYKGVFVCNGHLSKPQVPDYPGRFDGLQLHSALYKTPDVLKGKRVLVVGAGNSGCDIAVEAVHHASAVFHSTRRGYFYWPKFLFGIPADRWAEWPLKLRMPLWARRFFGERLLRLTTAGQPEDYGLPKPDHKLFEAHFIINSTLFYHLGHGDLVAKPDVVELKGDRVAFSDGSEERIDAIVYATGFQLSFPFLDQSYLQWDKMQPRLYLNMFDRAHPNLFFIGLFQTSTGNWPLMDYQAQLVARYLRARDAAPRKAARLDRMIGRDRSNWNGGIRFSDTQRHVIEVEHFAYRLQLKRLIRALPDSRVAARQARPVAVASAVPAPAAAARARTGDA

SEQ ID NO: 14730 - protein, 457 aa, Bordetella bronchiseptica RB50
MSKSPEQMTPYDQFNIEVPEDHFPVEGMSARAAQALVLSDEWTDTNPMLNMSSFVTTFAEPEAVRIAEKNMYKNYIDHDMYPQLFAMEQRMVRWLHQLWNGPKDAEPYGTATVGSSEACMLAGLAHKWNWRQRREREGKDATRPNMVTGGNVQIVWKKFLRYFDVEPRIVPLKPGQYCLTAEDLDKYVDENTIAVVAIAGQTFTGEDDDIQGIHDWLDAYEKKTGVSVPMHIDGASGGFVNPFLYPDYKWDFRLPRVQSINASGHKYGLTPPGLGWVIFRERKVFNEDLVFYVNYLGGEMPTATLNFSRNSFQVAVQYYQFLRLGFDGFKRVMQRTLDNAIALRQHLVDSGYFTIMNDTQRIPVVAVTLDPKVKKFNEFDVSNKVRERGWVISAYTMPPDAESVRSLRVVVRPHINRNVALLLAEDIVKACKYLEQHGGTATPPALHDTHKSSPAKC

SEQ ID NO: 14731 - protein, 1373 aa, Burkholderia pseudomallei K96243
MSKHRQAPGPRGGLVMGNLAAYKRNPITMLLRLHQQYGDVARNRLGPFVTHALAHPDHIQYVLQENHRNYVRGRFYDNFKMFFGDGLLTTDGEFWRRHRRVVQPLFHKKQVDAHTAAVGDAALALAHRWSALPPGKALDVVEEMMHLSLRMLGLMVFNTDVSSHAEAVGPAVRFGIEAMMPQGNLNDFIPRWAPTRFNRRIAHARRAIDTIVAKIIADHREARCEPSDVISLLLNARDPDTGAPMTQQEVHDEVMTVFLAGHETTGAGLAWALYALAQHPAVLRQLRDELDARLGGRAPTVQDFEQLPYLSQVVDEVLRVYPPIWGFTRDLVEDDEIGGYRIPARSSVFMSPYVTHRHPAFWRNPDAFDPENFASDAPARHRFVYFPFGGGMRKCIGFQTALLQMRVLVAVVAQHFDLNALPGHPIELGATISLRPVHGIRLIVKPRERQQSHLARVREHESARALRPLGDTATTAGAACPMTAAREPGASAAALAAVEAGALDAAHRGGAAAAAAGEPCPPRDPAEAAPLPLAASPAPASPAVDADASARGVPAWRFTWRPVPVDPVPDEPSPALSGRRIALVNGRGGTAERVAAALARTCAKVSVFAPAASADHAEAARVFVNEAGPLDGIVDLGLEAPFALDDAGAWEAPMRRTVELLKACYGDWAAEDDTSRLFYVALTWMDGQMGYGETAGAQPLGGLWAGLAKTLPQELPNCNVRVLDIAPDETGRVDRLVVNELYRWGLFEVGYRGGVRYTLHAKRNELPPHAVDARTTLGAGDTVLFSGGARGIGLLCARALAERHGCTVIVTGRETPPDGGEPWMALDEPGFKHYGLEQLRAATPEHPPKAIRAALQRLKRRRELKTALDEMAALGLPVHYRVCDVTDRAAVRALCDELGDSLRMVIHNAGVDRPVRLIQKRAEDFADTVRTKVLGFANLCDAVRARPRLVQFCNVGSLTGRWGGMTGETDYAAANEALARLGLWAARHAFSPACGVKTLVWPTWEGVGMITNFAVTQRYVSPMNVDEGVRHWLRELATPGSGEVMFMGAVGRAPTPVQIKGFVPIRELPNIGELVTRRHHVGEPVRFRPFKRFESRYAIDPAVAPYAHAFRFNGRAVLPASLVLEHACAVGDWVMPPTGEPRELSEMTNVVLRLDALPDVPAGGAPVELASEAAGYMIGDVWCVDVRCSDARTQAELLSMTLVYRPQPEQIGAAFARAPDTTPEPAPLTSAPHAAWNGELLPAGDWSVPDDASAGIVRIGRVPPAAVLSLWALPFPLELRLPVNHVEHVLRVLLAEWGAARADAPAVWRIGGAKLARLPAASADGVVEYAAGRFAVLDARGYVLLRIDDARVDGEPAQAALPETGALADPLTA

SEQ ID NO: 14732 - protein, 231 aa, Brassica napus
MNSKKMDTGSKDLISSLPDAIICHILSFLSTKDAALTSVLSKRWRHLLAFVTNLDLDNTIYDRPKMGRKRRRHLRKSSKLFVERVMALQGNAPLNKFSLRCKIACVTSRVNRWVLKALERGVVDLDLYISSEHEYPLPPQVLMSKTLVKLKLAGTDEFIIDVREVSLPKLKTLHMNDVSFADESGAAFGKLVSGCHVLEELVMVKMTWDFCGAGSVSNPTLKRLIIYGEYD

SEQ ID NO: 14733 - protein, 644 aa, Arabidopsis thaliana
MAASVHCTLMSVVCNNKNHSARPKLPNSSLLPGFDVVVQAAATRFKKETTTTRATLTFDPPTTNSERAKQRKHTIDPSSPDFQPIPSFEECFPKSTKEHKEVVHEESGHVLKVPFRRVHLSGGEPAFDNYDTSGPQNVNAHIGLAKLRKEWIDRREKLGTPRYTQMYYAKQGIITEEMLYCATREKLDPEFVRSEVARGRAIIPSNKKHLELEPMIVGRKFLVKVNANIGNSAVASSIEEEVYKVQWATMWGADTIMDLSTGRHIHETREWILRNSAVPVGTVPIYQALEKVDGIAENLNWEVFRETLIEQAEQGVDYFTIHAGVLLRYIPLTAKRLTGIVSRGGSIHAKWCLAYHKENFAYEHWDDILDICNQYDVALSIGDGLRPGSIYDANDTAQFAELLTQGELTRRAWEKDVQVMNEGPGHVPMHKIPENMQKQLEWCNEAPFYTLGPLTTDIAPGYDHITSAIGAANIGALGTALLCYVTPKEHLGLPNRDDVKAGVIAYKIAAHAADLAKQHPHAQAWDDALSKARFEFRWMDQFALSLDPMTAMSFHDETLPADGAKVAHFCSMCGPKFCSMKITEDIRKYAEENGYGSAEEAIRQGMDAMSEEFNIAKKTISGEQHGEVGGEIYLPESYVKAAQK

SEQ ID NO: 14734 - protein, 256 aa, Bradyrhizobium japonicum USDA 110
MTSSRFDLRGKVAIVTGGNGGIGLGLAHGLADAGADIAVVGRNETKSAAAVADLRQRGVKAIAVTTDVTDQAAVAAMIDRVVKEFGRIDILINNAGMSIRKPPHELELDEWNKVIDTNLTSAFVCSKLAYPALKASGNGKVINIGSMMSIFGASFATAYAASKGGIVQYTRACANAWAPDNIQVNAILPGWIDTDLTRGARQQVSGLHERVLARTPAGRWGEIDDFAGIAVFLASPASNFVTGTAIPVDGGFSVMA

SEQ ID NO: 14735 - protein, 342 aa, Methanosarcina acetivorans C2A
MTKTAAVIKGDGVGPELVEAMLKVANAAGTDVEFVMCEAGAGWWEEHGGNSLVPDETWQILDSSDACFKGPTTTPGGIGSPRSVAVSIRRKYDLYANVRPIKTFPNSNAPLGDVEMVCVREGTEGLYIGEEIQLTDDVSIAIRKITRTASGKIARYAFEEAKRRGYDTVVPIHKSNILKLTCGSFLEEVEKVAQDYPNIEVWPYHIDNIAQQLIKNPQIFNKKVLLSTNLFMDVISEECSALVGSIGLIYSANLGDNFAMFEPAHGSAPKYAGLDKVNPVATVLAGAWMLDYLGEKEKSEAIFKATERVISEGKYVTYDVGGNAKLSQMADEIAKYTAEILK

SEQ ID NO: 14736 - protein, 578 aa, Gibberella zeae PH-1
MSLYHEAAEILTGSSSEGGSLKSRVFKKKGLKSAPNQVYALVLESCKWSPILKEVIEKSELLKLERKLTPTLSLLLVHDLLLAKKGIALPQGHGLRASIERHKARISSEFKLARLRRKMPTLEALKGQVERECAGEETNYPRWVRVNAVKSTLEEQLETTFSKYTRARSINEVVTNAGRLIYIDSHVPNLVAITAGIDLTKTEAYTSGKIILQDKASCFPAYLLDPRSEDGDLIDACSAPGNKTTHLAAIVKQHTPEFDTPAQTIYAFEKDSRRSQVLHKMVKIAGSDYMTKIGFGQDFMQVKPTADNYKSVGALLLDPSCSGSGIVGRDSMPDLHLPEPYSGNGKTPPAKPNNRKRKHEKVEPAPENVMIDDDGNEMAIKSEKDLETRLEALSSFQLVLLLHAFRFPSAKKITYSTCSVHVQENERVVMRALESDIAKRRGWRILQRKDQVSGMREWPVRGLPEACEGDKEIAEGCIRSYKDDGQGVMGFFVAGFVRSGEQDDAPADDEGPYMRDDSGVIIRDVVGMPVLTSTGEAVSLTPRNEKSNDSDEESSEEEESASESNSSDEDDEWGGFDD

SEQ ID NO: 14737 - protein, 233 aa, Dianthus caryophyllus
MGRGRVELKRIENKINRQVTFAKRRNGLLKKAYELSVLCDAEVALIVFSNRGKLYEFCSTSCMNKTLERYQRCSYGSLETSQPSKETESSYQEYLKLKAKVDVLQRSHRNLLGEDLGELSTKELEQLEHQLDKSLRQIRSIKTQHMLDQLADLQKKEEMLFESNRALKTKLEESCASFRPNWDVRQPGDGFFEPLPLPCNNNLQIGYNEATQDQMNATTSAQNVHGFAQGWML

SEQ ID NO: 14738 - protein, 721 aa, Gibberella zeae PH-1
MDRGSVYSAHVYEPSFGENGDTRLQLQTQLETFILDFRLDNNFVYRDQLRENALLKRYFCDVNINDLISFNEELAHRLASEPAEIIPLFENALKKCTHRIVFPHEPKIEIPEHQLLLHSNADDVSIRHLDSETISRLVRVPGIVIGASVMSSKATELHIQCRNCGHTQNIPVLGGFTGVTLPRQCSRSRVPNDPTPKCPMDPYFVAHEKSRFVDQQIIKLQEAPDQVPVGELPRHVLISADRYLTNRVVPGSRCTVMGIFSIYQNKASKNSSTGGAVAIRTPYLRAVGIQSDIDQAAKGNATFSEEEEQEFLEMSRRPDIYDVMTDCIAPSIYGNRDIKRSILCLLLGGSKKILPDGMRLRGDINVLLLGDPGTAKSQLLKFVEKAAPISIYTSGKGSSAAGLTASVQRDQSTREFYLEGGAMVLADGGVVCIDEFDKMRDEDRVAIHEAMEQQTISIAKAGITTILNARTSVLAAANPIFGRYDDMKTPGENIDFQTTILSRFDMIYIVKDEHSREKDETMAKHVLGIQMNGRGTEDMTESEIPIDKMRRYITYCKTRCAPRLSPEAAEKLSSHFVSIRRQVHAAEIEANSRSSIPITVRQLEAIVRITESLAKLTLSPIATEVHVDEAIRLFLCSTMDAVNQGSNQGSRELNDEVNRLEAELKRRLPIGWSTSLSTLKKEMVEGKGYSEQALNRALMVLQRRDTIMFRNQGAQVYRNGA

SEQ ID NO: 14739 - protein, 435 aa, Medicago truncatula
MCEKENPNSHSALLDGKYELGRVLGHGTFAKVYHAKNLNTGKNVAMKVVGKEKVIKVGMIEQIKREISVMKMVKHPNIVQLHEVMASKSKIYIAMELVRGGELFNKIVKGRLKEDVARVYFQQLISAVDFCHSRGVYHRDLKPENLLLDEDGNLKVSDFGLCTFSEHLRQDGLLHTTCGTPAYVSPEVIAKKGYDGAKADIWSCGVILYVLLAGFLPFQDDNLVAMYKKIYRGDFKCPPWFSLEARRLITKLLDPNPNTRISISKIMDSSWFKKPVPKSIAMRKKEKEEEEDKVFEFMECEKSSTTMNAFHIISLSEGFDLSPLFEEKKREEREEMRFATGGTPSRVISKLEQVAKAVKFDVKSSDTKVRLQGQERGRKGKLAIAADIYAVTPSFLVVEVKKDKGDTLEYNQFCSKELRPALKDIFWTSADPPAA

SEQ ID NO: 14740 - protein, 355 aa, Kluyveromyces lactis NRRL Y-1140
MAGIKHRRDSAESINTDIITLSRFILDQQHLSAKNATGEFSMLLNSLQFAFKFISQTIRRAELVNLIGLAGASNSTGDQQKKLDVLGDEIFINAMKASGNVKVLVSEEQEDLIVFRNSPGKYAVCCDPIDGSSNLDAGVSVGTIVSLFKIHENQNGNSGEEDSEGTINDVARCGREMVAACYTMYGASTHLVLTTGAGVNGFTLDNNLGEFILTYPELRLPEQKSIYSINEGNTCYWEPTIADFIAKLKENSEENNGKPYSARYIGSMVADVHRTLLYGGLFSYPGDKKNPNGKLRLLYEAFPMAFLVEQAGGKAVNDRGERILDLVPQHIHDKSSIWLGSSGDVDKYLKHIGKL

SEQ ID NO: 14741 - protein, 611 aa, Arabidopsis thaliana
MASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYA

SEQ ID NO: 14742 - protein, 233 aa, Coprinopsis cinerea okayama7#130
MVSARRSINRAACVTIAELAVEAERYQGPCMFSEDVVAEIKTIVYAFNAQLTPEERSLLSVAYKNLTNNLRNSWRTIDCLESAAASIGSSNPKRRRELGLMRQQKRKIEKELVVTCNDIIELLDRYLLLAAKPGEEAVFYSKMKGDYYRYLAEFGPEEERKRYGESSHQAYRMAYKRALNNLDPLDPTRLGLALNFSVFYHGKAQTELATWPRVPSTTPSNVWIHPISRWTNH

SEQ ID NO: 14743 - protein, 336 aa, Zea mays
  misc_feature (171)..(171): Xaa can be any naturally occurring amino acid
MAPLGDGGAAAAAASNNLVVSFGEMLIDFVPDVAGLSLAESGGFVKAPGGAPANVACAIAKLGGSSAFVGKFGDDEFGHMLVNILKQNNVNAEGCLFDKHARTALAFVTLKHDGEREFMFYRNPSADMLLTEAELDLGLVRRARVFHYGSISLISEPCRSAHMAAMRAAKXPAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 14744 - protein, 427 aa, Escherichia coli K12
MADTKAKLTLNGDTAVELDVLKGTLGQDVIDIRTLGSKGVFTFDPGFTSTASCESKITFIDGDEGILLHRGFPIDQLATDSNYLEVCYILLNGEKPTQEQYDEFKTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCEPYEVNPILERAMDRILILHADHEQNASTSTVRTAGSSGANPFACIAAGIASLWGPAHGGANEAALKMLEEISSVKHIPEFFRRAKDKNDSFRLMGFGHRVYKNYDPRATVMRETCHEVLKELGTKDDLLEVAMELENIALNDPYFIEKKLYPNVDFYSGIILKAMGIPSSMFTVIFAMARTVGWIAHWSEMHSDGMKIARPRQLYTGYEKRDFKSDIKR

SEQ ID NO: 14745 - protein, 740 aa, Zea mays
MARAAAPILLHLLLLLLLLTDHGPGPAAAVRFDYASLTLGSLRLLGDAHLKNGTIRLSRDLPVPTSGAGRALYATAVPLRGGFSTQFAFTVATLNPSSVGGGLAFVLATDGATLGDAGAYIGVSVATDAAAVEFDTLMDVQFGDPNGNHVGLDLGSMVSAAAADLGGDDAGVDLASGRTINAWIDYRPSSSPSGSAAGILEVFVSYAPKQPPKPRPGSTEVHAIEWWSFSTASPAPSPRSAAPAPESQALPPPVATPVLPSPLLPGGTTTAPAPPSGSAGAPAASIAPSSGATVGRNAAGSGTPRPPAAVAGAATAGAFVAASFAGVALWALARRARARKRQAALAVGTRRDSSVASAAALARSPREFSYKELSAATRGFDASRVVGNGAFGTVYKGIVPDTGAMVAVKRCTTGARGGGGGSGEQARSEFLSELSIIAGLRHRNLLRLQGWCYEKGEILLVYDYMRNGSLDRALFDASAPVLPWRHRREILAGVASALAYLHHECERRVIHRDVKSSNVMLDEAYRARLGDFGLARQAEHGESPDATAAAGTMGYLAPEYLLTGRASECTDVFSFGALALEVACGRRPIGATPEGVGGCCSNLVEWVWSLHAEARILGAVDPRLGGEFEEGEARRALLVGLACSSPEPALRPGMRAVVQVLGGEADPPFVPAARPSMSLGSANQQLLLSLQDSVSDYHAMLGLPLSDSSSSGSLSSSSLTSTLRRGGHDIRVSSTAGEAR

SEQ ID NO: 14746 - protein, 403 aa, Zymomonas mobilis subsp. mobilis ZM4
MSEPFYRIRRLPPYVIAEVNAMRAAARAAGEDIIDLGMGNPDQPPPSHVIDKLAEVANKPDAHGYSASRGIPGLRKAQAAYYQRRFGVDVDPESEVVVTLGSKEGLANLAQAITAPGDVILAPNPSYPIHMFGFIIAGATIRSIPTTPDENFFKDLERAINFTVPKPSAMVIGYPSNPTAEVADLAFYERVVDFARRHNIWVLSDLAYSEIYFDGNPPPSILQIPGAKDVAVEFTSLSKTYSMAGWRIGFAVGNKKLIAALTRVKSYLDYGAFTPIQAAAVAAINGPQDIIEKNRELYKRRRDVMVESFTRVGWPIPAPKASMFAWAPLPKELAHLGSLEFSKQLLTHAKVAVAPGVGYGEKGEGYVRLAFVENEHRIRQAARNIKRYFTSLGIQGNDSIAAE

SEQ ID NO: 14747 - protein, 665 aa, Chlamydophila pneumoniae AR39
  misc_feature (76)..(76): Xaa can be any naturally occurring amino acid
MINKELDIGILGKIAGAIKQISIESIQKASSGHPGLPLGCAELAAYLYGYVLRQNPRDPHWINRDRFVLSAGHGSXLLYSCLHLAGFDVSLEDLQEFRQLHSRTPGHPEYGETVGVEATTGPLGQGLGNAVGMALSMKMLESRFNRPGHEIFNGKIYCLAGDGCFMEGVSHEVCSFAGSLNLNNLVVIYDYNNVVLDGYLNEISVEDTKKRFEAYGWDVYEIDGYDFTHIHETFSSIKRGQERPVLVIAHTIIGHGSPKEGTNKAHGSPLGVEGTHETKQFWHLPEEKFFVPPAVKNFFAHKIQEDRKAQEQWLDEVRVWSKQFPELHEEFVALTSHKLPKNLESLVQSVEMPDSIAGRAASNKLIQVLVQHIPYLIGGSADLSSSDGTWIANEKVIHTYDFSGRNIKYGVREFGMATIMNGLAYSQVFRPFGGTFLVFSDYMRNAIRLAALSKLPVIYQFTHDSIFVGEDGPTHQPVEQLMSLRAIPGLYVIRPADANEVRGAWIAGLKHTGPTVIVLSRQALPTLPAAHRPFKDGVGRGAYIVLKESGEKPDYTLFATGSEVSLALSVAKELEHLDKQVRVVSFPCWELFEAQDVDYKQSIVGGDLGIRVSIEAGSALGWYKYIGSEGLAIAMDRFGYSGASDDVSEECGFTTEQILQRILSQ

SEQ ID NO: 14748 - protein, 794 aa, Hyphomonas neptunium ATCC 15444
MPLSFKQLKTIEQRLLWLAAWTVHNANHLREKADDDVKVGGHQASCASIVSIMTALYFHVLRPEDRVAVKPHAAPVFHAMHYLMGSQTREKLENFRGYGGAQSYPSRTKDIDDVDFSTGSVGLGVAETAFASIIQDYLIARPWTDFGSGKRPAGRMVALVGDAELDEGNVYECLQEGWKHGLRNTWWIIDYNRQSLDGVVHEGLWTKIEAIFKAFGWRVEVLRFGALQRAAFAEPGGERLKQWIEDCPNPLYSALTYMGGAAWRKRLLDDIGDQGDVAALLEKRSDTQLSELMNNLGGQCLETLLEAFSRADDERPTVFLAYTIKGWSTPLAGHKDNHAGLMTKAQMADFQKVMGVAEGEEWEPFATVKQPGDLQAALEDVAFFAKGARRYSAPRVPSPGPVFLEDETLSTQAGLGKILDSLARGDTELAQRILTTSPDVTVSTNLGGWVNRRGLFAREAVADTFRDQKIPSAQKWAFSPEGQHIELGIAEMNLFLLLGAAGLSHSLFGERLIPVGTVYDPFVARGLDALNYACYQDARFIIAGTPSGVTLAPEGGAHQSIGAQLIGMSQDGIVSFEPAFLDELSIIMDWSFDYLQRDGEGDPDERTWLRDETGGSVYLRLSTRPVEQVRAWSREDAAFRQGVIDGGYWLRKPGPNAEVIIAYQGVIAPEAIKAAARIGEGRRDIGVLAVTSADRLNSGWTAARRARARGQKTAISQIERLMDGVPRHAQLITVTDGHPATLAWIGGVKGHPVTPLGVEHFGQTGTIRDLYRHFMIDADAIVSAASHLSPGKSL

SEQ ID NO: 14749 - protein, 424 aa, Rhodopseudomonas palustris CGA009
MTNSELLTRRQTAVVRGVSQATPVFAERALNSEIWDVEGKRYVDFAGGIAVLNTGHCHPRIVAAIREQLDRFTHTCFQVAPYEGYIRLAERLNQLAPINGPLKSILLSTGAEATENAVKIARAATGRSGVIAFTGGFHGRTAFASAMTGKVIPYKKALGPPLPGVWHVPFPVAGSDVSVEDALRCVQFVFKADIDASQVAAIIIEPVQGEGGFHQAPPELMRGLRRLCDENGIVLIADEVQTGFGRTGKMFAMEHYDVQADIVCVAKSLAGGLPLSGVIGRAAIMDAAEPGGLGGTYAGNPLACAAALAVLDVFEEENLIARANQIGERLRSAIDRFALSNTLVPTSVARGPGAMVAFDILKQRGSNEPDAEATKRVTRLAHENGLILLSCGTAANTIRILVPLTASDAIVDEGLAILERCLAA

SEQ ID NO: 14750 - protein, 483 aa, Rhodopseudomonas palustris CGA009
MLMPSDPGLLAERCLIGGKWCGEPVDAVFNPATGERIGAVPRFGTDEAEEAVRAAEIAFRQWSKLLAKQRATMLRAWFDQIIANRDDLALLLTREQGKPLAEALGEIDYAASFVEFYAEEARRIYGETIPSHRADARTMVIRQPVGVVAAITPWNFPAAMITRKVAPALAAGCTVVIKPAPETPLTALALGVLAQRAGFPPGVLNIITGDAPAIGKAWTEHPTVRAISFTGSTEVGKILMRQAASTVKKVALELGGNAPFIVFDDADLDAAVEGVIASKFRNMGQTCVCANRIYAQDGIYDAFVEKLTAKVATLQVGNGVDAGVTQGPLITTEAIAKVERHVSDAVAKGAKVVLGGKRHKLGRTFFEPTVLAGVTTAMLITREETFGPVAPVYRFTDEADVIAQANDSPFGLASYFYARDLGRVFRVAEALESGMVGVNSALLGADVVPFGGVKQSGLGREGSRHGIEEYVETKYILLGGLDR

SEQ ID NO: 14751 - protein, 204 aa, Oryza sativa (indica cultivar-group)
MASARPYRFPPPAEGGEPTRRRSAAQSCGTCGASAVASCVALCCCPCAVVGCLTLALVNPPYAAGRRCVARLAAGKRRRMIRPGVATTPRKTNRVWDLDDGQLQEWRPAGADGAVRAERKQDRREPGRTGGAASAAPPGDASVDAISAVGEGSGRARPRVDTAEKTWVEIYQLGHWGFGRLSFSQPQVIRGDTCGNDGVAASRQ

SEQ ID NO: 14752 - protein, 448 aa, Burkholderia pseudomallei K96243
MTTVFHRAPRASLPIAVAGDGIEIVDSTGTRYIDACGGAAVSCLGHSNQRVIDAIKRQAQQLPYAHTSFFTTQPAEALADRLVAAAPAGLEHVYFVSGGSEAIEAALKLARQYFVEKGEPARRHFIARRQSYHGNTLGALAIGGNAWRREPFVPLLIEAHHVSPCYAYREQRADETEEAFAQRLADELESRILALGPDTVAAFVAETVVGATAGAVPPVREYFRKIRAVCDKYGVLLILDEIMSGMGRTGYLFACEEDGVAPDLLTIAKGLGAGYQPIGATLVSDAIYRTIVDGSGFFQHGHTYVGHASACAAALEVQRVIDEERLLENVKARGEQLRASLAVRSAEQPHIGDVRGRGLFVGVELVRDRDTKAPFDPRLKLNALVKREAMQRGLMVYPMGGTVDGHLGDHVLLAPPFICTAPQIDTIVERLGDAIDAALASIGAAALR

SEQ ID NO: 14753 - protein, 480 aa, Cytophaga hutchinsonii ATCC 33406
MFSSLFKTKSIQSILKEEKGELKKTLTATSLVLLGIGAIIGAGIFSLTGIAAAENAGPAVTISFVVAGLGCAFAGLCYAEFASMLPIAGSAYTYSYATLGEFIAWIIGWDLVLEYAVGAATVAISWSRYLIKLLEKLGVDHIPYQWMMSPFETHRVNGTELHGIVNIPAIFITCLMSLVLIRGMKESAKLNNVIVALKITVVIAFIILGWSYMDPINHADYVPDNTGVFEHFGWTGVMTGAAVVFFSFIGFDAVSTAAQEAKNPQRDMPIGILGSLVICTILYVLFSYVMTGLENYQNFKGEAAPVALAIAATPYAFFQELIIIAILAGYTSVIMVLLMGQSRVFFSMSKDGLVPAIFSEVHPKYQTPWKSNILFAILVSLFAGLVPVSVVGEMTSIGTLFAFVLVCIGVLVLRKKQPDAPRAFRTPWVPFVPIMGIVVCLYLMYALPIDTWIRLIVWMAIGIAIYFLYSRHHSKIRNSN

SEQ ID NO: 14754 - protein, 168 aa, Triticum aestivum
  misc_feature (167)..(167): Xaa can be any naturally occurring amino acid
MNALAATSRNFRQAARLLGLDSKLEKSLLIPFREIKVECTIPKDDGTLASFVGFRVQHDNARGPMKGGIRYHPEVDPDEVNALAQLMTWKTAVAAVPYGGAKGGIGCSPGDLSRSELERLTRVFTQKIHDLIGTHTDIPAPDMGTNSQTMAWIFDEYSKFHGHSPAXV

SEQ ID NO: 14755 - protein, 413 aa, Bradyrhizobium japonicum USDA 110
MPGAQRAMEEFYRIRRLPPYVFEQVNRAKAAARNAGADIIDLGMGNPDLPAPPHVLEKLKETLGKPRTDRYSASRGIPGLRRAQAGYYARRFGVKLNPDTQVVATLGSKEGFANVAQAITAPGDVILCPNPSYPIHAFGFLMAGGVIRSVPSEPTPQFFEAVERAIVHSIPKPLALVVCYPSNPTAYVASLDFYKDLVAFAKKHEILILSDLAYAEVYFDENNPPPSVLQVPGAMDVTVEFTSMSKTYSMAGWRMGFAVGNERVIAALARVKSYLDYGAFTPVQVAATAALNGPDDCIKEMRDTYRKRRDALVESFGRAGWEIPPPEASMFAWVPLPEAFRSVGSMQFATLMVEKSGVAVSPGVGFGEHGEGYVRIAMVENEQRIRQAARGVRRFLESGIETLHNVVPLANRR

SEQ ID NO: 14756 - protein, 392 aa, Brassica rapa subsp. pekinensis
MASSTKTVMIPIAHGTEPLEAVAMITVLRRGGADVTVASVEDKVGVDACHNIKMVADTLLSDITDSIFDLIVLPGGLPGGETLKNCKPLENMVKKQDTDGRLNAAICCAPALALGTWGLLEGKTATGYPVFMEKLAATCATASESRVEIDGRIVTSRGPGTTIEFSITLIEQLFGKDKADEVSSGLLVRPNPGEEFTFTELNQTNWSFQDTPQILVPIAEDSEEIEAIALVDILRRAKANVVIAAVGNSLEVVGSRKAKLVADVLLDEVAEKSFDLIVLPGGLNGAPRLASCEKLVNMLKKQAEANKPYGGICASPVYVFEPHGLLKGKKATTHPCVSNKLSDQSHVEHRVVVDGNVITSRAPGTAMEFSLAIVEKFYGREKAVQLAKATLV

SEQ ID NO: 14757 - protein, 205 aa, Corynebacterium glutamicum ATCC 13032
MGPIRIGVGGPVGAGKTQLVERITRALIDEVSMAAITNDIYTIEDAKILAANGVLPEERIVGIETGGCPHTAIREDTSMNDAAIKDLVERFPDLELIFVESGGDNLSATFSPELVDFSIYIIDVAQGEKIPRKAGQGMIKSDLFIINKTDLAPYVGANLDVMVEDAKAFRKNKPFCLTNLRTDDGLDKVLEWIRHEVMMQDLQEA

SEQ ID NO: 14758 - protein, 156 aa, Glycine max
MLFANMCLLTATDLKRIFEKVDVNGDGLVSLEELNRLLQMTGNSQYSIEELESLVEKKSLGFSDFLFFYNSISEQNKGESKGSELESDLAKTFEVFDLDGDGFITSQDLESVLKRLGFWDQTHAKDCRTMIRFYDTNFDGRLDFQEFKTMMLLTKA

SEQ ID NO: 14759 - protein, 350 aa, Oceanospirillum sp. MED92
MSVFSHNEFDNHEQVVFCHDESTGLKAIIAIHNTNRGPALGGCRMWNYVDDQEALNDVLRLSKGMTYKSALANLDLGGGKSVIIGDPRKHKSEELLKAMGRFLERTGNQYIAAEDSGTSVPDLQVMGIETNNVAGVTERTGIDGLPCNGDPSPATAYGTFAGLKAAVQYKLDRTDLTGLKVAIQGVGNVGYRLAEHLHKAGAQLFVTDIHEEQVDKAVRELGATAVSQKEILSLDVDVLAPCALGAVLNDESIPLIKAQVIAGASNNQLAAQRHDLMLRERGILYAPDYAINAGGIIDIFYERIGHEHNKVRAHIETISDTLMEIFRRADSQDRPTGEVADELAEERFMK

SEQ ID NO: 14760 - protein, 499 aa, Arabidopsis thaliana
MARKMLVDGEIDKVAADEANATHYDFDLFVIGAGSGGVRAARFSANHGAKVGICELPFHPISSEEIGGVGGTCVIRGCVPKKILVYGATYGGELEDAKNYGWEINEKVDFTWKKLLQKKTDEILRLNNIYKRLLANAAVKLYEGEGRVVGPNEVEVRQIDGAKISYTAKHILIATGSRAQKPNIPGHELAITSDEALSLEEFPKRAIVLGGGYIAVEFASIWRGMGATVDLFFRKELPLRGFDDEMRALVARNLEGRGVNLHPQTSLTQLTKTDQGIKVISSHGEEFVADVVLFATGRSPNTKRLNLEAVGVELDQAGAVKVDEYSRTNIPSIWAVGDATNRINLTPVALMEATCFANTAFGGKPTKAEYSNVACAVFCIPPLAVVGLSEEEAVEQATGDILVFTSGFNPMKNTISGRQEKTLMKLIVDEKSDKVIGASMCGPDAAEIMQGIAIALKCGATKAQFDSTVGIHPSSAEEFVTMRSVTRRIAHKPKPKTNL

SEQ ID NO: 14761 - protein, 376 aa, Phytophthora brassicae
MADEDVQALVVDNGSGMCKAGFAGDDAPRAVFPSIVGRPKHLGIMVGMDQKDAYVGDEAQSKRGVLTLKYPIEHGIVTNWDDMEKIWHHTFYNELRVAPEEHPVLLTEAPLNPKANRERMTQIMFETFNVPAMYVNIQAVLSLYASGRTTGCVLDSGDGVSHTVPIYEGYALPHAIVRLDLAGRDLTDYMMKILTERGYSFTTTAEREIVRDIKEKLTYIALDFDQEMKTAAESSGLEKSYELPDGNVIVIGNERFRTPEVLFQPSLIGKEASGIHDCTFQTIMKCDVDIRKDLYCNIVLSGGTTMYPGVGERMTKELTALAPSTMKIKVVAPPERKYSVWIGGSILSSLSTFQQMWISKAEYDESGPSIVHRKCF

SEQ ID NO: 14762 - protein, 149 aa, Brassica napus
  misc_feature (115)..(115): Xaa can be any naturally occurring amino acid
  misc_feature (138)..(138): Xaa can be any naturally occurring amino acid
MEQTFIMIKPDGVQRGLVGEIICKFEKKGFTLKGLKLITVDRPFAEKHYQDLSAKPFFNSLVDYIISGPVVAMIWEGKNVVLTGRKIIGATNPAASEPGTIRGDFAIDIGRNVIXHGATPVESANKEAALWFPDGPVXWQSSLHSWIYE

SEQ ID NO: 14763 - protein, 659 aa, Thermococcus kodakarensis KOD1
MKKVVCPYCGFGCKLLIDPATLKVKPYKGEPNKGKLCPKGLYSTEIVKSRDRLKRPLKRVGSKIVPISWGQAMEEISNKLLEVRELYGPDAVAFLASSKVSNEENYLLQKIARLFGTNNIDNCARLCHEASVHALKLAVGTGAQTNPYEDIPKFKSVLIWGYNPAETHPVVMDYILRAKKSGAKIIVVDVRETRTMAFADHRLIIRPGTDIVLANALAHVIIEEELYNEEFIRSRTTGFSEVRMAVKKYTPEYAERATGVPAEKIKEVARDFSLAGSGAEMWGMGLTQHVSGVENVLALINLALLLGYIGERGGLYPMRGQNNVQGAAYMGALSEFLPGYVPLTDGKFRKRVAGLWGVDDLPTERGLYLTELWDAIEKGDVRALYIVGENPAVSEADFMRVRRALRNLDLLVVQDIFPTRTARYAHYLLPASAFCEKAGSYMNSERRIQWSEKVCEPAYDSKPDWEILTMLGKALGLPGFNYTSVEEITAEYFRLFPELEEKSVEELKNSDGIFLPKKRLHTWEFATPDGKARFMAVEWIPPWEGPDDKYPFVLTTVRLIGHYNTGEMTLRSPSLVRLMGEPKALISREDAERLGIQNGDWVEVETRRGKIRMTAEIGDVPQGVIAVPFHFKANKLTSHALNKAGTPEFKFAAARVRKV

SEQ ID NO: 14764 - protein, 425 aa, Kluyveromyces lactis NRRL Y-1140
MSLEEARNLVGKEDYEKAEAQFLAVLNHQDAAQPQSISNKDAQEKEQCILELGQLYGTTHQLKKLAEFVPRSREYMMKVAKSKIAKVLKTLLNDFELIPDSLDTQIEICEDSIDFATKEKRIFLKHSLSIRLATLYYQKTHYNESLQLINDLLRQFKKLDDKSSLLEVHLLECKVYHKLRNLTKSKAALTSARTSANSIYCPTLTMAELDLMSGILHCEDKDYKTAFSYFYESFEAFHSQTGSNTFGKACQVLKYMLLSKIMLNLIDEVKTILNAKYTKETYQSRGIDAMKAVAEAYNNRSLLEFNTAMQNYKTELMGDELIRSHFNALYDTLLESNLSKIIEPFECVEVSHISKIIGLDAQQVEGKLSQMILDKVFFGVLDQGNGWLYIYETPQQDATYDSSLELINQLNGVVEQLFEKAAVLY

SEQ ID NO: 14765 - protein, 451 aa, Thermoanaerobacter tengcongensis MB4
MPKRYVIIGGDAAGMSAASQIRRMDKEGEVLVFEKEGVISYAQCGLPYWVGGVVSEKKKLIARTAEEFLNRYNIDVKLYHEVVKIDPSKKEIKVFRREEKDEIAVPYDVLLIGTGSTAIVPPWEGRNLPGVFTLKTMGDAEKLLDWLSSHTPTKAVVIGGGYIGLETAEALHSRGFKVTVLDLAPQLIPTFDKEIAEIAQDALTRHGVEVHLNEEVVGLEGDEKGVKAVVTKNGKFEADLVIISIGVRPVSELAKEAGIELGPKNAILVNERLETSIPDIYAAGDCATHFNRIKNAPDYIPLGTTANKQGRIAGINMAGGDAKFAGVVGTAIVKVFDRTIARSGLGERDCEALGIPYQVVLIKARPVSHYYPWEDEILTIKLCYHKDNRKLLGGQIAGGLGGVDKRIDVLATALFHEMTIDELQALDLAYAPPYNSVWDPLQQASTVAQRG

SEQ ID NO: 14766 - protein, 219 aa, Capsicum annuum
MADQYEHNKPSVEETTTGANVESTDRGLFDFLGKKEEEKPTHAHEEQAISSEFGEKVKVGEEEHKEEEKKKEEKKLHRSSSSSSSSSDEEEEVVGEDGQKIKKKKKKGLKDKMKDKISGDHKEEDKKTEDTSVPVEKYEETEEKKGFLDKIKDKLPGGGQKKTEEAAAPPSPPPPPAVAEHEAEGKEKKGFLDKIKEKLPGYHSKTEEEKEKEKEAASH

SEQ ID NO: 14767 - protein, 426 aa, Methylococcus capsulatus str. Bath
MLDSTTLFADACRFIPGGVNSPVRAFRGVGGTPVFVDRAEGPYVYGVDGKAYIDYVGSWGPMILGHAHPEVLTAVHAAVDRGLSYGAPTVAETAMAKTVCALMPSLDRVRMVSSGTEATMSAIRLARGYTGRDKIVKFEGCYHGHSDSLLVKAGSGALTLGAPSSPGVPANLAEHTLVLPYNDAAAVRDVFARHGAEIACIIVEPVAGNMNCVPPVPGFLETLRDVCDASGAVLIFDEVMTGFRVALGGAQAHYGICPDLTTLGKVIGGGMPVGAFGGRLDIMEQLAPVGQVYQAGTLSGNPVAMAAGLKTLELISQPKFFDELAEKTRHLAEGLRVRAEQAGIPLCVNWVGGMFGLFFTEQQGVSRFDQVMACDQERFRRFFHGMLEEGVYLAPSAFEAGFVSAAHDYQILDRTLTAAERVFAGL

SEQ ID NO: 14768 - protein, 326 aa, Streptococcus agalactiae NEM316
MSSYWNNYPELKKNIDETNQLIQERIQVRNKDIEAALSQLTAAGGKQLRPAFFYLFSQLGNKENQDTQQLKKIAASLEILHVATLIHDDVIDDSPLRRGNMTIQSKFGKDIAVYTGDLLFTVFFDLILESMADTPFMRINAKSMRKILMGELDQMHLRYNQQQGIHHYLRAISGKTAELFKLASKEGAYFGGAEKEVVRLAGHIGFNIGMTFQILDDILDYTADKKTFNKPVLEDLTQGVYSLPLLLAIEENPDIFKPILDKKTDMATEDMEKIAYLVVSHRGVDKARHLARKFTEKAISDINKLPQNSAKKQLLQLTNYLLKRKI

SEQ ID NO: 14769 - protein, 402 aa, Streptococcus agalactiae NEM316
MKEILVLGAGYAGLKAVRNLQKQSGDFHITLVDMNDYHYEATELHEVAAGSQPKEKITFPIKDVINTNKVNFMQDEVLKVDAENKTVTVKNNGELHYDYVVVALGFVSETFGIKGAMENALQMTNISQAENIHNHIVNTMKLYRETKDENLLKLLVCGAGFTGIELAGAMVDERPKYAALAGVKPEQIEIICVEAATRILPMFDDELAQYGVNLIKDLGINLMLGSMIKEIKPGEVVYGTSKEDEELKSITAGTIIWTTGVSGSPVMGESGFDQRRGRVMVNSDLRDPKYDNVYVIGDVSAFMDTESGRPFPTTAQIATRMGAHVAKNLLHQIKGEATEDFSYSPQGTVASVGNTHGLGVVGKTKIKKYPASVMKKIIMNKSLVDMGGLKELLAKGRFDLYH

SEQ ID NO: 14770 - protein, 566 aa, Colwellia psychrerythraea 34H
MQHMKVLIVDDDIVDRELIKRTLKRSDISCNITEVESVDDALKNLQDSSFDAILLDYNLPQRNGIELLLEIKGDPNRHDTAVIMMSTSKEDELALNCINAGAQDFLVKTEINVFRLQRAIVNAQARSDLEKRLYQSYQRTKELAEHDSLTGLANRYYFDESLVKDIKSNQREKKILALLLIDLDNFKYVNDNFGHDIGDKLLIEVVKRISNCLRGNELFARLGGDEFAITLTRLPSINGASIVSQRIINALREPFQIDNHWIQSGASIGISTCPWDSSNTKELFKFADIAMYRAKNKGRNQFSFFEEEMQNEFLEQFKIETQLRSAIMNDDFYLHYQPVIDAKSKTITGVEALIRWNIDGDMISPDKFIPIAEKSRLIIDIGKWVIQQAIKQLSLWNKNRSSPLTMAINFSSVQLADEYLFDFIRDCLSQHNVAAHLIEVELTETALIIEPEKTVKIIQGISDLGCKVSLDDFGTGFSSLSHLHSFPINIVKIDRTLMPNASSSEKVKQLLSGLVLMIKSLDLQIVAEGVETESDLNLCVKLGIGKIQGFYFDKPLSPFDLERKYL

SEQ ID NO: 14771 - protein, 422 aa, Azoarcus sp. BH72
MKHLILGNGPAGVVAAETLRRAAPQDEIVMVGSEDAPPYSRMAIPYLLEENIDERGTWLRKDPGHFDRLRIRELRGRAVSLDTDQRRVLFADGHFEDYDRLLIATGSHPVRPPIPGVDLPEVQTCWTLADARAIAAHARPGARVLQLGAGFIGCIIMEALAKRGVELTVVEMGDRMVPRMMTPQAGGMIKRWVENKGIRVVTNAGVSRIDRGTDGAPLQVTLTTGATLACDLVIVAAGVAPNVAFLEGTGVHVAKGVLVDARLETSVPGIFSAGDVAEAPDLFTGAHLVAAIQPNAADQARVAALNMAGRETTLNGVLAINVLDTLGLISTSFGQWWGEAADKGGSGVEHVDEARSRYLSLQFKDDVMIGATSIGLTEHVGALRGLIHGRVQLGEWKARLLQNPLAFVDAYIARSQPVALTH

SEQ ID NO: 14772 - protein, 335 aa, Thermococcus kodakarensis KOD1
MGKLDVIQAKGTERLKRGFAKMVKGGVIMDVTNAEQARIAEEAGAVSVMALHRVPADIRKAGGVARMAPIEKIQEIMDAVTIPVMAKVRIGHVAEAKILEALGVDMIDESEVLTPSDPFFHIDKREFTVPFVCGARNLGEAVRRIWEGAAMIRTKGEAGTGNIVEAVRHVRLVAEGIRQIQAMTDDQVYAVAEKFAEPYLRLSLNVKEIAGLPQRVLDNEPIYGHYTYREIVDGLYKILLEIKKLGRLPVVNFAAGGVATPADAALMMQMGMDGVFVGSGIFKSSNPPKMAKAIVEAVNHWDEPDVLVEISKEIGEPMRGQDIEELEVRLEERGV

SEQ ID NO: 14773 - protein, 115 aa, Oryza sativa
  misc_feature (51)..(51): Xaa can be any naturally occurring amino acid
  misc_feature (72)..(72): Xaa can be any naturally occurring amino acid
  misc_feature (96)..(96): Xaa can be any naturally occurring amino acid
MSPFNDLNGGAFLSEPAPQQTGIVIGKKKDEKKDEDLSDEDHALKEHLELXLLRVLYPDRGVHKFALESMRXRRLSATSSMTSVTKTIKFLRTKYXNSEGLFETIPESDVKKYMS

SEQ ID NO: 14774 - protein, 475 aa, Arabidopsis thaliana
MEANKKAKPSYGDVISNLPNDLLCRILSYLSTKEAALTSILSKRWSNLLLSIPILDFDDSVLLKPQKGQRKNVFFKAFVDRLLSQRVETSSHVQRVSLKCRQGGVEPDCVIKWILTTVRDLGVLDLSLCIDFGIFHLPFNVFRSKTLVKLRIGTMIRLSQFPSDVVSPTLNSLVLDLVEFRDGDKVEFRQILLAFPSLQSLRVHESNKWKFWNGSASSRTLKSLVYRSDDDSSAPKPCVSFDTPSLVYLDYSDMVADKYENLKFDSLVEARLDLHLTAFQIMRKPNNIGIVSGDVTTLFKGIRNVKILCLSPDALEALYYRGEKIPMFNNLITLSLGSDKPHGSPFIFWKLLPSLLNNSLKLETLIIKGLVHYVAEGWEGLSPMTPMSRLCFSWDTVSDSLSSSAMKVLEISGYKGTWQELNQMKRFLGNLSRLEVVRVYHKAMDDKERINVMFDLFLLPKVSSECDIQVMKETA

SEQ ID NO: 14775 - protein, 413 aa, Thermococcus kodakarensis KOD1
MIKKAVIPIGGDATRLRPLTIETSKGLVRLLNKPILEHSILSLAKDGIEEVYLGVRGYVNYTTLFDYFREGYWLQKKYGLEKEIRIRYMPRYESTTNGDAVWYTMEYYGIKEPVVVIQGDNIYQLNIQDMYKWHRKKNAFMTIALQPVEDVTGFGVAKIDDDYRIEYFVEKPRPEQAPSNLANTGIYILSENFWEFLNEGWAKEMKETRRLDFGGDIIPALIEHGYEVYGYPMEGYWFDVGTPERYLNAAMYLLRHLSPEDMEAVEITHDVYMQGKSEMSEDLRRKFREMIKTGKLIVEGKVLLGRHISIGKGTALEDAVIDNYTIVGRNCEILHSVVMDRVKLGDNVRIVNSIIGRHVEIGNNVRIVNSVIGDNAVIEDNVRMYNVKIWPHEFVERGATLEHYTVRTGVPRR

SEQ ID NO: 14776 - protein, 303 aa, Mycobacterium tuberculosis
GAMVTTVGFDVAARLGTLLTAMVTPFSGDGSLDTATAARLANHLVDQGCDGLVVSGTTGESPTTTDGEKIELLRAVLEAVGDRARVIAGAGTYDTAHSIRLAKACAAEGAHGLLVVTPYYSKPPQRGLQAHFTAVADATELPMLLYDIPGRSAVPIEPDTIRALASHPNIVGVKDAKADLHSGAQIMADTGLAYYSGDDALNLPWLAMGATGFISVIAHLAAGQLRELLSAFGSGDIATARKINIAVAPLCNAMSRLGGVTLSKAGLRLQGIDVGDPRLPQVAATPEQIDALAADMRAASVLR

SEQ ID NO: 14777 - protein, 518 aa, Solanum lycopersicum
MDALCAGTAQSVAICNQESTFWGQKISGRRLINKGFGVRWCKSFTTQQRGRGVTSAVLTRDINKEMLPFENSMFEEQPTADPKAVASVILGGGVGTRLFPLTSRRAKPAVPIGGCYRLIDVPMSNCINSGIRKIFILTQFNSFSLNRHLARTYNFGNGVGFGDGFVEVLAATQTPGDAGKMWFQGTADAVRQFIWVFENQKNKNVEHIIILSGDHLYRMNYMDFVQKHIDANADITVSCVPMDDGRASDFGLMKIDETGRIIQFAEKPKGPALKVMQVDTSILGLSEQEASNFPYIASMGVYVFKTDVLLKLLKSAYPSCNDFGSEIIPSAVKDHNVQAYLFNDYWEDIGTVKSFFDANLALTKQPPKFDFNDPKTPFYTSARFLPPTKVDKSRIVDAIISHGGFLRECNIQHSIVGVRSRLDYGVEFKDTMMMGADYYQTESEIASLLAEGKVPIGVGPNTKIQKCIIDKNAKIGKDVVILNKQGVEEADRSAEGFYIRSGITVIMKNATIKDGTVI

SEQ ID NO: 14778 - protein, 516 aa, Solanum lycopersicum
MSVATDVRFALLRNNPAALTGTNLKIVKFCNGELMGKKLKYTKFQLRSNVVKPHICMSLTTDIAGEAKLKDLEAKKEDARTVVAIILGGGGGTRLFPLTKRRAKPAVPIGGAYRLIDVPMSNCINSGINKVYILTQFNSASLNRHIARAYNFGNGVTFGDGYVEVLAATQTPGELGKRWFQGTADAVRQFHWLFEDARSKDIEDVLILSGDHLYRMDYLHFVQSHRQSGADITISSLPIDDSRASDFGLMKIDDTGRVMSFSEKPKGDDLKAMAVDTTVLGLSPEEAKEKPYIASMGVYVFKKDILLNLLRWRFPTVNDFGSEIIPASTKEFCVKAYYLFNDYWEDIGTIRSFFEANLALTEHPPRFSFYDATKPIYTSRRNLPPSAIDNSKIVDSIVSHGSFLTNCFVEHSVVGIRSRIGTNVHLKDTVMLGADYYETDAEIASQLAEGKVPLGIGENTRIKECIIDKNARIGKNVVIANSEGVQEADRSSEGFYIRSGITVILKNSTIPDGTVI

SEQ ID NO: 14779 - protein, 782 aa, Burkholderia sp. 383
MDRAGTGLAPVPGSENMKQTETQQQAAFDYHEFPTPGKISVVASKPLVTQRDLALAYTPGVAGVCEAIAADPLQAHRFTSRGNLVGVITNGTAVLGLGNIGPLASKPVMEGKAVLFKKFAGIDVFDIEINETDPDKLVDIIAGLEPTFGGINLEDIKAPECFTVEQKLRDRMKIPVFHDDQHGTAITVSAAFINGLKVVGKSISEVKVVTSGAGAAALACLDLLVDLGLPVENVWVTDIEGVVYRGRTALMDPAKSRFAQETDARKLAEVIGGADVFLGLSVGGILTADMLKAMAPRPLILALANPTPEIFPELAHATRDDVVIATGRSDYPNQVNNVLCFPYIFRGALDVGATTITREMEIAAVHAIAGLAEEEQNEVVAAAYGAYDVAFGAQYLIPKPFDPRLIVRIAPAVAKAAMEGGVAKRPLTDLDAYVEQLQQFVYHSGAFMKPLFATARRLVRDGGKARIVFTEGEDERVLRAVQVIVDEKLARPILVGRPEVLLARIERFGLRIRLGQDVEVTNPEYDERFPQYWTTYWELRCRDGISKEMARVEMRRRLTLIGAMMVRLGDADGMICGTVGEYHNHLRFVDEVIGKKPGASTYAAMNILLLDQRTVALVDTHVNDNPDAEQIAEFTIAAARQMEWLNLTPKAALLSRSNFGSGSAASGVKMRRALEIVREQAPDIEADGEMHGDCALDEGLRSRLLPMSPLKGAANLLVCPNVDAGNIAYNLLKTEAGSNVAVGPFLLGVNAPVNILTSSATVRRIVNMAALTVIEANRNASA

SEQ ID NO: 14780 - protein, 308 aa, Yersinia pestis CO92
METGKLVVLGSINADHILNIEQFPRPGETVIGQQYNVAFGGKGANQAVAAGRSGADIAFIACVGDDDIGERVRQQLTADKIDTQPIEAIKGATTGVALIFVNSDGENVIGINAGANSAVTPEYLRRYQQQVIDADALLMQLESPLDTVIAAAKLAKQHQTQVILNPAPARKLPDELLTLVDMITPNETEAERLTGIHIEQDDDAAKAAQILHDKGIATVIITLGSRGVWLSEQGKGKLVAGFKVNAVDTIAAGDTFNGALLTALLEGQSMDVAVRFAHAAAAIAVTRPGAQPSIPWRAEIDSFLQERV

SEQ ID NO: 14781 - protein, 662 aa, Colwellia psychrerythraea 34H
MSSRQELANAIRVLSMDAVQKAKSGHPGAPMGMADIAEVLWRDFLKHNPTDPNWADRDRFILSNGHGSMLIYSLLHLSGYDLSIEDLKEFRQLHSKTPGHPEYGYTPGVETTTGPLGAGIANAVGMAIAEKTLAAQFNREDHAIVDHFTYCFLGDGCLMEGISHESCSLAGTLGLGKLIAFWDDNGISIDGKVEGWFTDNTPARFESYGWHVICVDGHDPQAITHAIEEAKSVIDKPSMICCKTIIGFGSPNKSGTHDCHGAPLGDDEIAATREFLNWSHAPFDIPSDIYEQWDRKEKGQASQVSWNDKFAAYKAAHPGLASEYERRVIKGELPAEFEEKANAFIQQCHESSENIASRKASQNAIEAFGSVLPEMLGGSADLAGSNLTLWSGSKGIQEDAAGNYIFYGVREFGMSSIMNGISLHGGFVNYGATFMMFMEYARNAVRMSALMGIQNIFVYTHDSIGQGEDGPTHQPIEQLTNLRTTPNLTTWRPCDATESAVAWKAAVQSQKAPTALIFSRQGLPAMSRTQTQVSDIEKGAYILVDCAGTPDVILMATGSEVALAVNAATALTEQGKLVRVVSMPSTNVFDKQSSDYKEAILPFSVTKRVAIEAAHVDFWAKYVGLSGAVVGMTTFGESAPGNVLLEHFGFTVDNVVNTVNKL

SEQ ID NO: 14782 - protein, 216 aa, Brassica napus
MAIISEVEEESSSRPSMLPFRATFDSSNPLGFLQHAFDFLGEQSDYLKKPSAEEEIAAVVRAAKEKLNKAEKESVEKKPADPVEKKESVKPTMAASSSKPMEVEKPKENKEAGPIVPNKGNGTDLENYSWVQTLQEVTVNIPVPTGTKARSVVCEIKKNRLKLGLKGQDPIIDGELYRPVKPDDCYWNIEDQKMISILLTKQDQMEWWKCCVKGEP

SEQ ID NO: 14783 - protein, 559 aa, Leifsonia xyli subsp. xyli str. CTCB07
MSDTAQLLADARVWLEQDPDPETRRELEALLASAESGSAGAIADLRSRFGARLAFGTAGLRGEIAAGPNRMNRVLVAQAAAGFARWLRENAGDGTPSVVIGYDGRKNSAVFARDTAELMVGAGVRAVLLPRLLPTPVLAFAVRHLGTSAGVMVTASHNPRNDNGYKVYLGGKSHGSQIVSPTDAEIAAHILDVARGSVAELPRSDRYEVAGEEVERDYIAATAAVASASAPRDAVSFAYTAMHGVGWRTAREVFARAGFAAPAVVTAQRDPDPAFPTVAFPNPEEPGAMNLAFATAREAGADLVIANDPDADRLAVAIPDPASTDGYRRLSGNEVGALLGWRAAELTAEEGGTLACSIVSSPALAAVAEAYRLGFANTLTGFKWVSRAPGLIFGYEEALGYLVNPQTLRDKDGISAATALLDLASSLAAEGRTIADQLDAFAERFGFFASDQISLRVSDVSRIGEIMATLRATPPSTLGAVAVSRIDDLSDGLGDLPPNDVLRILLADGSRVMVRPSGTEPKLKIYIDASSDEGTLAERRSTAAARVAALADAMRALTA

SEQ ID NO: 14784 - protein, 590 aa, Coprinopsis cinerea okayama7#130
MVDLEDSDDDISEIQQEIASLAQCDSEYVTKYYGSFVVHYKLWIVMEYLAGGSCLDLLKAGPFSEAHIAVICRELLLGLDYLHAEGTIHRDIKAANVLLSSSGKVKLADFGVAAQLTNTLRHTFVGTPFWMAPEVIRQAGYDSKADMWSLGITAIEMAKGEPPLAEYHPMRVLFLIPKAKPPTLEGPFSAAFKDFVTLCLTKDPKLRPSANELLQHRFIRGAKKTSYLTELIERYQEWRMRSPHKGQNNAATIRNTATWDMNDTIRSDWNFDTVKSMGAMGTFRGSVKDLGMPTGMILEADESDDGETSIDTGAATKGSDPLLSNSQAAHSTVMIKNPPPHLAESDDIADDDIPNGAPPAYSGSVRSARRASYAERSSTDGPGTVLNEADLGTGVDTIRPVKKVDAAGSLRLSTGYLGSIRKEGSGSSYSTHKRSASEGARAGRAMVDEVVLPVLQRAIRDDMDAREIESLSMLQRGFEELKEANSELAYNVILDILQGINDNNAIKRHVQTSRGLFPHKRITRKSEMTSKGLVVTEETEEVSGLPESSNGVPPAQAEAETPRRSPIAELLYMRWLEGLRLKWPSIMTGS

SEQ ID NO: 14785 - protein, 474 aa, Emericella nidulans
MASTLRLSTSALRSSTLAGKPVVQSVAFNGLRCYSTGKTKSLKETFADKLPGELEKVKKLRKEHGNKVIGELTLDQAYGGARGVKCLVWEGSVLDSEEGIRFRGLTIPECQKLLPKAPGGEEPLPEGLFWLLLTGEVPSEQQVRDLSAEWAARSDLPKFIEELIDRVPSTLHPMAQFSLAVTALEHESAFAKATAKGINKKEYWHYTFEDSMDLIAKLPTIAAKIYRNVFKDGKVAPIQKDKDYSYNLANQLGFADNKDFVELMRLYLTIHSDHEGGNVSAHTTHLVGSALSSPMLSLAAGLNGLAGPLHGLANQEVLNWLTEMKKVVGNDLSDQSIKDYLWSTLNAGRVVPGYGHAVLRKTDPRYTSQREFALRKLPDDPMFKLVSQVYKIAPGVLTEHGKTKNPYPNVDAHSGVLLQYYGLTEANYYTVLFGVSRALGVLPQLIIDRAFGAPIERPKSFSTEAYAKLVGAKL

SEQ ID NO: 14786 - protein, 873 aa, Coprinopsis cinerea okayama7#130
MTLESRLDTRRNSVPSWVVNEGRRESAPSLFPPINHNPSLPPPISSNDPSSTHIPSFNHFSWANSSDRTSSRAPVNGNGTDHGTNRHVDTIGPLHPVPPFNFQPGRRIQDTSSSSQSTSGAPTSNSQEGTPQPTTQPSKPKESTTPYSRSPELRISHKLAERKRRKEMKELFDDLRDHLPSDRGMKASKWEILTKAIEYVSQLKTSQQSLMTEVENLRRENESLRQGTMAGFGAPGDLPESTMPPKNHSLSLLFHPKKNQNQKGPAQSQPKPRPKPPGAVEKKEEEDEDHLKLPDTPYSEYKLLSSSLKGWKYDVMKFDSRKPVDILRWTAPVKLNRKDLRREDRTAAAAKVPEAVRPMLGLDGKPVIGVDGKPVMVDAEGKPIHESGGTSSKDKGKANKRRFQKKTRQVFLVPDEVRQMQREERYPWVMEDSHPTHKEHWIGQLEDLSKAETHAFFMPAANDSFKFVPAHRWYKFQKKLNHDFPTATADVESAYTKAQKKDPQAWLATFHGGKGASASTMAIFKGEAEDQKPSGPVGPGGRKLKAVDRPPTSLLEDDEDPAVRRKRERELGEEGDLDEQLFEEDFADDEEMAAPDIDEEEAKELEERMKREYKLANKQRDAGVDEDEEDDEEEDLAKVKAKRRMEKMIRNREGNDAYESDDDENPYLSSAEEEEEEELPVPTGPAIQPQPQQVDQPNTPRPSTNKPAAPGSNSRTTSPATSPSLGGHSLVAKRATSPKVPKARVPGSQPGSRATSPNPGSRATSPLANGAQKRKAEDPGTPASQNGGPSAGGQPKLKKKKVAATASNAELEGLIIDWLRNTENPTTRGCIQHFNSYLVDAAKKKEFSEMVKRVAALKDGRLTLKPEFRSRNP

SEQ ID NO: 14787 - protein, 295 aa, Pseudomonas aeruginosa UCBPP-PA14
MKSFENKVAAITGAGSGIGRALAVELGRQGCHLALADVNAAALEETRQLLASSGVRVSTAVVDVADREQVQAWADKAASEHGRVNLIFNNAGVAHAGTVEGSDYSEYEWIMNINFWGVVNGTKAFLPHLKASGNGHVVNVSSVFGLFAQPGMSAYNATKYAVRGFTESLRQELDMEDSGVSASCVHPGGIKTNIAKTARMNESMAKVTGQAADKARQQFNDQLLRTTPEKAAQVILRGVQRDSRRILIGADAHAIDVMLRLAPVLYQRVVTASMRLAARFAPRPKSPQGAREASE

SEQ ID NO: 14788 - protein, 333 aa, Arabidopsis thaliana
MDEKDRPKNLREEEEKPSEETKILISSLPWEIDYLGNKLFNYEGYWYSEDILQSIPNIHTGFQPQETDIILASFYKSGTTWLKALTFALVQRSKHSLEDHQHPLLHHNPHEIVPNLELDLYLKSSKPDLTKFLSSSSSSPRLFSTHMSLDPLQVPLKENLCKIVYVCRNVKDVMVSVWYFRQSKKITRAEDYSLEAIFESFCNGVTLHGPFWDHALSYWRGSLEDPKHFLFMRYEDLKAEPRTQVKRLAEFLDCPFTKEEEDSGSVDKILELCSLSNLRSVEINKTRTSSRVDFKSYFRKGQVGDWKSYMTPEMVDKIDMIIEEKLKGSGLKF

SEQ ID NO: 14789 - protein, 858 aa, Coprinopsis cinerea okayama7#130
MSAEILKSEAPKDTSGVPHPTDDASPFSIPDIVLNGTEMTKISKKGKKRVVFRIDPDEGRLLYKSKKGGLVPIEAIKEMRSGEDARYYCNQFEQPEEAESRWITVIYILGGAYKTLHILADTRDAFHAWDTTLRKLHSVRQGLTTGLGNMETREEVWERQYWKGADEEGDQVLDFDDVDRLCKRLHANIPTPRLQQLFKEADTENKGHLDYPAFQRFVKKLKRRPDVEQIYGQIAGQSGGKFDFAAFEKFIKEVQKSPLSTDELRAVFDKYATSADSTSPNEPSGALTLDAFTKFLTSPDNAAFAEEGKPIWQDMTKPISEYFISSSHNTYLVGNQLTGVSTIEGYIRALLHSCRSVELDIYDGDDEPVIFHGKTLTSKVPLRDVCVAIMKYGFTTSPYPLLVSAEVHCGLAQQEKMVDVMTEVWGDALIQAPVNGRPQLTHLPSPEDLKHKILLKAKNLYVVEQLAKAKAKRAEEKAAVLEADPSSESTNESTDDDAGESKPGALGALKSRWRKMRGKDPKPAKPKVKMSFRLASLLVYTIGVKCHGLNDEVQYAPEHIFSLSEYSANKLLKVGMWDLIRHTQGHLVRIYPKGTRVNSTNFEPHRYWASGAQVVAINWQTFDLGYVMNQAMFQRNGRSGYILKPEALRSLDKDLFSKRTKHFLDITSHELIELIIAFMTYLLTNHLPPLNQIISAQQLPPLRDSKGNEVFGKSIPDPFVEVSLLIPDWTNSPFLPESAKAEGAEYHSPSEGNTTTATSARTVKMKTQVVTDNGFNPTWNEQLHLPFDCVGGMMDLIFVNVAVRQEGKEDEDDEPLAMYCIPLGSLNQGYRHLPLHDAQMNQHLFSTLFVNVAIRDAD

SEQ ID NO: 14790 - protein, 165 aa, Zymomonas mobilis subsp. mobilis ZM4
MIIVVMGVSGCGKSTVGADLAKHLHCDFQDADDFHPQANKDKMSNGIPLTDEDRWPWLRAIRDYMDKEKAAGHDVVFACSALKKVYRDLLNDKHDVHFVYLKGSEELISDRLAHRSSHFFNPKLLHSQFETLEEPTADEGVFVVDIRNDPDTIVDIVKKEMTSWK

SEQ ID NO: 14791 - protein, 615 aa, Cytophaga hutchinsonii ATCC 33406
MCGITGFISIKWGSDELHSMTRRLQHRGPDAEGFYINESVHLGHRRLSILDLSVAANQPFFSKDKRYVMVFNGEVFNYKELAVKYAIPTDTTSDTEVILELFALQGPAAFQEFNGMFAIAIWDTYEKKLTLLRDRFGIKPVCYYDGPDGFGFASEIKSLLELPIPRLINSEALADYLFLEYIPKPNTIFQNIKKLTNGCYLEVTDGVRVAVKAFYDIREKYDPKPLKEKEGLEEFHHLLSDAVKSRMISDVPIGAFLSGGVDSSLVVSKFQENSTLPVETFTIGFDEKQYDESAYAKKVSELLKTNHHEYRLPAEDVFSVLKDAIEFYDEPFAVSSVLPSLLISKVSRQHTTVALTGDGADELFMGYNTYYWYNRIETLKRIGGKASLKLAGNIFKMFGGKPAIKSRLFEGWADKHPYINLWSQEQQMFTQQEIGKLLNYRYTHETTIPYWESLEKISLNNEQAVSFFDIQHYLADDLMYKMDIASMRHGLEVRCPFLDYNLVEFAVNLPLELKINNGTQKYILKKALEKYIPQSLIYRTKWGFSAPSEEWLKRSHTYLIDHYLDPARISAQGIFNAQEIQKLIASFRSGHYYHGKRLWSLVIFQLWYEQYMVAK

SEQ ID NO: 14792 - protein, 215 aa, Zea mays
LNGNQCGDAESVDVGGQPNALNLALQKPEFALVTTDSGIVLLHNSKVISTTKVNYTITSSSVSPDGTEAVVGAQDGKLRIYSISGDTLTEEALLEKHRGAITSIHYSPDVSMFASADANREAVVWDRASREIKLKNMLYHTARINSLAWSPDSRLVATGSLDTCAIVYEIDKPVASRVTIKGAHLGGVHGLTFLENDTLVTAGEDACIRVWKVVE

SEQ ID NO: 14793 - protein, 222 aa, Mesembryanthemum crystallinum
WLVDSKGLIVSSRKNSLQEFKKPWAHEHEPLGDLSSAVKAIKPTVLIGSSGVGRTFTKEVIEAMASFNEKPLIMALSNPTTQSECTAEEAYTWSKGRAIFASGSPFNSVEYEGKTFVPGQSNNAYIFPGFGLGLVISGAIRVHEDMLLAASEALAGQVTQENYDKGMIYPPFSNIRKISAAIAANVAAKAYDLGLATRLPRPENLVKYAENCMYSPVYRSFR

SEQ ID NO: 14794 - protein, 216 aa, Yersinia pestis CO92
MTIRNYNYHMTHFVISAPDIRHLPRDEGIEVAFAGRSNAGKSSALNTLTNQKGLARTSKTPGRTQLINLFEVVDGVRLVDLPGYGYAEVPEEMKLKWQRALGEYLQKRNCLKGLVVLMDIRHPLKDLDQQMITWAVAVGTPVLLLLTKADKLASGARKAQLNLVREAIIPFMGDIQVEAFSSLKKIGVDKLREKLDTWFSEIPPEVMAEEFDGEGE

SEQ ID NO: 14795 - protein, 396 aa, Mesembryanthemum crystallinum
MLSRLISFLKACWRPSSDRSHSGSDAAGRQDGLLWYKDTGQHINGEFSMAVVQANNLLEDQSQIESGCLSLLDSGPYGTFVGVYDGHGGPETSRYINDHLFHHLKRFAAEQQSMSVDVIKKAFQATEEGFFSVVAKQWPMKPQIAAVGSCCLVGVVCNGILYIANLGDSRAVLGRAVKATGEVLAIQLSAEHNASIESVRQEMQATHPEDKDIVVLKHNVWRVKGLIQITRSIGDVYLKKTEYNREPLYSKFRLREPFKKPILSSDPAISVHELQPHDQVCIFASDGLWEHLTNQEAVDLVQKSPRNGSAKRLVKVALQEAAKKREMRYSDLKKIDRGVRRHFHDDITVVVVFLDSNLISRGSSVRGPTLSLRGGGIHLPAKTLAPCATPMEVGNS

SEQ ID NO: 14796 - protein, 418 aa, Mesembryanthemum crystallinum
QAETLLERGIHPIRIAEGYEVASRIAVEELERIAHKFEFGEEPLIQTCMTTLSSKIVNRCKRSLAEIAVKAVLAVADLERKDVNLDLIKVEGKVGGKLEDTELIYGILVDKDMSHPQMPKHIEDAKIAILTCPFEPPKPKTKHKVEIDTVEKFETLRKQEQQYFDDMVQKCKDVGATLVICQWGFDDEANHLLMNRNLPAVRWVGGVELELIAIATGGRIVPRFQELTPEKLGPAGLVREKSFGTTKDRMLYIEHCANSRAVTIFIRGGNKMMVEETKRSIHDALCVARNLIRNNSIVYGGGSAEIACSLAVEAAADRYPGVEQYAIRAFADALDSVPMALAENSGLTPIETLSAVKSQQVKENNPCCGIDCNDVGTNDMREQNVFETLIGKKQQLLLATQVVKMILKIDDVISPSEY

SEQ ID NO: 14797 - protein, 288 aa, Colwellia psychrerythraea 34H
MLSDFIKQHKLPEEFRLTVEEHYKPLADRIVRLFNKKSNAYFVGINGCQGSGKSTLTDFIAEYLIAQYQLNVVVMSLDDFYLSSTKRNQLADDIHPLLSTRGVPGTHDITALNRVLSQLSEHRTGFSIPKFNKAIDEPCPQSQWISVEKPVDIILLEGWCWGVTSQTDEQLQTPINDLELQHDAEGEWRSYVNQQLKTGYEPLYKKMDFWLALQAPSFDCVYQWRLEQEQKLQAKNIGLSHSKVMSPAEVLNFTHYFQRLTVHGSNTLSNSADAVFHLDNTRHIIDIP

SEQ ID NO: 14798 - protein, 323 aa, Oceanospirillum sp. MED92
MTNPDFLGSARRTIKLEAEAVSDLLDFLDDSFNQACKIMLNCSGRVIVTGMGKSGHIGKKIAATLASTGTPAFFVHPGEASHGDLGMITPNDVVIALSNSGETAEVVTIIPLLKRMNTPLISITANPASTLSSAGDANLHIGVEKEACPLDLAPTSSTTAQLVLGDALAIALLEAKGFSAEDFAFSHPGGSLGRRLLLKVSDIMHADQDIPKVLSGTPLKDALIEVTRKRLGMTTIVDQNNVLQGIFTDGDLRRALDQNVDLQTTSIDAVMTPDGTTVTAEMLAAECLQIMEQRKINALIVTDQDNHPVGALNMHDLLKAGVI

SEQ ID NO: 14799 - protein, 469 aa, Yersinia pestis CO92
MSAEHVLTMLNEHEVKFVDLRFTDTKGKEQHITIPAHQVNADFFEEGKMFDGSSIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHAFGKTATFMPKPMFGDNGSGMHCHMSLSKNGNNLFAGDKYGGLSEIALFYIGGIIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEAMAALNEDREFLTRGGVFTDDAIDAYIELRREEMDRVRMTPHPVEFELYYSV

SEQ ID NO: 14800 - protein, 448 aa, Streptococcus agalactiae NEM316
MTITAEDIRREVKEKNVTFLRLMFTDILGVMKNVEIPATDEQLDKVLSNKAMFDGSSIEGFVRINESDMYLYPDLDTWIVFPWGDENGAVAGLICDIYTAEGEPFAGDPRGNLKRNMKRMQEMGYKSFNLGPEPEFFLFKMDENGNPTLDVNDKGGYFDLAPTDLADNTRREIVNVLTQMGFEVEASHHEVAVGQHEIDFKYDDVLKACDNIQLFKLVVKTIARKHGLYATFMAKPKFGINGSGMHCNMSLFDNEGNNAFFDPEDPRGMQLSEDAYYFLGGLMEHAYNYTAIINPTVNSYKRLVPGYEAPVYIAWAGRNRSPLIRVPASRGMGTRLELRSVDPTANPYLALSVLLGSGLEGIENKIEAPEPIETNIYAMTVEERRQAGIVDLPSTLHNALKALEEDEVVKAALGTHIYTNFLDAKRIEWASYATYVSQWEIDNYLDLY

SEQ ID NO: 14801 - protein, 706 aa, Bradyrhizobium sp. BTAi1
MSALWVIVLCGALSIVYAIWATQSVLSADAGNARMQEIAAAVREGAQAYLRRQYTTIGIVGVVIFVLLAYFLGMLVAIGFAIGAILSGAAGFIGMNVSVRANVRTAQAAITSLAGGLELAFKAGAITGLLVAGLALLGVTIYFGILTGFMKLAPDSRTVIDALVALGFGASLISIFARLGGGIFTKGADVGGDLVGKVEAGIPEDDPRNPATIADNVGDNVGDCAGMAADLFETYAVTAVATMVLAAIFFAKSSLLANMMTLPLAIGGICIITSIAGTFFVKLGASQSIMGALYKGLIATGVLSLAGLAIAIAWLIGFGKLDGVDYTGTALFICGVVGLVVTGLIIWITEYYTGTDFRPVKSIAAASVTGHGTNVIQGLAISMEATALPAIVIIAGILVTYSLAGLFGIAIATTTMLALAGMIVALDAFGPVTDNAGGIAEMAGLPKEVRKSTDALDAVGNTTKAVTKGYAIGSAGLGALVLFAAYNQDLQFFIADSAHHPYFAGIKPDFSLNNPYVVVGLLFGGLLPYLFGAMGMTAVGRAAGAIVEEVRRQFREKPGIMQGTDKPDYGKAVDLLTKAAIKEMIIPSLLPVLSPIVVYFLIYAIAGGGAAGKSAAFSAVGAMLLGVIVTGLFVAISMTSGGGAWDNAKKYIEDGHFGGKGSDAHKAAVTGDTVGDPYKDTAGPAVNPMIKITNIVALLLLAILAH

SEQ ID NO: 14802 - protein, 398 aa, Streptococcus agalactiae NEM316
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGAKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQLGVKSIIGGGDSAAAAINLGRADKFSWISTGGGASMELLEGKVLPGLAALTEK

SEQ ID NO: 14803 - protein, 167 aa, Zea mays
MMMAEVAANHSKRSHNDGYFSAKAAVAAAAAASPPEELGSMPMSSKKPRPRNSNSPRTAPVSPKEKKDRIGERVAALQQLVSPFGKTDTASVLQEASGYIRFLHQQLQVLSSPYMRAPPAAGAAPEDPEHYSLRSRGLCLVPVDQTLQLTQSNGADLWAPANTTRRR

SEQ ID NO: 14804 - protein, 357 aa, Brassica napus
MAASASERPQFISSNGGNRSFSNAPLIDNSDPNQIIVPEKKSWKNFFAYLGPGFLVSIAYIDPGNFETDLQAGAQYKYELLWIILVASCAALVIQSLAANLGVVTGKHLAEHCRAEYSKVPNFLLWVVAEIAVVACDIPEVIGTAFALNMLFSIPVWIGVLLTGLSTLMLLALQQYGVRKLEFLIAFLVFTIALCFVIELHYSKPDPGEVLHGLFVPQLKGNGATGLAISLLGAMVMPHNLFLHSALVLSRKIPRSSTGIKEACRFYLIESGLALMIAFLINVSVISVSGAVCNAPDLTPEDRAKCEDLDLNKASFLLRNVVGKWSSKLFAIALLASGQSSTITGTYAGQYVMQGFL

SEQ ID NO: 14805 - protein, 211 aa, Pichia angusta
MSAIYRALKRDKDTSKPQSDNRESKVRQNRQRCLLISSRGVIQRHRHFINDLQSMLPQSRKEPKLDTKKNLFELNELAELHNCNNIMYFESRKHQDLYMWLSKTPNGPSIKFHIQNLHTMEELNFTGNCLKGSRPILSFDRAFDSDIHLKILKEMFIHQFGVPPRARKSKPFIDHLMTFAILDGKIWIRNYQISEPVGAEAAEANLEEMKL

SEQ ID NO: 14806 - protein, 287 aa, Pichia angusta
MEVCITTQSIDNGVGAASMFACLFTHPLDLAKVRLQTAKVPGDSLVSLAYKIVKTEGVLAAYAGLSASLLRQATYSTARFGVYEKLKGIMTDPTKGQASTFQLLAASMIAGAVGGVVGNPADVVNIRMQNDNSLPESQRRHYKHALDGLLKITREENITALFRGLGPNLARGILMTASQVVSYDVAKKLLVENLSMDPKTKATHFSASLIAGLVATTVCSPADVLKTRIMNSSGTGQSSFGILKDAISREGLGFMFRGWTPAFIRLGPHTILTFIALEELRRLKIGL

SEQ ID NO: 14807 - protein, 481 aa, Exiguobacterium sibiricum 255-15
MKMIYDAQEARQIDEWAKTSGLPLEVLMERAGSEIAKRIKNRHTREERILVMCGTGNNGGDGYVIGRELVRDGYDVTMHAPFGEVKTATAHLHQHYAENFGLATEAVCGQYDVIVDGIFGTGFDGSRLTKSIHDVFDWVREQKQQGAKLYAIDIPSGIPSDQTNGFSGQAIRADVTFSLHAFKRSAFLLKTAPFFGKLEKIDLGLPAFGGWQLMSESIAPLLTRDPYGHKGTYGTALLIGGSETMPGSIQLAARAALRSGVGKLQVATVPTAQVGLIMNAPEAMVLNQTTTAIQEMLDQVNVAGIGPGLTSDSISDWIELLFAQDIPVVLDAGALIRDSYPERKAEIVVTPHIGEFARMTKRTVREIQDDLFGQASEYAVLHQVIVVLKAHVILIATPEGGGYVINGASSGLAKGGSGDTLFGILTSLLGQKEYFKHIPVEQLIALGASWYAQASKQVEQQLHPSSIVATDVIDQLGRVKN

SEQ ID NO: 14808 - protein, 550 aa, Aspergillus nidulans FGSC A4
MGRYPLKSYFAPSKLFFYTWFWGAHIAIFAYGWYHQAKSEPLSPLNVLSYSVWISRGAGLVLTVDGTLILLPMCRNLVRFLRPKLRWLPLDENIWFHRQVAYATLVFTILHVAAHYVNFYNIERKQLRPETALQIHYAQPAGVTGHVMLFCMMLMYTTAHHRIRQQSFETFWYTHHLFIPFLLGLYTHATGCFVRDSAEPYSPFAGERFWKHCIGYQGWRWELVAGFFYLCERLWREIRALRETEIVKVVRHPYDAMEIQFRKPGFKYKPGQWLFIQVPEVSNTQWHPFTITSCPFDDYVSIHVRQVGDFTRALGDALGCGPAQARDLEGLDPMGMYEVALQNGQQMPKLRVDGPYGAPAEDVFENEIAVLIGTGIGVTPWASILKNIWHLRASPDPPRRLRRVEFIWVCKDTTSFEWFQALLSSLEAQSASDAAYQGVSEFLRIHIYLTQRLDQDTTTNIYLNSVGQELDPLTELKSRTNFGRPDFKRLFTAMRNGLQDQSYMRGLHTHSRTEIGVYFCGPNVAARQIKAAASSASTNEVKFKFWKEHF

SEQ ID NO: 14809 - protein, 421 aa, Zymomonas mobilis subsp. mobilis ZM4
MIPFSLKNGTLCVEDIPLPEIAAQYGTPCYVYSHSYLTERARRFTKALDGAGKGKSLVAFAVKANPSQAILASFAKEGLGADVVSAGEIRRAVHAGIPPERIVFSGVGKTAEEMRYALEIGIGQFNIESVSEIEMLAEVATSLGKKAAVALRINPDVDPHTHAKIATGKADTKFGIAAEDALSAYEKLASYPSLKIQGIASHIGSQITDLAPFEAAAERIYEIITALEKAGHAIETADLGGGLGVRYKDDQPEPPSVEAYGEMIKRVTKGWNCRLIFEPGRSLIANAGVLLSKVIRIKESKTARFVILDAAMNDLVRPTLYDAYHEIKAVTPSAQTYQADIVGPVCETGDIFARNRSISAVKADDLMAIMSAGAYGATMASAYNSRPLVAEVMVSGNKSALIRKRQSVEDLMRDEQKVEWL

SEQ ID NO: 14810 - protein, 534 aa, Coprinopsis cinerea okayama7#130
MAASTSQKLPKDFIWGFATAAFQIEGSADVDGRGKSIWDDFAKLPGKTLDGKNGDVATDSYRLWKEDIALLAEYGVRSYRFSISWSRIIPLGGRNDPINPKGIEFYSNFIDELLKHNIIPFVTLFHWDLPQGLQDRYKGWLNKDEVSKDFERYARVCFENFGDRVKHWLTINEPWCCAILGHGRGVFAPGRSSDRERNPEGDSSTEPWIAGHSIIYAHALAVKAYREDFKPTQKGEIGITLNGDWAMPYDDNPENVAAAQHALDFAIGWYADPVYLGYYPPYMREVLGDRMPDFTEEEWKVVKGSSDFYGMNTYTTNLCRAGGDDEFQGLVDYTFTRPDGTQLGTQAQSSWLQDYPDGFRALLNYLYKKYKLPIYVTENGFSVKGESDMTIEEACKDKDRVHYFQGTTKALLDAINIDGVDIRSYFPWSFLDNFEWADGYTTRFGVTYVDYDTQKRYPKDSAKFLVQWFKDHEHQETAAKADDKPTTAVADATKVVANGSVSKKENGAAEGKRRSGVRASVSKYLSALLALIKS

SEQ ID NO: 14811 - protein, 520 aa, Saccharomyces cerevisiae
MLSRTRAAAPNSRIFTRSLLRLYSQAPLRVPITLPNGFTYEQPTGLFINGEFVASKQKKTFDVINPSNEEKITTVYKAMEDDVDEAVAAAKKAFETKWSIVEPEVRAKALFNLADLVEKHQETLAAIESMDNGKSLFCARGDVALVSKYLRSCGGWADKIYGNVIDTGKNHFTYSIKEPLGVCGQIIPWNFPLLMWSWKIGPALATGNTVVLKPAETTPLSALFASQLCQEAGIPAGVVNILPGSGRVVGERLSAHPDVKKIAFTGSTATGRHIMKVAADTVKKVTLELGGKSPNIVFADADLDKAVKNIAFGIFYNSGEVCCAGSRIYIQDTVYEEVLQKLKDYTESLKVGDPFDEEVFQGAQTSDKQLHKILDYVDVAKSEGARLVTGGARHGSKGYFVKPTVFADVKGDMRIVKEEVFGPIVTVSKFSTVDEVIAMANDSQYGLAAGIHTNDINKAVDVSKRVKAGTVWINTYNNFHQNVPFGGFGQSGIGREMGEAALSNYTQTKSVRIAIDKPIR

SEQ ID NO: 14812 - protein, 406 aa, Candida albicans SC5314
MCKVVSVFENIPPVFFPNLYKNEIKFSFSVFFFFHQLMTATPVYFDISCNGKPKGRVVFKLYDDVVPKTAANFRSLCTGDKGISPKSGKPLSYKDSIFHRVIKDFMCQGGDFTAPSDHLGTGGESIYGEKFEDENFKLNHNKPFLLSMANSGPNTNGSQFFITTVPTPHLDGKHVVFGEVIEGKSIVRQLERSEKGANDRPVEDWKIADCGELPANYEPVASGADDGTGDTYEEILTDNDTIDINNPQSVFAAVSKIKDIGTKLLKEGKLEKSYEKYTKANSYLNDYFPEGLSPEDLSTLHGLKLSCYLNAALVALKLKHGKDAIAAANNALEVEQIDDKSKTKALYRKGMGYILVKDEEQAQKILEEALELEPNDAAIQKGLQEAKHNIKLRRDKQKKAMAKFFS

SEQ ID NO: 14813 - protein, 493 aa, Pseudomonas syringae pv. phaseolicola 1448A
MSLTRFQMCIDGQWVDALSGKTFDSLNPALAEPWAQLPDADEADVERAVQSAQKAFEGPAWRGLTATARGKLLRKLGDLIAENKENLAQLESRDNGKLIRETRGQVSYLPEFFHYTAGLADKLEGGTLPLDKPDLFAYTVHEPMGVVAGIIPWNSPLYLTAIKLAPALAAGNTIVLKPSEHASATVLELARLALEAGIPPGVVNVITGYGPTTGAALTRHPLVRKIAFTGGAATARQVVCSSAENFAKLSLELGGKSPNIIFADADLDSAINGAVAGIYAASGQSCVSGSRLLVQDEIYDEFIERLAERASRIRIGNPQDETTEMGPMATAQQLAVVEGLVADALAEGARLRLGGKRPRLDSKGWFYEPTLFECDRNSMKIMQEEVFGPVASVIRFKDEAEALAIANDSQFGLAAGIWTRDLGRAHRLARDIRSGIIWVNTYRAVSAMAPIGGFKNSGYGRESGIDSVLAYTELKTVWINLSQAPMPDPFVMR

SEQ ID NO: 14814 - protein, 433 aa, Lophopyrum elongatum
MQCFRFASWEKEREEELQGPARSQSALSNSSMSTDRDARRSGSECCSLTVSSEISVDSFGRYRQLSLPHRPNNDLRIFTFQELKSATRSFSRALMIGEGGFGCVYRGTIQSTLEPRRSLDVAIKQLGRKGLQGHKEWVTEVNFLGVVDHPNLVKLIGYCAEDDERGIQLLLVYEFMPHGSLADHLSTRSPKPASWAMRLRVALDTARGLKYLHEDSEFKIIFRDLKPSNILLDENWNAKLSDFGLARLGPQEGSHVSTAVVGTIGYAAPEYIHTGRLSSKNDIWSYGVVLYELLTGRRPLDRNRPRGEQNLVEWVKPYSSDTKKFETIMDPRLEGNYNLKSAARIASLANKCLVRHARYRPKMSEVLEMVQKIVDSSDLGTPERPLISHSKKLASDEKKRKGLNLKRRIADIKAGDGRWFRWHKWTPKLVRTQ

SEQ ID NO: 14815 - protein, 284 aa, Zea mays
MAAAASGGDTPKQLLSIIRDFAYEKSHGERRVSDLRRRLADARAAADVAAAELDAAKRAREAAEQEFRGSQVQDAIAADSILALEATISCLHEEISKASTDLDALKNIPYVLSCTKYCFSLLVMVILSPHCCREDFISKMYDMNAKIRQFQQMVSLELAEYNHCELPSTDERNFKIAQFGVVFVLMNIICVVKLCEHVKDKSKTVDSEGISEELSDKVSNIEAEVQLLEEEYKKDLLYHDKVRQELAEVQAKRALMEAVMEETKQLQELGEYPEHTELSVPMHF

SEQ ID NO: 14816 - protein, 177 aa, Thermococcus kodakarensis KOD1
MRRTTKETDIEVELDVEGTVETGDPVLNHLLMALFHYMGRNARVKANYDLRHHLWEDVGITLGLELREKLPGKFARFGSAVMPMDDALILVALDISGRPYLNLELFPLEEEEGFSVTLVREFLWGLARSLRATIHVKQLGGVNAHHIIEAAFKGLGIALAQAIAESERLESTKGVLE

SEQ ID NO: 14817 - protein, 130 aa, Oryza sativa
MYAAMYPETFGFSAYPQQQQPPPDAASCIYTTALPLIADPPDILNLGASTPRPGNSGNAQLASCERLVTISDLKSEERKQKLSRYRKKKVKRNFGRKIKYACRKALADSQPRVRGRFAKIEEGDLLKPRK

SEQ ID NO: 14818 - protein, 209 aa, Thermococcus kodakarensis KOD1
MSIEELVEKVDWEKNGGVVPVVVQDTEGEVLTLAYMDREALRRTLETGYAHYYSRSQGRVRMKGEVSGNLQVVREIRVDCDSDALLLKVEPKGPACHTGNYSCFYRKLGEPERVLPMDYSLTILRELEELIRKRKESPVEGSYTSRLFREGRERIYKKFGEEAVEVLVAENREALIYETADMLYHLLVLLAYNDVSLGEVMAELRRRRK

SEQ ID NO: 14819 - protein, 460 aa, Bradyrhizobium sp. BTAi1
MDAKPSDLSPVHAMASTSDGHARGGWRGERGDPSLGNMFASVRTSAKGSLWRKLVAFLGPGYLVAVGYMDPGNWATSLAGGSKFGYVLLSVALLSNIMAIVLQSLCTRLGVGTGRDLAQACRDSTPRWVSVPLWLSAEIAITATDLAEVIGTAIGLSLLFGLPLSIGVCVTALDVFLILALQAFGFRWIEAFVVALLGIIALCFAIQIAMAQPDWAQVIKGFVPSGQLLANPEMLYLALGILGATVMPHNLYLHSGLVQTRGYGDSLKEKREAITLSTIDSTIALCLALTINASILILAAATFHRTGQHDVAELDQAHSFLAPLLGSTLAPTLFAIALLCCGLNSTITATLSGQIVMEGFLHWRIAPWLRRLITRMIAIVPAVVVTIWAGEKATGQLLILSQVVLSLQLPFAVVPLVLITASRAKMGPFVAPRWLTAIATVIAIAIIGLNAKLVWDLATG

SEQ ID NO: 14820 - protein, 502 aa, Zea mays
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFAMDLLHRSARTWSADFRASVGAMLDAVDAEFGKDDGSDKKPSASYLVPLQQCIFRFLCKAFVGADPSADWLVDNFGFTILDIWLALQILPTQKIGLVQPLEELLIHSFPLPSFLIWPGYYVLYRFIEKHGAEAVAYAEAQHGIGKKDAINNILFVLGFNAFGGFSVFLPFLVAKVGGAPALRERLRDEVRRAMVGKDGEFGFATVREGMPLVRSTVYEMLRMQPPVPLQFGRARRDFVLRSHGGAAYQVSAGEVLCGYQPLAMRDPEVFERPEEFVPERFLGDEGARLLQHLFWSNGPETAQPGPGNKQCAAKEVVVDTACMLLAELFRRYDDFEVEGTSFTKLVKRQASPSVAQAAAAAGAQQ

SEQ ID NO: 14821 - protein, 141 aa, Brassica napus
KTLELLVQRSLEATVDAVLAGRLPNVEIRKINSHGVEVIVEKKEPSVDVVTLDKKHEAETLDVLKLTEDETISEVLPAKEITEAESSEHETPMYLYVYGIAESTVLQAIKTLEMEIAVEITDNISEAEALLALQSKITKNP

SEQ ID NO: 14822 - protein, 467 aa, Bacillus anthracis str. Ames
MKSLLRKKALSTESPRQLQRTLTALDLTFLGIGAVIGTGIFVLTGIVAAKHSGPGIMLSFLIAAFTCACVAFCYAEFASSIPVSGSVYTYAYMTVGEVVAFIVGWCLMLEYLLAVAAVAVGWSGYLQSLLQGFNIHLPAIIASAPGVGKGGLIDLPAVCILLIITVLLSFGIRESARINNIMVLIKLAVIIAFIVAGAKYVKPENWTPFIPFGYDGIITGAATVFFAFLGFDAIATAAEETKKPQRDLPIGIIGSLLICTVLYMIVSFVLTGMVPYTQLDVSDPVAFALHFVGEDTIAGLLAVGAMTGMTTVLLVVMYGQVRVSYAMSRDGLLPKALARVNKRVKIPLLNTWITGVVAALLAGLLDLHVLANLVNIGTLTAFTFVCCAVLILRKTHPDLKRGFRTPFVPVLPVVAILCCLYLMINLSKTTWISFAIWLIVGLCFYFFYSRKHSHLATEKTNDEQKKA

SEQ ID NO: 14823 - protein, 416 aa, Triticum aestivum
  misc_feature (96)..(96): Xaa can be any naturally occurring amino acid
  misc_feature (265)..(265): Xaa can be any naturally occurring amino acid
MGSSHRHLMRLLDDPFFPFPPPPPTSSLSLTSCPFLPPPPPSPFAFPHHPDLLDLYLPADPFFAPPLIPSPHAFLLHDLTDRVAALELTLAARAAXAAPQPARRKYTYAATEPGGRKVKWTAEEKPRGGGRALKWEAELASPNDDGFDRKWRWEAKSKGGARGKTKTKWGTEIKGKGSLEPWSHAYTWEEDFTASDDDEDELEVEERRPEKPKKIKAAAKDKEVDKKKKKPARTCVQIEEIPEDNTAGCDAIRKAFAMGNGKGKXKELSPQDAALLIQMNYRPHLAHRSQVLRCLRDLAVAKAKLKELRSLFYNLSYRRRLSHDHEECQRFSEKIIVLLLTVDALEGPDFMVRTAKKSMLEELESMLEIVDPQPPGKQRSFSRRKFDLPEGGAIPNEKTAGVNNAVRVINTGKGKQ

SEQ ID NO: 14824 - protein, 85 aa, Glycine max
NERKVETLGHGNMNIAQSPLERPNIINGRTQKERHQKLAIYMNKRNHRNFGRKIKNDCTKALADSHSGIRGKYARTEESACHTRN

SEQ ID NO: 14825 - protein, 396 aa, Bacillus licheniformis ATCC 14580
MKFEHSDVLKQLPEQFFASLVKKVNEKIAAGHDVINLGQGNPDQPTPEHIVDTMAQAVRNPENHRYSSFRGSRSLKEAAAAFYQREYGVELDPEREVAVLFGGKAGLVELPQCLLNPGDTVLVPDPGYPDYWSGVELARANMETMPLTADNQFLPDYSRIPKEVKEKAKLMYLNYPNNPTGAQATSAFFEETVRFAKSNGICVVHDFAYGAIGYDGKRPVSFLETAGAKDAGIEIYTLSKTYNMAGWRVGFAVGNASVIEALNLYQDHMYVSLFKAVQDAAAAALLSDQACVQEQNERYEKRRNAWIRAVRDIGWHADAPQGSFFAWMPVPDGYTSEAFSDLLLEKANVVTAPGIGFGKHGEGYVRVGLLTSEERLREAASRIAELNIFKKTGHSH

SEQ ID NO: 14826 - protein, 90 aa, Prosthecochloris aestuarii DSM 271
MNIYIGNLDYGVTEEDLREAFGEFGDVSSANIITDKFTGRSKGFGFVEMSSSDDANEAIESLNDTDLNGRTIKVNEAKPRAERPARRYQY

SEQ ID NO: 14827 - protein, 417 aa, Malus micromalus
MAAKESNSAAAAASSDGKIKRMLTHGGRYAQYNVFGNLFEVSSKYVPPIRPIGRGAYGIVCAAVNAEAREEVAIKKIGNAFDNRIDAKRTLREIKLLRHMDHENVIATKDIIRPPQKENFNDVYIVYELMDTDLHQIIRSNQPLNDDHCRYFLYQLLRGLKYVHSAGVLHRDLKPSNLFMNANCDLKIGDFGLARTTSETDFMTEYVVTRWYRAPELLLNCSEYTAAIDIWSVCCILGEIMTRKPLFPGKDYVHQLRLITELLGSPDDSSLGFLRSDNARRYVRELPQYPKRSFSLGFPNMSPSSIDLLEKMLIFDPNRRITVDEALSHPYLAPLHDINEEPVCPMPFNFDFEQPSFTEENIKELIWRESVRFNPESHFSMDHDIICCILLQTNLKTDCNDMFVDTVIVECVKGVDS

SEQ ID NO: 14828 - protein, 408 aa, Xanthomonas campestris pv. vesicatoria str. 85-10
MSTAADSPLSLAHYYLPVYRPRQVVLERGQGSRVWDDAGREYLDLSSGIAVSGLGHNDPDLVAALTEQAGKLWHTSNVFFSAPPLKLAEELVSASRFAHKVFLCNSGTEANEAAIKLVRKWASSQGRPADKRVIVTFRGSFHGRTLASVTATAQPKYQEGYEPLPGGFRYVDFNDVAALEAAMAGGDVAAVMVEPIQGEGGVMPAAPGFLSRVRALCDQHDALLVLDEIQCGMGRTGTLFAHWQEQVTPDIVTLAKALGGGFPIGAMLAGPKVAETMQFGAHGTTFGGNPLAAAVARVALRKLASPQIADNVVRQSAALRAGLEALNADFGLFAQIRGRGLMLGAVLAPAHAGQAGAILDLAATHGLLLLQAGPDVLRFVPALNLTDAELADGLARLRLAIAEYVAQA

SEQ ID NO: 14829 - protein, 409 aa, Mycobacterium smegmatis str. MC2 155
MTAASTFVIIGGGLAGAKAAEALRDNDFDGQVLLFAAEEKLPYERPPLSKDYLAGKKTLDEFTVAAPAWYRDHDVTLRLGTEVAAINPADHTVTLPDGSAVGYDKLLLATGSASRRLPIPGADASGVHYLRTVDDAAALDAVLTEGASLAVVGAGWIGLEVAASARTRGVNVTVVEAARLPLLGALGAEVAEVFAQLHREHGVDLRLEQTVEEITTADGRATGLRLGDGSTIAADAVLVAVGAAPNIGLAERAGLATADGGVLVDASLRTSDPDIYAVGDIAAAQHPLFGVRIRTEHWANALKQPAVAVAGMLGRPAEYAELPYFFTDQYDLGMEYAGHAPSYERVVFRGDVPGREFVSFWLDGDNRVLAGMNVNIWDVLDDVKALIRSREPVDPDLLADPGRPLNAPG

SEQ ID NO: 14830 - protein, 507 aa, Glycine max
MCGVSLLAFLLLLSLCAEASVHDYRGEKFAAKGNAFVVHGGSEGIYASAPNLTDAYPPPNPDSYIRFERITFRRNKELSNFSSWPIQAVVFEVEDRETIGGSAYGGQRAVCCTGDLAKLGVCAEGQVIYRPSVENPDWPQVFGVSFEMDDEVAVLPLKSIQITKTGMYNLYFIHCDTRLKELVVEGKTVWKNPSGYLPGRMAPMKVFYQFMSFAYVLLGIFWFSQYARFWKEVFPLQNCITAVITLGMFEMALWYFDYAEFSETGIRPTGTTIWAVTFGTVKRTFARLVILLVSMGYGVVRPTLGGLTSKVVMLGGTFFIASEVLELVENVGAVSDLSGKAKLFLVLPAAVLDVFFILWIFTSLSATLTKLQTRRMMIKLDIYRKFTNALAAAVLVSVGWICYELYFKSNDVYNEQWQNAWIIPAFWQVLSYSLLCVICILWAPSQSATRYAYRDDGSDEFDRDETTLTLIKPSPISSKDVRSVPDARPVQSSNGNSNDDLEEDKRE

SEQ ID NO: 14831 - protein, 92 aa, Oryza sativa
  misc_feature (45)..(45): Xaa can be any naturally occurring amino acid
MGFWVTTLIFLLAGFVASLFSLLCCNRGPSTNLKEKRGINDIEYXFHLTLVITATVCCWMMWAIVYLAQLKPLINPILSGELSWKLNTPLIF

SEQ ID NO: 14832 - protein, 720 aa, Mycobacterium sp. KMS
MVTPGSGPTSPTLHTVWPGEAYPLGATYDGAGTNFSLFSEVAERVELCLIAKDGSEERINLDEVDGYVWHAYLPTVTPGQRYGFRVHGPWDPSAGHRCDPSKLLLDPYGKSFYGDFRFGQALYSYDLDAEDLASGGDPPRIDSRGHTMTSVVINPFFQWGSDRAPRTPYHDTVIYEAHVKGMTRRHPAVPAELRGTYAGLCHPAIIDHLKSLNVTAIELMPVHQFMHDHRLLDLGLRNYWGYNTFGFFAPHNEYAANQHAGGAVAEFKAMVRSFHAAGIEVILDVVYNHTAEGNHLGPTVNFRGIDNAAYYRLLDGDLRLYKDFTGTGNSLNARHPHTLQLIMDSLRYWVLEMHVDGFRFDLASTLAREFYDVDRLSAFFDLVQQDPVVSQVKLIAEPWDIGEGGYQVGNFPGLWTEWNGQYRDTVRDYWRGEPATLGEFASRLTGSSDLYEATGRRPSASINFVTCHDGFTMHDLVSYNEKHNEANGEDNRDGESHNRSWNCGVEGPTDDPDVIALRGKQMRNMLATLMCSQGTPMIAHGDEIGRTQQGNNNVYCQDSELSWMDWSLCETNADLLEFTRKVVAFRKNHPVFRRRRFFEGKPIRSADQVRDIAWLTPAGTEMTPEDWGTGLGKCVAVFLNGEAIPAPNARGERVVDDSFLLCFNAHDHVQDFVTPDGDYAEMWTADLDTADPTGHTDVVVPAGEKISLQPRSLLVLRKTA

SEQ ID NO: 14833 - protein, 448 aa, Borago officinalis
MAAQIKKYITSDELKNHDKPGDLWISIQGKAYDVSDWVKDHPGGSFPLKSLAGQEVTDAFVAFHPASTWKNLDKFFTGYYLKDYSVSEVSKDYRKLVFEFSKMGLYDKKGHIMFATLCFIAMLFAMSVYGVLFCEGVLVHLFSGCLMGFLWIQSGWIGHDAGHYMVVSDSRLNKFMGIFAANCLSGISIGWWKWNHNAHHIACNSLEYDPDLQYIPFLVVSSKFFGSLTSHFYEKRLTFDSLSRFFVSYQHWTFYPIMCAARLNMYVQSLIMLLTKRNVSYRAHELLGCLVFSIWYPLLVSCLPNWGERIMFVIASLSVTGMQQVQFSLNHFSSSVYVGKPKGNNWFEKQTDGTLDISCPPWMDWFHGGLQFQIEHHLFPKMPRCNLRKISPYVIELCKKHNLPYNYASFSKANEMTLRTLRNTALQARDITKPLPKNLVWEALHTHG

SEQ ID NO: 14834 - protein, 172 aa, Triticum aestivum
RVRDGIRKTQQTHSTVSPLAGRLFVVIGAGGAGKALAYGAKEKGARVVIANRTFARAQELGNLIGGPALTLTELENYHPEEGMILANTTAIGMHPNVNETPLSKQALKSYAVVFDAVYTPKETRLLREAAECGATVVSGLEMFIRQAMGQFEHFTGMPAPDSLMRDIVLRKT

SEQ ID NO: 14835 - protein, 203 aa, Poa pratensis
MNPEYDYLFKLLLIGDSGVGKSCLLLRFADDSYLESYISTIGVDFKIRTVEQDGKTMKLQIWDTAGQERFRTITSSYYRGAHGIIIVYDVTDQDSFNNVKQWLNEIDRYASDNVNKLLVGNKCDLTDKKVVSYETAKAFADEIGIPFMETSAKNALNVEQAFMAMSASIKDRMASQPAANNARPATVQIRGQPVEQKTSCCSS

SEQ ID NO: 14836 - protein, 203 aa, Poa pratensis
MNPEYDYLFKLLLIGDSGVGKSCLLLRFADDSYLESYISTIGVDFKIRTVEQDGKTMKLQIWDTAGQERFRTITSSYYRGAHGIIIVYDVTDQDSFNNVKQWLNEIDRYASDNVNKLLVGNKCDLTDKKVVSYETAKAFADEIGIPFMETSLKNALNVGQAFMAMSASIKDRMASQPAANNARPATVQIRGQPVEQKGSCCSS

SEQ ID NO: 14837 - protein, 82 aa, Brassica napus
MCPLRFLLVFFSAVLAGYFAWKTVSSSPEIISEDDDGSPVELNEKQGLCFKKMEKGFWVFVDMASGKYLWRNLKLMSEKGSK

SEQ ID NO: 14838 - protein, 486 aa, Oryza sativa (japonica cultivar-group)
MASYDKAIESYKRAVTTAASLAASAMLVRGVVNELVPYEVRDLLFSGVGYLRSRMSSQHMVIIEETEGWTNNQLYDAVRTYLATRINTDMQRLRVSRVDETKSMMFSMEEGEEMADVHEGSEFRWRLVCRDNSSSSNGNGNGRGGNGNYRLEVRSFEMSFHKKHKDKALNSYLPHILATAKKIKDQDRTLKIYMNEGESWFAIDLHHPSTFTTLAMDHKQKQSVMDDLERFIKRKEYYKKIGKAWKRGYLLYGPPGTGKSSLIAAMANYLKFDVYDLELTEVNWNSTLRRLLIGMTNRSILVIEDIDCTLELQQREEGQESSKSNPSEDKVTLSGLLNFVDGLWSTSGEERIIVFTTNYKERLDPALLRPGRMDMHVHMGYCCPESFRILASNYHSIDNHATYPEIEELIKEVMVTPAEVAEVLMRNDDTDVALEGLIQFLKRKKDVGKEGKAENVEQVVKAEETEKGMMKKNDVPENQDPQDASK

SEQ ID NO: 14839 - protein, 462 aa, Bacillus cereus ATCC 10987
MTFSKSTTDKPSYTYEELSEKNKAYVWHPFTQMKDYLEEDPVIIERGEGRKLYDVNGNEYWDGVSSIWLNVHGHQVPELDEAIREQLNKISHSTMLGLANVPSILLAEKIIEVVPEGLKKVFYSDSGSSAVEIAIKMAFQYWQHKGKPKKQRFVTLKEAYHGDTIGAVSVGAIDLFHQVYSSLLFEAIKMPYPYTYRSPYGNNKEEIVKKHLEEMEELLKDKHEEIAAIIVEPLMQGAGGMITMPKGYLKGLRNLCTKYNVLFITDEVATGFGRTGKMFACEHENVTPDILTAGKGLTGGYLPVAITVTTDEIYNAFLGGYEEQKTFFHGHSYTGNPLGCAVAIANLELYEKTNLIEEVARKTEYVATQLEDLFAYKHVGDIRQCGLMVGIELVKNKETKEAFEWTERVGVQVCKRSRELGMILRPLGNTIVFMPPLASTIDEIDDMLRILYKAISDVTEGE

SEQ ID NO: 14840 - protein, 464 aa, Saccharomyces cerevisiae
MGQILSNPVIDKESHSGADSLTAFGLCAMQGWRMSMEDSHILEPNVLTKSDKDHIAFYGIFDGHGGAKVAEYCGNKIVEILQEQKSFHEGNLPRALIDTFINTDVKLLQDPVMKEDHSGCTATSILVSKSQNLLVCGNAGDSRTVLATDGNAKALSYDHKPTLASEKSRIVAADGFVEMDRVNGNLALSRAIGDFEFKSNPKLGPEEQIVTCVPDILEHSLDYDRDEFVILACDGIWDCLTSQDCVDLVHLGLREGKTLNEISSRIIDVCCAPTTEGTGIGCDNMSIVVVALLKEGEDVAQWSDRMKSKAHRTSVRSFADKRRRVFSYYDFSKCNDEQVFAITTKKPQDKFTRDHEAAVASVTAADNDDPMDIDDTDADTDAENLDPSSQSKSKTSGPIDLASLEALLGATGGVKTDSNGNKVTYTLPQSALAQLLQTMGHDPASSHPENDSNTDHKAGRSHLQ

SEQ ID NO: 14841 - protein, 382 aa, Pseudomonas syringae pv. phaseolicola 1448A
MIDSKLPNVGTTIFTVMSQLAAETGAINLSQGFPDFDGPQALRDAVCRHVTQGHNQYSPMTGLPALRQQVAAKIARSYGREVNPDSEITITPGATQAIFCAIHSVIRTGDEVIIFDPCYDSYEPAVELAGGRCVHVQLGLDDFSIDWQKLSDALSPRTRMIVINSPHNPSGALISRAELDRLAALIADRDIYLLSDEVYEHLVFDGARNVSVLDHEALYQRAFVVSSFGKTYHVTGWKTGYVVAPPALTSELRKVHQYVSFCGVTPLQYALADFMAEHPEHVDELPGFYQAKRDFFCGHLAESRFSFRPVGGTYFQLVDYSQIRPDLNDVDMALWMTREHGVASIPISVFYQSPPAGQRLIRLCFAKQEDTLRQAAEKLCAI

SEQ ID NO: 14842 - protein, 226 aa, Arabidopsis thaliana
MDSSTSTKKNTKLFVRNQTCFKKSSLSSSNAKKTTNLSMREQTMFKKALELSTLCDIEVCVIYYGRDGKLIKTWPEDQSKILHDKKLSEKVLEMEDSLESGLRVLQDKLLLLQPEKNQTELGQSCAVYSTTYPLSSPSLIEDHQHQQQWTEPLSNTDFCQIPNSVSSFEQSTLLGEQGSGLGSNSDLPPMVFTPQMQTQTPLVPFDQFAPWNQAPSFADPMMFSYN

SEQ ID NO: 14843 - protein, 589 aa, Burkholderia thailandensis E264
MLLTGKLADIVSPRRAGRSKPPARRRAVCSRPYRTNTSGRRKTMGKPLLGQMMDMPLLVSSLIAHAARHAGDVEIVSRRVEGDIHRYTYRDCEARSKRLAQALTRLGVGVGDRIGTLAWNGYRHVEAYYGISGMGAVCHTINPRLFPEQIAYIVNHAEDRYVLFDLTFAPLVDQLAPQCPNVKGWIAMTDDAHLPRGATPYLCYETLVGAQDGDYAWPLLDERQASSLCYTSGTTGHPKGALYSHRSTVLHAYGAALPDAMGLSSRDAALPVVPMFHVNAWGLPYTAALTGTKLVLPGKDLDGKSLYELIESERVTFSAGVPTVWLGLLAYMREAGVRFSTLDRTVIGGSACPPSMLETFEDVYDVRVIHAWGMTELSPLGTLSKLNWAQSQRSVDEQRRLLEKQGRVIYGIDMRIVGDDGRELPWDGVAFGDLQVCGPWVIDRYFGIDASPLVDGWFPTGDVATIDADGFLQITDRSKDVIKSGGEWISSIDVENVAVAHPAVAEAACIACAHPKWTERPLLVVVKRAGMDVTRGELLAFYDGKVAKWWIPDDVVFVDALPHTATGKLQKLKLREQFRDHVLPTAVDA

SEQ ID NO: 14844 - protein, 340 aa, Magnetospirillum gryphiswaldense
MYKSPNSGEVSLSAATANEYLVVTGHSWTLSARSLRSFEAGFGRKAESLIAGGGVGLSLLLSLLVWLMATGRARAIQLAESMTKDLRIAVQNTESAQRDLAVQAQSLAQSNTDLEQFAYVASHDLREPLRMVTMYLALVSRKLGPDLDADMKEFIGFAVDGAKRMDALILGLLEYARIARSEMPLQPLALGEPIAESLRNLQILCQEAGAVVSVAEDLPSILGDRTELIRLFQNLFANAVKYRSPDRAPIISVGWRDDGTEWCVWVKDNGIGIAPEYFEQVFGIFKRLVTRKEYEGTGIGLAICKRIVEHHLGRIWVMSIVGEGCTFLMAFPKIDAQKGH

SEQ ID NO: 14845 - protein, 444 aa, delta proteobacterium MLMS-1
  misc_feature (428)..(428): Xaa can be any naturally occurring amino acid
MTIRQDAINGKLTPIFQQCAEHEQVSAETLMAGVAAGTICIPKNRHHDFTRITGIGQGLKTKVNANIGSSKDHPELANELQKLCICMKAGADAVMDLSMGGEISAIRREILQNCPVPLGTVPIYQSIAQCVEREGKKIGEVSVDHLFRTIEEQARDGVDFMTVHCGITRDTLARVNNHQRLLGVVSRGGSFTIEWMSYNQQENPLYEHFDDLLAILREHEVTLSLGDGIRPGCLADATDRGQVQELIHLGELTQRAWEAGVQVMIEGPGHVPLGQIEANVLLQKRLCHNAPFYVLGPLVTDIAPGYDHITGAIGGAIAAAAGADFLCYVTPAEHLKLPSPQDVHDGVIASRIAGHAADIVKGVPGAMEQDIEMAKRRGALDWKGQIEMSIDPEKARRYREEGNTYTGDACSMCGSFCAIKVYKQATRXVSVQQHRIFGRSAPAI

SEQ ID NO: 14846 - protein, 305 aa, Mesorhizobium loti MAFF303099
MHKQTSPKELDDMLRGSLTALVTPFEKSGRFDEKAFRAFVEWQLGEGTTGLVPVGTTGESPTLSHDEHRHVVKVCIEVANGRAPVVAGAGSNNTAEAVGLVQYAEKAGADAALVVTPYYNKPTQRGLYEHFAAVARATKLPIIIYNIPPRSVIDMMPETMGRLAHDFKNIVGVKDATGKVERVSEQRMTCGKDFIQLSGEDASALGFNAHGGVGCISVTSNVAPRLCAEFQEATLSGDSVKALELQDRLLPLHKAIFLEPGVSGAKYALSKLGKVENVLRSPLVTVEESTAAKIDAAMKHAGLIN

SEQ ID NO: 14847 - protein, 153 aa, Nicotiana clevelandii
MKMIVLRSSDGETFEVEESVALESQTIKHMIEDDCADTSIPLPNVTSKILAKVIEYCKRHVDAASKTEDKAVEDDLKAFDADFVKVDQSTLFDLILAANYLNIKSLLDLTCQTVADMIKGKTPEEIRKTFNIKNDFTPEEEEEVRRENAWAFE

SEQ ID NO: 14848 - protein, 831 aa, Halobacterium sp. NRC-1
MDPDLADDYISHPDQLQEAAEEALRVYDLPVDVSLGQAHVRVHGLAEHTDIRAIRAEHLNTMVSIQGMVRKATDVMPKIQRAVFVCQRCGTDTEVPQGDAGFQEPYQCESCERQGPFKLDPDRSEFVDSQKLRIQESPEGLGGGETPQSIDVHVEDDATGNVTPGDHVTVTGVLRLDQSEEATDSPVFEHYMEGSSVVIEDAEFDELNISEADKEEIVALSDHEEIHEEMVDSMAPAIYGHREAKLAMMLQLFSGVTKHLPDKSRIRGDLHMLLIGDPGTGKCVRGDTTVALADGSEREIRDLVEANLDDPRPVDDGVWDGVDVAVPSLAADGRLVQRRATKVWKREAPETMYRVRTAAGHRLTVTPSHPLFVAGSHGPDAVRTEDLEVGQLVGVAPDGDGSGQVAPDGGVIRDAQPAPVGDAETVAWSAIESITEVEPDEEWVYDLEVEGTHSYLTDGVVSHNSQMISYVQNIAPRSVYTSGKGSSAAGLTAAAVRDDFGDGQQWSLEAGALVLADNGVAAVDELDKMADDDRSAMHEALEQQKISVSKAGINATLKARCSLLGAANPKYGRFDQYEPIGEQIDLEPALISRFDLIFTVTDQPDPEEDAALADHILQTNYAGELNTQNEELANANYSEAEIESQTEDVAPAIEPGLLRKYIAYARRTCFPTMTPDARQAIEEFYVDLRSKGADEDAPVPVTARQLEAIVRLAEASARLRLSDSVEKSDADRVIGIVQSCLQDIGVDPETGEFDADVVETGQSKTQRDRVKNIKALIGEIEEEFDDGAPVEEVLDRAEEIGMDAGKAEHEIEKLKERGELYQPNTDHLRSI

SEQ ID NO: 14849 - protein, 410 aa, Sinorhizobium meliloti
MTINATVKEAGFRPASRISSIGVSEILKIGARAAAMKREGKPVIILGAGEPDFDTPDHVKQAASDAIHRGETKYTALDGTPELKKAIREKFQRENGLAYELDEITVATGAKQILFNAMMASLDPGDEVVIPTPYWTSYSDIVQICEGKPILIACDASSGFRLTAQKLEAAITPRTRWVLLNSPSNPSGAAYSAADYRPLLDVLLKHPHVWLLVDDMYEHIVYDAFRFVTPARLEPGLKDRTLTVNGVSKAYAMTGWRIGYAGGPRALIKAMAVVQSQATSCPSSVSQAASVAALNGPQDFLKERTESFQRRRNLVVNGLNAIEGLDCRVPEGAFYTFSGCAGVARRVTPSGKRIESDTDFCAYLLEDSHVAVVPGSAFGLSPYFRISYATSEAELKEALERISAACKRLS

SEQ ID NO: 14850 - protein, 418 aa, Xanthomonas campestris pv. vesicatoria str. 85-10
MTTGNLLYAQSGGVTAVINATAAGVIAEARARKIKVLAARNGILGALREELIDTSKESAAAIAALAQTPGGAFGSCRYKLKSLEEDSAKYERLLDVLRAHDVRWFLYNGGNDSADTAWKVSQLAKAYGYPLHCIGVPKTIDNDLAVTDTCPGFGSAAKYTAVSVREAALDVAAMADTSTKVFIYEAMGRHAGWLAAAAGLAGQDPDDAPQIILLPERAYDQAAFLAKVKQVVDKVGWCVVVASEGIQDAHGKFVADAGGATDSFGHAQLGGVASFLAAQVKQELGYKVHWTLPDYLQRSARHLASKTDWEQAQAVGKAAVQYAIKGMNAVIPVIERVSDAPYRWKIVPAPLHKVANHEKKMPPSFLRKDGFGITERARRYFAPLIKGEAPLAYGSDGLPKYVSLKNVAVAKKLPAWEG

SEQ ID NO: 14851 - protein, 278 aa, Bacillus licheniformis ATCC 14580
MKPIYGLIGNPVAHSMSPDIHNAALKDLSLEGHYHAFRVENEDLEDAVKGMRALGIQGFNVTVPHKVSIMKHLDRIDESAEALGAVNTVRREKEGLVGYNTDGAGFLKSLKPSLDRPLSELSILLIGAGGAARAIFTTLAAETPKRLDVANRTPEKALAFTQRFDGEARALSLQEAEADLSAYDIVIQTTSVGMHPNVEAAPLSLANAKETCLVCDIIYNPLKTALLHEAEAKGLKTLDGVGMFIGQAALAFELWTGHEPNMEKMKSIVLQQLGGKSC

SEQ ID NO: 14852 - protein, 569 aa, Triticum aestivum
  misc_feature (266)..(266): Xaa can be any naturally occurring amino acid
  misc_feature (403)..(403): Xaa can be any naturally occurring amino acid
  misc_feature (413)..(413): Xaa can be any naturally occurring amino acid
  misc_feature (485)..(485): Xaa can be any naturally occurring amino acid
MIEQVCTKKQAGTGPEFPGYRRPTRPPTRPLSCAKGKERRIWNLHTIFFLKENRGEEESGVREMAMASLARRRAAEAVLLRRPHAAAWASACRGYAASGEESDVVVIGGGPGGYVAAIKAAQLGLKTTCIEKRGALGGTCLNVGCIPSKALLHSSHMYHEAKSSFAHHGVKFSNLEVDLPAMMAQKDKAVSGLTKGIEGLFKKNKVEYVKGFGKLVSPSEVSVDLVDGGSTIVKGKNIIVATGSDVKSLPGVTIDEKKKIVSSTGXALALTEIPKKLVVIGAGYIGLEMGSVWNRLGSEVTVVEFAPDIVPSMDGEIRKQFQRMLEKQKFKFMLKTKVVGVDTSGSGVKLTVEPAAGGEQTVIEADVALVSAGRVPYTAGIGLDAIGVETDKGGRILVDNRFXTNVKGVYAIXGDAIPGPMLAHKAEEDGVACVEFIAGKEGHVDYDTVPGVVYTHPEVASVGKTEEQVKASGVAYQVGKFPLLXANSRAKAIDDAEGMVKVISEKETARILGVHIMSPGAGEIIHEAVLALQYGASSEDIARTCHAHPTVSEALKEACMNTYDKAIHM

SEQ ID NO: 14853 - protein, 212 aa, Oryza sativa (japonica cultivar-group)
MRTGEVAEAVPRVVAILSSLLQRVAERNDAAAAAAAVGEEAAAVSAFQGLTKPAISIGGYLERIFRFANCSPSCYVVAYIYLDRFLRRRPALAVDSFNVHRLLITSVLTAVKFVDDICYNNAYFARVGGISLMEMNYLEVDFLFGIAFDLNVTPAAFASYCAVLQSEMTYLEQPPAVDLPRLHCCPSDQDDAGCHHKQQQQQQQQQQHQLAV

SEQ ID NO: 14854 - protein, 191 aa, Zea mays
MAMMVSVSNSFLTFNSPNHLRTSRRRFCAMATTGVRVTEGEGNLPKLVLTSPDKSEAGDIFFWRCVTSWKVASGKDLLFVRPDAVFNKIKPISGGIPHCFPQFGPGVIQQHGFGRNMDWSVVDSENAVDNAAVTLELKDGPYSRSMWDFAFHALYKVVVGADCLSTELKITNTDNKPFSFFPQPREPRRRR

SEQ ID NO: 14855 - protein, 426 aa, Pseudomonas syringae pv. phaseolicola 1448A
MSKTNESLMQRRHAAVPRGVGQIHPIFAASAKNATVTDVEGREFIDFAGGIAVLNTGHLHPKIIAAVQEQLTKLSHTCFQVLAYEPYVELCEKINAKVPGDFDKKTLLVTTGSEAVENAVKIARAATGRAGVIAFTGAYHGRTMMTLGLTGKVVPYSAGMGLMPGGIFRALYPCELHGVSVDDSIASIERIFKNDAEPKDIAAIIIEPVQGEGGFYVAPKAFMLRLRELCDKHGILLIADEVQTGAGRTGTFFAMEQMGVAADLTTFAKSIAGGFPLAGVCGKAEYMDAIAPGGLGGTYAGSPVACAAALAVLDIFEEEHLLDRCKAVGERLVTALKGIQAKYPVIGEVRALGAMIAVELFEDGDSHKPNAAAVVQVVAKARDKGLILLSCGTYGNVLRVLVPLTAEDELLTRGLAILEECFAEIA

SEQ ID NO: 14856 - protein, 372 aa, Halobacterium sp. NRC-1
MDDGTIETFKAFRSQFNGDRGPYKGGIRYHPGVTRDEVKALSGWMVYKTAVADIPYGGGKGGIILDPEEYSDSELERITRAFATELRPFIGEDKDVPAPDVNTGQREMNWIKDTYETLEDTTAPGVITGKALENGGSEGRVNATGRSTMFAAREVFDYLDRDLSDATVAVQGYGNAGSVAAKLIADQGADVVAVSDSSGAVHNPDGLDTRAVKAFKTETGSVSGYEGATEELSNEALLTMDVDLLVPAALENAIDEDLAHDVDADVVVEAANGPLTPDADDVLTERGVTVVPDILANAGGVTVSYFEWVQNRQRFQWTEDRVNEELEAIITDAFDAMTDAHEDAGTPNLRTAAYVVAVQRVVDAYEGSGSWP

SEQ ID NO: 14857 - protein, 380 aa, Halobacterium sp. NRC-1
MNFSTRVTSVEPSATLAVSTLASELEADGVDVVDLSVGEPDFDTPESIVDAGKAAMDAGHTGYAPSNGVPELRDAIAEKLQGDGLDYEAGNVIVTPGAKQALYETFQAVVDEGDEVALLDPAWVSYEAMAKLAGGELNRVDLAPHDFQLEPALDDLADAVSDDTELLVVNSPSNPTGAVYSRAAMEGVRDLAVDHDITVISDEIYQRVNYGPAHVSLAGLDGMFERTVTINGFSKAYSMTGWRLGYLAGPEALVDQAGKVQSHSVSSAANFIQRAGVEAIRHTDDAIDEMVAAFESRRDLLVDLFAEHGTDVSTPDGAFYLMLPVADDDQAWCQDALKDAHVATVPGSAFGAPGYARLSYAASTDRLEAAVDRLAAEGYL

SEQ ID NO: 14858 - protein, 161 aa, Trema orientalis
MSSSEVDKVFTEEQEALVVKSWAVMKKNSAELGLKFFLKIFEIAPSANNLFSYLKDSPIPLEQNPKLKPHAMTVFVMTCESAVQFRKAGKVTVRESNLKRIGAIHFKNGVVHEHFETRFALLETIKEAVPEMWSPEMKNAWGEAYDQLVAAIKFEVKPSST

SEQ ID NO: 14859 - protein, 314 aa, Idiomarina baltica OS145
MQSTNHSIPHVDMRRYDEDFQAFTKDVGNGYEEYGFIALTNHGVDTQLIERALDTCRELFALPEDVKMKYHRPGEGGARGYTPFGTEIAKDAKHVDLKEFWHVGRELEGEPPYPQLLPNVWPEELPEFKRDMTLIYQELDKLGNKVLDALAVFLDQPRDFFRDKVNLGNSILRPLHYPPIIDEGTPSVRAGAHEDINVLTLLVGSREPGLEVLAKDGTWVPVTIIEGAIICNVGDMLQRLTNHQLPSTTHRVVNPPMPYSAKSRYSIPFFLHFNPDVMITPLESCISEENPQKDEPITADDYLMERLREIGLVK

SEQ ID NO: 14860 - protein, 979 aa, Bacillus licheniformis ATCC 14580
MDGKPISIRIDGKEFEAVAGATVLDILNKNGFEHPQICHVPETDPIQTCDTCIVEADGKLKRACSLRAEDGMTISLSAERVKAAQKEAMDRLLENHLLYCTVCDNNNGNCKLHNTAEMMGIEDQKYPYTPKEDPSCAVDMSHPFYRYDPNQCIACGQCVEVCQNLQVNETLSIDWELERPRVIWDEGVSINESSCVSCGQCVTVCPCNALMEKSMLGKAGFMTGIKPDVMEPMIDLVKDVEPGYSSIFAVSEVEAAMRSQRTKKTKTVCTFCGVGCSFEVWTKGRDILKIQPVSEAPVNAISTCVKGKFGWDFVNSEERLTKPLIRKNNEFVESTWEEALDYVARRLGSIREQNGKDAVGFISSSKITNEENYLMQKLARQVFGTNNVDNCSRYCQSPATDGLFRTVGMGGDAGTIQDIAKAGLVIIVGANPAEGHPVLATRVKRAHKLHGQKLIVADLRKNEMAERSDLFIRPRQGTDQVWLMAVTKYMIDQGWHDQAFIDENVNFFEEYKQSLETYTLEYAEKITGIHKQTLIQIAEMIRDADGTCILWGMGVTQNTGGSDTSAAISNLLLATGNYRRPGAGAYPLRGHNNVQGACDMGTLPGWLPGYQHITDDKARKKFEQAYGTTIDEEPGLDNIEMLHAVEEGKMKAMYIVGEDMALVDSNANRVHDILSSLEFLVVQDVFLSKTAQYADVVLPASASLEKDGTFTNTERRVQRLYQALPPLGDAKPDWVIIQDIANRLGADWSYSHPGDIFSEMASLSPLFSKADYDAIEGWNSFLWGSLTGESTPLLYEDGFNFPDRKARFAIADWAEPAEFPEEYDLHINNGRMLEHFHEGNMTNKSAGIQAKVPDVFVEVSPELAKERGICDGSQVRLISPFGAVKLTALVTDRVRANELYLPMNSTDKESAINFLTGPAVDARTNTPAYKQTKVRMEVLGGCAEPPLPKTNPRNKKRHPQNGAEVERKWKRPGYVHLTD

SEQ ID NO: 14861 - protein, 314 aa, Zea mays
MYADAGFAFAFAAAYSPTLTSSQPQPPPPPFDYAFSSEPPLLSMPAMDHDAYLGNLVQPSMVSEYDLGGEGDLFKAPEAIIEEPLLSLDPVAAAFSMMAGNGSAVMDQTIKDAGIGTIQNDPLLSEVLYECEKELMEKSTIEETISELMDVKIPMLQVEEIPSQAEQVLIQNQQLPAMEKEKQSVPECSLQKSVSSGCLNSADWMNGPARPNFLDFQGLDFEAAFGLRRAYSEGDIQNLGANTPRPAANVCVTISDLKTEERKQKLSRYRKKKIKRNFGRKIKYACRKALADSQPRVRGRFAKIEECDLLKPSK

SEQ ID NO: 14862 - protein, 140 aa, Brassica napus
  misc_feature (11)..(11): Xaa can be any naturally occurring amino acid
TEAALSQTCFXVSRNRLVSRSDDETERVELRKQSENEMKRCLTWWDLVWFGFGSVVGAGIFVLTGQEAREEAGPAIVLSYVVSGFSAMLSVFCYTEFSVEVPVAGGSFAYLRIELGDFAAFITAGNILLEGVVGTAAVGR

SEQ ID NO: 14863 - protein, 675 aa, Xanthomonas campestris pv. vesicatoria str. 85-10
MLEHYGLWLALGCAVLAIVYGIVSARWVVAQPSGNARMQEIAAAIQEGARAYLNRQYLTISVAGAVLFVLVGLFLSWYTAIGFALGAVLSGLAGYIGMNVSVRANVRTAEAARHGIGRAMDVAFRGGAITGMLVVGLGLLGVAGYFAVLQGMGLPLEQNLHALVGLAFGSSLISIFARLGGGIFTKGADVGADLVGKVEAGIPEDDPRNPAVIADNVGDNVGDCAGMAADLFETYAVTVIATMLLGSLTLAETGPYAVLYPLVLGGVSIIASIVGAAFVKVKGGGSIMGALYKGVIVSGVLAALAYWPITQSLMRDNTHGAAALYACALIGLVLTGLIVWITEYYTGTQYTPVQHVASASTTGHGTNIIAGLGISMKSTALPVIAVCAAIWGAFHFGGLYGIAIAATAMLSMAGMIVALDAYGPITDNAGGIAEMAELPPEVRNITDPLDAVGNTTKAVTKGYAIGSAALAALVLFADYTHNLQAANPDQVYAFDLSDHTVIIGLLIGGLIPYLFGAMAMEAVGRAAGAVVEEVRRQFRELPGIMAGTAKPQYDRAVDMLTRSAIGEMIVPSLLPVVVPIIVGLLLGPRALGGLLIGTIVTGLFLAISMTTGGGAWDNAKKYIEDGHFGGKGSEAHKAAITGDTVGDPYKDTAGPAINPLIKIINIVALLLVPLL

SEQ ID NO: 14864 - protein, 970 aa, Exiguobacterium sibiricum 255-15
MNRWKSVCAVVLTFALIFSLFPVNGLALEKGKSTLVIIHYKEDKTAPKDWNLWLWANGPDYFPNKAHAFNGQDAYGKIAAYEFPVDQPEKIGFIVRDDSWNKDAGSENDRFITKDMIKDGVAEVWIESGSKDVSPVNPTGGSDVESVNTNIHYYRYDNDYDKYGVWAWPNAQDGKRFEFDGQDAFGAVANVTLTNTTKERLVGIIPHIEGWSEKDGADRFYYAGAKDIWLIEGDQTVYYSQPDIDRTPKFTSFLADDFKTMTLKTNSPIAAEDVKTLTFKGLVNPVVTQVDAKTLHVTVASDIDLANVVTVSHPVFGEGILEAGKVLRSDAFDKKYAYDGKLGTAYQKGKTTFRVWAPTAQSVELELYKLPKKQAATTKDIVREVKMVRGDRGVFSITVNGDLDGTGYTYEVKHAKETTRAVDPYTTAVAVNGDQGVVVDLRETNPKRWTKTKMPLKQATDAIIYETHVRDLSMFDVTGDTYDSGIEQKGKYLGVVKPGTRLMKDGKKTKTKTGLDHLKELGITHVQFIPVYDFNTASVDETNPLKTYNWGYDPKNYNAPEGSYSTNPYDPKVRIKEMKQMIQGLHDNGLRAVMDVVYNHMFDAKASNLDKIVPGYYYRYTEGGDLANGTGVGNDTASERKMMHKLIVDSVGYWAKEYRWDGFRFDLMGIHDVKTMNAVKKTTTKIDPSILVFGEGWSLGTPLPEADKANQTNAKQMPGIAHFNDNLRDALKGSVFEDTDAGFINGKTGLETRIKRGIVGEIAYNKDITGFAAEPNQAITYVEAHDNHTLWDKLNLTNPNDTDATKTKMHRLASSILLTSQGTTFIHAGQDFMRTKGGDHNSYKSPDAVNQLDWKRKMDRQADVDYMKGLIQVRKANPVLHLGTAKDIRRYLTFKDVPEQVVAYQLSDDAPQQKTDLYVVHNAKRQAVKMTLPKGTWSVIVDGKTAGMKTLKKVSGSVTVDPLSSYVLKK

SEQ ID NO: 14865 - protein, 502 aa, Oryza sativa
MRRCPRFAHHLRLRSQLLRLRAEASSWRLPVAAVSSSNLHPEYAKKIGGSDFSHDRQSGKELQNFKVSPQEASRASNFMRASKYGMPITANGGNIARWVKKEGDKVSPGEVLCEVETDKATVEMECMEEGYLAKIIHGDGAKEIKVGEIIAVTVEEEEDIGKFKDYKAPSSAESAAPAESKPQSEPTEPKKEKEQPKAPEPKATKTEESFLSEDRTFSSPIARKLAEDNNVPLSSIKGTGPDGRILKADIEDYLASVAKGAKKETAAAPGLGYVDLPNTQIRKVTANRLLHSKQTIPHYYLTVDTRVDKLIKLRSELNPLQDTSGGKKISINDLVIKAAALALRNVPECNSSWMNDFIRQYHNVNINVAVQTEDGLFVPVIRDADKKGLATIADEVKQLAQRARDNSLKPEDYEGGTFTVSNLGGPFGIKQFCAIVNPPQSAILAIGSAEKRVIPGAEGQFEVGSFMSATLSCDHRVIDGAIGAEWMKAFKGYIENPTTMLL

SEQ ID NO: 14866 - protein, 479 aa, Bacillus anthracis str. Ames
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPQGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVSLVKEQVAKLSVGSPEQDSTIVPLIDDKSADLVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 14867 - protein, 539 aa, Oryza sativa
MHAHKRRCATMAVSLVVVVVVVIAIVVPLLYLVLLPAWKPARRDDGDGGMRRRLPPSPPWGLPLLGHLHLLGALPHRALRSLAAAHGPVLLLRLGRVPVVVVSSAAAAEEVMRTRDLEFASRPRVAMAERLLYGGRDVAFAPYGEYWRQTRRICVVHLLSARRVLSFRRVREEEAAALVARVRAAGGAVDLVEHLTAYSNTVVSRAVFGDESARGLYGDVDRGRVLRKLFDDFVELLGQEPMGELLPWLGWVDALNGMEVKVQRTFEALDGILEKVIDDHRRRRREVGRQMDDGGGGDHRDFVDVLLDVNETDMDAGVQLGTIEIKAIILDMFAAGTDTTTTVIEWAMAELITHPDAMRNAQDEIKAVVGITSHITEDHLDRLPYLKAVLKETLRLHPPLPLLVPHEPSSDTKILGYSIPACTRIVINAWTIGRDQATWGEHAEEFIPERFLESGLDYIGQDFVLVPFGAGRRGCPGVGFAVQAMEMALASLLYNFDWETRVVDRRSEFGTSSLDMSEMNGLSVRLKYGLPLIAISRFP

SEQ ID NO: 14868 - protein, 614 aa, Arabidopsis thaliana
  misc_feature (371)..(371): Xaa can be any naturally occurring amino acid
  misc_feature (424)..(424): Xaa can be any naturally occurring amino acid
MDPIESVEYNGFETTNGNSHNDDHGWKKVVYPKRNRKQKPADQAAATKNGVTGNLIPNGTLSNGGGNVFRSLEEQAEGRHLQILAAKKASDTADVSDGGRSKWRSNGYGDEGYDFDDSDSEIAVGKENLKAEEVKKPKVKKVKKPKVTLAEAAAKIDVSNLAAFLVEASESYASQPEIQLMKFADYFGRSLSQVSSAHFPWVKTFKESPLSKLIDIPLSHIPEAVYKTSADWINQRPIEALGAFVLWGLDCILADLAVQQGGVKGGKKGAQQASSKSQVAIFVAVAMVLRKKPDALTNILPTLRENPKYQGQDKLPVTVWMMAQASQGDISVGLYSWAHNLLPVVSSKSCNPQSRDLILQLVERILSNPKXRTILVNGAVRKGERLIPPPSFEILVRLTFPASSARVKATERFEAIYPLLKSVXLLAPGSKAMKQVTQQIFTFALKAAGEENPLLAKEAAAITIWALTQNVDCCKHWENLYTDNLKASVAVLKKLIGEWKERSVKLTPAETLTLNQTMKSLRQKNEEALTEGGNGVSQSLYKDADKYCKVIAGKLSSGGCIKSIATTAALLAATGFAGAAALSANPEAIAYLKNLVESLDINKFTETVMTALKN

SEQ ID NO: 14869 - protein, 63 aa, Pfiesteria piscicida
MRGILVDWLVEVHLKYKLKAETLYLTVNLIDRYLEVQQVVHGELQLVGVTAMLIASKYEEIYP

SEQ ID NO: 14870 - protein, 566 aa, Spinacia oleracea
MAPSTLICDTDSWQNLKTHVAEIKKTHLRDLMSDADRCKSMMVEFDGLLLDYSRQNATHDTMSKLFQLAEASHLKDKINQMFNGEHINSTENRSVLHVALRASRDAVINGDGKNVVPDVWQVLDKIRDFSEKIRSGSWVGVTGKPLTNVVAVGIGGSFLGPLFVHTALQTESEAAECAKGRQLRFLANVDPIDVAKNISGLNPETTLVVVVSKTFTTAETMLNARTLREWISSALGPAAVAKHMVAVSTNLTLVEKFGIDPKNAFAFWDWVGGRYSVCSAVGVLPLSLQYGFPIVEKFLKGASSIDQHFHSAPLEKNLPVLLGLLSLWNVSFLGHPARAILPYCQALEKFAPHIQQVSMESNGKGVSIDGVVLPFEAGEIDFGEPGTNGQHSFYQLIHQGRVIPCDFIGIAKSQQPVYLKGEVVSNHDELMSNFFAQPDALAYGKTQEELQKENISPHLVPHKTFTGNRPSLSLLLPSLTAYNVGQLLAIYEHRVAVEGFVWGINSFDQWGVELGKSLANQVRKQLHASRTNGEAVKGFNFSTTTVMAKYLQETSDVPAELPTKLP

SEQ ID NO: 14871 - protein, 63 aa, Cryptoperidiniopsis brodyi
MRGILADWLVEVHLKFKLVPETLYLTVNIIDRFLQIHKVSRPKLQLVGVTSLLIASKYEEIYP

SEQ ID NO: 14872 - protein, 562 aa, Halobacterium sp. NRC-1
MSTQQEDDTPDVDDAAPATPASGSPAALEALIEDHVLEREDHLNAPGFVIRADAVQDVLSTLKTEAGFDHLSCVTAEEHEDRFESIYHLRKYDDPTQEVSIIVPTSRDNPVSETAEPVFRTADWHEREAYDLVGVEYDDHPNLERILLPDTWQGHPLGLDYNQNKPQIVTFDEHKNPLEGHEQAADDSDTMFLNIGPHHPATHGVLHVETVLDGEQVADVNPDIGYLHRCEEQMAQKGTYRHQIMPYPDRWDYGPGGILNEWAYARTAEDLADIDVPEYAQILRTMGGELCRIACHMLALGTFCLDIYGDFTAIFMYAMRDREVVQNILEDLTGQRMMLNYLRLGGVVWDIPEPRAEFFESVRDFLDELPERLDEYSDLITSNEIFQARTVNTGVLDYETAKDYGVTGPVARGSGVDYDVRRDDPYGYYPELDWDVVTEDGGDNYSRLLVRMEEVEQSARIIEQCVDLLEGWPEDERDIQANVPRTLKPEAGTETYRTVEGAKGELGVYIRADGTEKPGRFKIRSPCFSNLSALKEMSTGEYIPDLVATLGSLDVILGEVDR

SEQ ID NO: 14873 - protein, 248 aa, Oryza sativa (japonica cultivar-group)
MVLCSMRKSFKDSLKVLEADIQHANTLASDFSRDYDGACLQMRMSYSPAAQFFLFLVQWTDCSLAGALGLLRILIYKVYVDGTTTLSTHERKASIREFYAVIFPSLMQLHKGISDVDDRRQKAICTERYRRRDEDESKRHVSEIDVEREEECGICMEMNNKVVLPNCSHAMCMKCYRQWRSRSQSCPFCRDSLKRVNSGDLWMLTDDRDVIDMATITRENLRRLFMYIEKLPLVAPDNIFYAYDSHVK

SEQ ID NO: 14874 - protein, 323 aa, Magnetospirillum magnetotacticum MS-1
MGVLEKFGVQMIGATAEAIDKAEDRNLFREAMTKIGLETPKSALANASAAKKADRDRYLAEKARIEASQSDPAARAAALAEFERQWSGGEGDRRRRYIEHALGQALIALAEVGLPAIIRPSFTMGGTGGGIAYNREEFLDIVERGIDASPTNEVLIEESVLGWKEYEMEVVRDKADNCIIVCSIENLDPMGVHTGDSITVAPALTLTDKEYQVMRDASLAVLREIGVETGGSNVQFAINPENGRMIVIEMNPRVSRSSALASKATGFPIAKVAAKLAVGYTLDEIANDITGGATPASFEPTIDYVVTKIPRFDFEKSPAPSRP

SEQ ID NO: 14875 - protein, 360 aa, Candida albicans SC5314
MTNPSLVLNKIDDISFEDYESPEITSPRDVIVEVKKTGICGSDIHYYAHGSIGPFVLRKPMVLGHESAGVVVAVGDDVTNLKVGDKVAIEPGVPSRYSDEYKSGNYHLCPHMAFAATPPVNPDEPNPPGTLCKYYKAPADFLFKLPDHVSLELGAMVEPLTVGVHACKLANLKFGENVVVFGAGPVGLLTAAVAKTIGAKNIMVVDIFDNKLQMAKDMGAATHTFNSKTGDDLVKAFDGIEPSVVLECSGAKQCIYTGVKILKAGGRFVQVGNAGGDVNFPIADFSTRELTLYGSFRYGYGDYQTSIDILDKNYINGKENAPINFELLITHRFKFKDAIKAYDLVRGGNGAVKCLIDGPE

SEQ ID NO: 14876 - protein, 153 aa, Halobacterium sp. NRC-1
MIGLLKSMATTMKHALSGDTFTVEYPEEAPEVSARFRGVHKFSQERCIWCRQCENVCPNDTIQIVTDNQRNGEQYNLHVGQCIYCRLCEEVCPVDAILLTENFEFTGDTKHDLVFNKEQLKNVPWYNDIDPVASREPDRGAWIGDGEGEVDYQ

SEQ ID NO: 14877 - protein, 185 aa, Brassica napus
MAEELLANEERLTRTDSAEKKRVRDESDDAVIDSPEVKRLRDDLFDVLDDSDPEPVSQDLDSVMKSFEDELSSTVTTAGETQPDLGYLLEASDDELGLPPVSPVPVAKEVETTETLTDLVRASSDSSGVDEVWGFEDHLSNYYGSLDFGSGVGDYLAVEGLFEFSDDGFDAGELFSWRSESLPAE

SEQ ID NO: 14878 - protein, 377 aa, Nicotiana tabacum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDVKEKLSYIALDFEQEMETSKTSSSVEKSYELPDGQVITIGAERFRCPEVLFQPSMIGMEAAGIHETTYNSIMKCDVDIRKDLYGKIVLSGGSTMFPGIADRMSKEITALAPSSMKIKVVAPPERKYSVWIGGSILASLSTFQQMWIAKAEYDESGPSIVHRKCF

SEQ ID NO: 14879 - protein, 296 aa, Bradyrhizobium sp. BTAi1
MAAKTNFRGSFTALVTPFKNGAVDEAAFRSLVNWQIDEGTNGLVPVGTTGESPTLSHDEHKQVVEWCIAEAKGRVPVIAGAGSNSTREAVELAEHAEKAGADAVLVVTPYYNKPTQEGLYQHFKAINDAIGIPIIIYNIPPRSVIDMSVDTMKRLFELKNIAGVKDATASMVRVSQQRATLGEDFNQLSGEDATIIGYMAHGGHGCISVTSNVAPRLCAEFHAAWQKGDVATALKIHDKLMPLHTNLFIESNPGPVKYALSLLGKLEERLRLPMVPVSEPTRIAVREAMVHAGLIN

SEQ ID NO: 14880 - protein, 325 aa, Idiomarina baltica OS145
MAKMNLLQAINSALDLAMAKHDNVYSFGEDTGGFGGVFRATSGLTEKYGKHRNFNTPLVEQGIIGFANGLASQGSYAVAEIQFGDYIFPAFDQIVNESAKFRYRSGNEFNVGGLTIRTPYGGGIAGGHYHSQSPEAYFAHTPGLKIVMPRNPYEAKGLLLSSIFDPNPVLFMEPKRLYRASTGDVPEEEYTIPLGQAEVVKEGADITLLAWGAQMEMTEKAAELAEKDGVSCEIIDLRTILPWDVKTVTESVLKTGRLVISQEAPITSGFASEIAATVQDKCFLYLESPIARVCGLDVPYPLCHEKEYMADHLKIYEAIKRTMNY

SEQ ID NO: 14881 - protein, 129 aa, Bacillus licheniformis ATCC 14580
MKPVHTKYSTRDGGHYVPAMEHNDVLYISGQLSMNPETGKIPAGGIKEEAKQALANMELVLKERGLAKEDVILCRLYTPDVKYWPDINEVYAHFFGNHKPARVVVPSNHLYAGCLVEVEAIAAIKEEAQ

SEQ ID NO: 14882 - protein, 124 aa, Bacillus licheniformis ATCC 14580
MESIFEAGNLKSNGHYALAVIHQNTVYVSGQFAIDPITQEKKFGTIEEETLQVLSNIEYILKKAGSHKGKILKITLYLHDINLLDRVDNVCQGFFHDYRPARSVVSTTELHYGFQVEIEAIASL

SEQ ID NO: 14883 - protein, 625 aa, Xanthomonas campestris pv. vesicatoria str. 85-10
MNAAPTVLQQQAQSLSEAVTQPIPGSRKIFVQGSRADLQVPMREIALTRTPTLFGGEENPPLSVYDTSGPYTDPRVAIDLAAGLAPLRAQWIAERGDTVALDGLSSSFGRGREHDVRLDAVRFPARRLPRVARQGANVTQMHYARRGIITPEMEYVAIRENQRLEAVTDASLRRQHPGQAFGASIQQRITPEFVREEIARGRAILPNNINHPESEPMIIGRNFLTKINANIGNSAVSSGIAEEVEKLVWSIRWGGDTVMDLSTGKHIHETREWIIRNSPVPIGTVPIYQALEKVDGRAEALTWEIFRDTLIEQAEQGVDYFTIHAGVLLRYVPLTAQRVTGIVSRGGSIMAKWCLAHHKENFLYTHFEDICQIMKAYDVAFSLGDGLRPGCIADANDAAQFGELETLGELTKLAWKHDVQTMIEGPGHVPMQLIKENMDKQLRECGEAPFYTLGPLTTDIAPGYDHITSAIGAAMIGWFGTAMLCYVTPKEHLGLPNRQDVRDGIMAYKIAAHAADLAKGHPGAQVRDNALSKARFEFRWDDQFHLGLDPEKAKEFHDQTLPKDAHKLAHFCSMCGPHFCSMKITQDVRDYAAEHGMSEAQALSTGMQEKSAQFVAQGAQVYRAT

SEQ ID NO: 14884 - protein, 444 aa, Coccidioides immitis RS
MSHLPIEPEFEQAYKELAFSLENSTLFEKHPEYRKALQVASIPERTIQFRVTWENDKGESRKSLINFPFFLGGWEQQLEVNRGYRVQFNSALVNMGGGKGGADFDPKGKSDNEIRKFCSAFMMELSKHIGADIDVPAGDIGVGGREIGFLFGAYKRQRHIWEGVLTGKGLSWGGSLIRPEATGYGLVYYVQHMIEYATNGQESFKGKRVAISGSGNVAQYAALKVIEFGGTVISLSDSKGALVIRNEGDSITPQEIYEIQQLKDQRKQLSALADAPHFKDRCVYIEGARPWLHVGQVDVALPCATQNEVSGPEALGLIQSGCKYIAEGSNMGCTLAAIEHFEAHRQLHKKGGAVWYAPGKAANAGGVAVSGLEMAQNSQRLTWTAEEVDQKLKNIMKVCFETGVRTSETYTALSEGQLPSLVIGSNIAGFIKVAEAMRDHGDWF

SEQ ID NO: 14885 - protein, 209 aa, delta proteobacterium MLMS-1
RGRNTLELRFPEIYQQLLSISRHLVYDKRWNAQEIEFTFEGPRTEDLYLLQTRDMITIKKKESFNVFADADTAEAAVTAHGVGVSGSAISGLVVFNAEDIARLRAERPEAQLILIRQDTVPDDIKEIAAADGLLTARGGQTSHAAVVATRLEKTCVVGCSQLKVFETEQRCEINGFTFQCGDHLSIDGRKGLVLQGDHPTRKEMQILPL

SEQ ID NO: 14886 - protein, 581 aa, Nicotiana tabacum
MGNTCVGPSISKNGLFQSVSAAMWRTRAPDDSGSTTNGDSARGETTESGKDPDLVVQNKPPEQITMPKSEQKEEEPAKKEEGPVKPKKPVEMKRVGSAGLRTDSVLQKKTGNLKEFFSIGKKLGQGQFGTTFKCVEKATGKEYACKSIAKRKLLTDDDVEDVRREVQIMHHLAGHPNVISIKGAYEDAVAVHVVMEYCAGGELFDRIIQRGHYTERKAAELTRTIVGVLETCHSLGVMHRDLKPENFLFVNQKEDSLLKTIDFGLSIFFKPGDRFNDVVGSPYYVAPEVLKKRYGPEADVWSAGVIVYILLSGVPPFWAENEQGIFEEVLHGDLDFSSDPWPSISEDAKDLVRRMLVRDPKKRLTAHEVLCHRWVQVDGVAPDKPLDSAVLSRMKQFSAMNKLKKMALRVIAESLSEEEIAGLKEMFRMIDTDNSGQITFEELKVGLKRVGANLKESEIYDLMQAADVDNSGTIDYGEFIAATLHFNKIEREDHLFAAFSYFDKDGSGYITADELQQACEEFGIGDVHLEDMIRDADQDNDGRIDYNEFVAMMQKGNPVIGGGKKGLEHSFSTGFREALRL

SEQ ID NO: 14887 - protein, 373 aa, Arabidopsis thaliana
MTLQSSPMSVLTEDLVEDILSRVPATSLVRLRSTCKQWNAILNDRRFIKKHFDTAEKEYLDMLLRSLRVSSMSVNLHGLHDNIDPSIELKRELNLKGLLCNSGKVESFEVFHCNGLLLFTNTSTIVVWNPCTGQTKWIQTESANTRYHKYALGYENKNLCRDYKILRFLDDGTNFELEIYEFNSSSWRVLDSVEIDFELDIGSQGMSVKGNTYWIVIDDHEVDGELVNCFLTSFDFTRERFGPHVCLPFQTSWYSDVISLSSVREERLSVLFHEEDSLTMEIWVTNDITDTIVTSWSKFLRVDLYTHRFYNGVTFFIDEENKAAVFSEDVPDDSDDIHSIVYIIGQDRLRIVDLEDGPFWPQMFCYVPSLVQI

SEQ ID NO: 14888 - protein, 400 aa, Glycine max
MACPAMANGNGSLKNLKLNDTKGKTITCKAAVVYGPGEPFVVENILVHPPQKMEVRIKILYTSICHTDLSAWRGVNEAQRAYPRIFGHEASGIVESVGEGVSEVEEGDIVVPIFNGECGECSMCKCEKTNLCERFGVDATKKVMEGDGTTRFSTVNGKPIFHFLNTSTFSEYTVVDSACVVKFLDSDHSLSHKNLTLLSCGVSTGVGGAWNTANVHSGSTVAIFGLGVVGLAVAEGARARGASKIIGVDINPDKFIKAQTMGVTDFINPDDEEKPVYERIREITDGGVHYSFECTGNVDVLRDAFLSSHEGWGLTVILGVHASPKLLPIHPMELLDGRNIVGCVFGGFKGRSQLPHFAKECGQGVVKLDNFITHELPFEEIDKAFDLLITGKSLRCLLHF

SEQ ID NO: 14889 - protein, 1036 aa, Coprinopsis cinerea okayama7#130
MANVEDPLSSGRILRRAPNLHDGTLVKELESTHRPSHRRQTSIRASIRRRFEEVRDGVLSRSRSLNGRSIRPAGQHDSTPANAEETPRKVHSRSLSELNCAPPQPVSIVSVSPRATDDFTAHQRTLSTVSERSFMTSTAAPAPPRPNTHPDSKESGDMVVPHLLQLGTPMTKVSAKKHKKFVFRLDPDLGQIVWESKKHKIIPIENIKEIRSGRDARYYREQFQLAQEYEDRWLTIVYILDGNYKTIHLIVATRDVFRMWDSTLRQLHAIRQELMSGLGNLEVRQALWEKQYWKGADEEQDQRLTFEEVEKLCKRLNINSSQEDLRRLFQQADVRGRGFLEFDDFRKFVKLLKTRPEIRRLYNKLKGRTLDVFDFSTFEIFMREKQQSELTTDELKGLFSKYTGSQPAMSLDSFTTFLLSPDNSAFLDQHLKIYHDMTRPLPEYFISSSHNTYLVGHQLVGDSTIEGYIRALLHSCRSVEVDIYDGDVEPMIFHGKTLTSKVPLRTVCEAIKKYGFVASPYPIIISAEVHCSVPMQDMIAEIMIEVFGDSLIREPLEGRTKIDVLPSPEELKGKILMKTKNLMLTFNDTSDGDSSSTDPSASSASASETEFFDHIYSVPAEKKVGVHDKHESKGPLAKVGSNVLQRVKSIAKPSTSGPKPLRMHSAPEVPLNSPVVSPTASNQTHRRHSEYDRPKPKMSFALVALLVYTVGVKWRGLNKKEEYAPEHMFSLSENTANKLLKMGMMDLIKHTRTHLVRIYPKGTRVTSTNFLPHRFWASGAQLVAINWQTFDLGYMINHAMFQRNGRSGYVLKPAALRSPNKDELTKKTHHVFQVSIISAQQLPRPKNALGHEMPRSHLNPYVEVSLYVPDWPTLSTPGSTNGGVSRGNSTRLAAAITSPRKKRSGTFSPVAAAFPNPADAIAPLSPIPPVPSSIPGKTISRKTGVVKNNGFNPIWEEKLQLPFECVGDMMDLVFVRFVVKCQDAKEGDEPLAVYCASLGSLGRGYRHLPLHDSQLSQFLFSTLFVRINVLDISPSP

SEQ ID NO: 14890 - protein, 187 aa, Yersinia pseudotuberculosis IP 32953
MTVSASKTAQQLKYIKDSIKTIPDYPKAGILFRDVTSLLENPKAYSASIELLSEHYSESGVTKVVGTEARGFLFGAPVALALGVGFVPVRKPGKLPRETISESYELEYGTDTLEIHTDSIQPGDKVLVVDDLLATGGTIEATVKLIRRLGGEVVHAAFIINLPELGGEARLTQQGIHCYSLVSFDGH

SEQ ID NO: 14891 - protein, 205 aa, Triticum aestivum
  misc_feature (199)..(199): Xaa can be any naturally occurring amino acid
LSGLISFGRGMGKPAPSGSPAKTSSAEYKKQGREMSSPVPEKTSTSGGCGKGSSALSTKGKKRSEEERGSEGNVKKSKHESCSPTSSSPKGQVTKVKLGHKITALQQMVSPFGKTDTASVLYEAINYIKWLHEQVQLLSDPYMKSCSSKDYKPWVRSDGMEKEDAETDLKSRGLCLVPLSRTPQVYMDSNGPDYWTPPXRSCLFQ

SEQ ID NO: 14892 - protein, 103 aa, Zea mays
MSGRGKGAKGLGKGGANRHLKVLRDNIQRITNPPIRTLARRGGVKRISGLISQETHGVLTIFLENTILNSITYTEHARRKTATAMYVVYALNRQGPTLYRFRG

SEQ ID NO: 14893 - protein, 367 aa, Saccharomyces cerevisiae
MSISSKIRPTPRKPSRMATDHSFKMKKFYADPFAISSISLAIVSWVIAIGGSISSASTNESFPRFTWWGIVYQFLIICSLMLFYCFDLVDHYRIFITTSIAVAFVYNTNSATNLVYADGPKKAAASAGVILLSIINLIWILYYGGDNASPTNRWIDSFSIKGIRPSPLENSLHRARRRGNRNTTPYQNNVYNDAIRDSGYATQFDGYPQQQPSHTNYVSSTALAGFENTQPNTSEAVNLHLNTLQQRINSASNAKETNDNSNNQTNTNIGNTFDTDFSNGNTETTMGDTLGLYSDIGDDNFIYKAKALYPYDADDDDAYEISFEQNEILQVSDIEGRWWKARRANGETGIIPSNYVQLIDGPEEMHR

SEQ ID NO: 14894 - protein, 429 aa, Mycobacterium tuberculosis CDC1551
MVAGEFRLLSHLCSRGSKVGELAQDTRTSLKTSWYLLGPAFVAAIAYVDPGNVAANVSSGAQFGYLLLWVIVAANVMAALVQYLSAKLGLVTGRSLPEAIGKRMGRPARLAYWAQAEIVAMATDVAEVIGGAIALRIMFNLPLPIGGIITGVVSLLLLTIQDRRGQRLFERVITALLLVIAIGFTASFFVVTPPPNAVLGGLAPRFQGTESVLLAAAIMGATVMPHAVYLHSGLARDRHGHPDPGPQRRRLLRVTRWDVGLAMLIAGGVNAAMLLVAALNMRGRGDTASIEGAYHAVHDTLGATIAVLFAVGLLASGLASSSVGAYAGAMIMQGLLHWSVPMLVRRLITLGPALAILTLGFDPTRTLVLSQVVLSFGIPFAVLPLVKLTGSPAVMGGDTNHRATTWVGWVVAVMVSLLNVMLIYLTVTG

SEQ ID NO: 14895 - protein, 402 aa, Pseudomonas syringae pv. phaseolicola 1448A
MADQGSPRRFARIDRLPPYVFNITAELKMAARRRGEDIIDLSMGNPDGATPPHIVEKLITVAQREDTHGYSTSRGIPRLRRAISNWYKKRYEVDIDPESEAIVTIGSKEGLAHLMLATLDQGDTVLVPNPSYPIHIYGAVIAGAQVRSVPLVPGVDFFDELEKAIRGSIPKPKMMILGFPSNPTAQCVELDFFERVVALAKQYDVLVVHDLAYADIVYDGWKAPSIMQVPGAKDIAVEFFTLSKSYNMAGWRIGFMVGNPELVNALARIKSYHDYGTFTPLQVAAIAALEGDQQCVLDIAEQYRQRRNVLVKGLHELGWMVENPKASMYVWAKIPEAYAHLGSLEFAKKLLAEAKVCVSPGIGFGEYGDDHVRFALIENQDRIRQAVRGIRSMFRADDKLKS

SEQ ID NO: 14896 - protein, 865 aa, Burkholderia thailandensis E264
MLSRTPRRALVFRPPRGGAPPRLSRLPFASPRPPLASPFSPFSPFSPFSPFSPFSLSSLSSHASRLSRRPRPSPARSRLCDEPYPPRRHARRSGAARAIAPERARRHPRACPRAFIRMTPFPRYPPGGVARRRCRARRHHASRPTSLRPPPLRRSRPTPKQGSDNMTNQNRRDFLRLAAGTAGAAALQLFPPVIREALAIPANRRTGTIRDVEHIVILMQENRSFDHYFGKLRGVRGFGDPRPLTLQNGKPVFHQPVLLGPAELLPFHPDASNLGMQFLQDLPHGWQDTHGAWNKGRYDRWIANKGTTTMAYLERGDIPFHYQLADAFTICDAYHCSIPSSTDPNRYYMWTGYVGNDGAGGGPVLGNEEAGYGWSTYPETLEQAGVSWKIYQDIGTGLDAAGSWGWTQNPYIGNYGDNALLYFNQYRNAQPGSPLYDKARTGTNVSAGGTLFDVLQQDVKNGTLPQVSWICAPEAYSEHPNWPANYGAWYVEQVLKALTSNPDVWSKTALFITYDENDGFFDHVAPPFAPQSRDNGLSTVSTAGEIFPGDAAHMAGPYGLGPRVPMLVVSPWTKGGWVCSQTFDHTSLLQFIEARFNDRYPVRAPNVTPWRRAVCGDLTSAFNFSSPDGSWPQLPDTSGYAPPDRNRHPSYVPVPPVAQSMPKQEAGLRAARALPYELFVLGRIDQSTGKFKLTFANTGRAGAAFQVTAGNRVDGPWAYTVEARKRLSDEWSTALTLSLYDLTVYGPNGFLCQFRGSTAAALGLNANPEVIYGYDVANGNITLRLSNRGRATVRLTVANAYGKESPRVYELKPGQRINDYWDLRDSHSWYDLTVSDGAPNGFLRRFAGHVETGRPSTSDPLIATV

SEQ ID NO: 14897 - protein, 449 aa, Oryza sativa
  misc_feature (226)..(226): Xaa can be any naturally occurring amino acid
MAGLQVTGMNIHIVVVAKHGQEVTELVAPHRETAQAPLCQFGRGLRVKSQALSVCGKIVCPEETRDTDDVYRFGPLGSVIPYSCVFGGSVILPVMVGMKPGIHLTRANVPSLRDRIKERAALRCMQRDTLDQTAINAVRRDESAISDLAGYGFEEEDYPVVDYESDLQTAMSTTGGGGGDSSGGGGGEAPRPSRYESQKRRDWHTFGQYLRNHRPPLELSRCSGAXVLEFLRYLDQFGKTKVHAAGCPFFGHPSPPAPCPCPLRQAWGSLDALVGRLRAAFEEHGGRPEANPFGARAVRLYLREVRDSQAKARGIAYEKKRRKRPPTSSSSSQAAAAAAAATSPASPAASPTPPPPPPTERSADVRPMPPEGHFFIPHPHFMHGHFLVPGGDADHHHQVSNAGNGGNTNTNTNTNTGGGGGNGDEMAVAMAAVAEAHAAGCMLPLSVFN

SEQ ID NO: 14898 - protein, 297 aa, Halobacterium sp. NRC-1
MGEDVGQNGGVFRATEGLYEEFGDDRVIDTPLAESGIIGSAVGMAAYGLKPVPEIQFSGFMYPGFDQVVSHMSRLRTRSRGRFTLPMVLRAPMGGGIRAPEHHSESKEAFYAHEAGLKVAMPSTPYDAKGMLIASIRDPDPVVFLEPKKIYRAFREDVPDDPYEVELGDAAVRTEGEDVSVFTWGAMTQPTVEAAENLDRIDVEVVDLRSLSPIDFDTIIESFKKTGRAAIVHEAPNTGGLGAEITATIQEEALLYQEAPVERITGFDVPFPLAALEDYYLPEPARIAAGIEEAFDF

SEQ ID NO: 14899 - protein, 242 aa, Brassica napus
KVSDGTSSLAKTSGSRLDFMESGKSSIYRGSTSSDISDESSCSSLSSTVNKPHKANDLSWEAIQAVRARDGVLGLSHFRLLKRLGCGDIGSDYLSELKGTKCYFAMKVMDKTSLASRKKLLRAQTEREILQSLVHPFLPTLYTHFETEKFSCLVMEFCPGGDLHTLRQRQPGKHFSEQAVKFYIAESLLAIEYLHMLGIVYRDLKPENVLVREDGHIMLSDFDLSLRCLVSPTLVKSTAIES

SEQ ID NO: 14900 - protein, 633 aa, Oryza sativa (japonica cultivar-group)
MAVAVPDHTFNNGYSSKNQIEGRSLSWKRVFVQTDKGSVLGIELERGENAHTVKKKLQLALNIPTEESSLTCGDQLLNNDLSYICNDSPLLLTRNHMHRSCSTPCLSPNGKDVQHCDDSRVIEIVGCTSPSARMKQLVDDIVRGIEKGIEPVAISSGMGGAYYFRDMWGEHAAIVKPTDEEPFGPNNPKGFVGKSLGLPGLKKSVRVGETGSREVAAYLLDHKNFANVPPTMLVKITHSVFHMNEGVDYKTKSSDNKTQAFSKLASLQEFIPHDYDASDHGTSSFPVSAVHRIGILDIRIFNTDRHAGNILVRKLYNDASRFETQTELIPIDHGLCLPESLEDPYFEWIHWPQASIPFSEEDLEYITNLDPIKDAEMLRMELHTIHEASLRVLVLSTTFLKEAAACGFCLSEIGEMMSRQFTRKEEEPSDLEVLCMEARNWVEEREWLLPQADFEGEDDNESTQFDLDSEDDSTTFEASFSNNIRPIKGNSRDPPSKLAEVNEYVDEDDNNEFNKDDVGTCTSPITTWTPSTSNLSISSNELSFSGRRKSHSGVAKNKVTSKINSNSYSGNHSAKEKLPHNSSFAKLSDLSANKWSPFLEKFQDLLQSMFQDRKQTAGRNPWLTQRLGTSCQF

SEQ ID NO: 14901 - protein, 676 aa, Salinibacter ruber DSM 13855
MATDLLEETDIETQTINTIRFLSADAVQRAESGHPGTPMGLAPVAYVLWTRHLRHNPRDPDWPGRDRFVLSAGHASMLLYSLLHLTGYDLPMEELKGFRQWGSRTPGHPEAHLTPGVETTTGPLGQGFANGIGMAIAEQLLADEFNEEGFPLFDHHTYAICSDGDLMEGISQEAASLAGHLGLGKLVYFFDDNDITIDGSTDLAFTEDVAARFEAYGWHVAHVEDANDLEAVDRAIEEAKAETERPSLIRVQSHIGYGSPNKQDTAAAHGAPLGEEELRGAKENLGWPPGETFYVPDAVYDHMRAAKTEGQEAQREWEALREAYEEAHPGQAARLKRWMNRELPEGWEEALPAFEPTADTGEELATRKASGLTLEALAPEVGYLIGGSADLTGSNKTDVEGRGDFQKDSRSGRYFRFGVREHAMAGLSNGMALHGGIQPYAGTFLIFSDYLRPSLRLSALMEQPVVYVFTHDSIGLGEDGPTHQPVEHLMALRAIPGATLIRPADANEAARAWAAAVTRTGGPTALALTRQTLPIVDRTELTTAEGLHRGAYILREAAGQPGVILMGTGSEVQHALQAARALEKDGIQAQVVSMPSWELFEEQSETYRRKVLPPSVEARVSIEAGVTQGWERYVGPEGTAIGVDRFGASAPGETVMEKYGLTAERVAEEARSLVRG

SEQ ID NO: 14902 - protein, 474 aa, Halobacterium sp. NRC-1
MVVGDISTGTDVAVVGAGPGGYVAAIRAGQLGLDVTLVEKDAYGGTCLNYGCIPSKAMITASGVAHEAGHAEEMGVYADPDVDVAEMVDWKDGVVDQLTGGVEKLCKANGVNLIEGRAEFAGSDKLRVVHGGDGQGSETIEYEHAIVSTGSRPIEVPGFDFGDDPVLDSRQALAMAELPSSMVIVGGGYIGMELSTVFAKLGVDVTVVEMLDGILPQYGDDIARPVRQRAEELGIDFHFGLAADSWTDTDDGIVVTAADEDGEETEFETEKVLVAVGRQPVTDTLNLDAVGLEPNDDGRLETDHEARTDVENVFAIGDVAPGPMLAHKASKEGEVAAEVIAGEPAALDYQAVPAAVFTDPEIGTVGLTEDDAAAQGFDPVVGTFPFNASGRALTTGHDDGFVEVVADEESGFLLGAQIVGPEASELVAELGLAIEMGATLEDVASTIHTHPTLSEATMEAAEHALGHAVHTLNR

SEQ ID NO: 14903 - protein, 578 aa, Nicotiana tabacum
MGNTCVGPSISKNGIFQSVSAAMWRSRSPDDTASTTNGESARIETPISVKEPDSPLPVQEPPEQMTMPKSEKKEEEKEQPKKPKKPAEMKRVSSAGLRTDSVLQKKTGNLKEFFSIGKKLGQGQFGTTFKCVEKATGKEYACKSIAKRKLLTDDDVEDVRREVQIMHHLAGHPHVISIKGAYEDAVAVHVVMEFCAGGELFDRIIQRGHYTERKAAELTRTIVGVVEACHSLGVMHRDLKPENFLFVDQKEDSLLKAIDFGLSIFFKPGDRFTDVVGSPYYVAPEVLRKRYGPEADVWSAGVIIYILLSGVPPFWAENEQGIFEQVLHGDLDFTSDPWPSISEDAKDLMRRMLVRDPRRRLTAHEVLCHPWVQVDGVAPDKPLDSAVLSRMKQFSAMNKLKKMALRVIAESLSEEEIAGLKEMFKMIDTDNSGQITFEELKDGLKRFGSNLKESEIYDLMQAADVDNSGTIDYGEFIAATLHMNKIERQDHLFAAFCYFDKDGSGYITADELQQACEEFGIGDVRMEEMIREADQDNDGRIDYNEFVAMMQKGNPVLGGGKKGLEHSFSIGFREAVKL

SEQ ID NO: 14904 - protein, 357 aa, Xanthomonas campestris pv. vesicatoria str. 85-10
MSKQILILPGDGIGPEIMAEAVKVLKRIDAQHGLGFELVYDELGGAAYDKYGSPLADETLERARAADAVLLGAVGGPQWDTIDPSLRPERGLLKIRSQLGLFANLRPALLYPQLADASTLKPEVVAGLDLLILRELTGGIYFGQPRGNRTLDNGERQAYDTLPYSESEIRRIAKAGFEMARLRGKKLCSVDKANVLASSQLWRAVVEEVAKDYPDIALSHMYVDNAAMQLVRAPKQFDVIVTDNMFGDILSDQASMLTGSIGMLPSASLDANSKGMYEPCHGSAPDIAGKGIANPLATILSVAMMLRYTFAQADAADAIERAVGKVLDQGLRTADIWSEGTTKVGTVAMGDAVVAAL

SEQ ID NO: 14905 - protein, 436 aa, Haemophilus influenzae R2866
MAKIVKVIGREIIDSRGNPTVEAEVHLEGGFVGLAAAPSGASTGSREALELRDGDKSRFLGKGVLKAVAAVNNEIAQAIVGKDATNQAEIDQIMIDLDGTENKSNFGANAILAVSLANAKAAAASKGLPLYAYIAELNGTPGVYSMPLPMMNIINGGEHADNNVDIQEFMIQPVGAKTLREALRIGAEVFHNLAKVLKSKGMSTAVGDEGGFAPNLASNADALACIKEAVEKAGYVLGKDVTLAMDCASSEFYNKENGMYEMKGEGKSFTSQEFTHYLEELCKEYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 14906 - protein, 215 aa, Corynebacterium efficiens YS-314
MDRSETKITRKKETMIRIGIGGPVGAGKTQLIERITRALDGTLSMAAITNDIYTIEDAKILARNGILPTERIIGIETGGCPHTAIREDTSMNEAAARQLREKFPDLDLLFIESGGDNLSATFSPELVDFSIYIIDVAQGEKIPRKAGQGMIKADLFVINKTDLAPFVGADLSVMVKDTHEFRGQRPYALTNLRTDEGLEEILAWIRRDVLMSDLA

SEQ ID NO: 14907 - protein, 581 aa, Nicotiana benthamiana
MGNTCVGPSISKIGLFQSVSAAMWRTRMPDDSGSTTNGDSARGETAESSKDPNLVVPSKPPEQITMPKSDQKEEEPAKKEEGPEKPKKPVQMKRVGSAGLRTDSVLQKKTGNLKEFFSIGKKLGQGQFGTTFKCVEKATGKEYACKSIAKRKLLTDDDVEDVRREIQIMHHLAGHPNVISIKGAYEDAVAVHVVMEYCAGGELFDRIIQRGHYTERKAAELTRTIVGVLEACHSLGVMHRDLKPENFLFVNQKEDSLLKTIDFGLSIFFKPGDRFNDVVGSPYYVAPEVLKKRYGPEADVWSAGVIVYILLSGVPPLWAENEQGIFEEVLHGDLDFSSDPWPSISEDAKDLVRRMLVRDPKKRLTAHEVLCHRWVQVDGVAPDKPLDSAVPSRMEQFSAMNKLKKMALRVIAESLSEEEIAGLKEMFRMIDTDNSGQITFEELKVGLKRVGANLKESEIYDLMQAADVDNSGTIDYGEFIAATLHFNKIEREDHLFAAFSYFDKDCSGYITADELQQACEEFGIGDVHLEDMIRDADQDNDGRIDYNEFVAMMQKGNPVIGGGKKGLEHSFSTGFREALRL

SEQ ID NO: 14908 - protein, 259 aa, Triticum aestivum
MEMSGVSAVDSPGSGSASSALGAPRPSRYESQKRRDWQTFGQYLRNHRPPLELARCSGAHVLEFLRYLDQFGKTKVHTAGCPFFGHPSPPAPCPCPLKQAWGSLDALVGRLRAAFEEHGGRPEANPFGARAVRLYLRDVRDGQAKARGIAYEKKRRKRHPQTSSKQKQQAAAASAAASPAPVDRPDMRHGMLEQTHYLFPMHAHLFQGHFLALAPDGDPVGALDGVVPAGDDIVMVMAAAAAAAEAHAAGCMMPLSVFN

SEQ ID NO: 14909 - protein, 423 aa, Legionella pneumophila subsp. pneumophila str. Philadelphia 1
MTQKTAKLSIDGQETIDLPIYTPTLGNDVIDITQLGSHGVFTFDQGFLSTASCESKITYIDGDKGILLYRGYPIEQLAEKKDFLDVSYLLLNGELPNKEEKKAFVSLINNHTMVHQQMYQFLNGFRRDAHPMAIMVGIVGALSAFYHESMDLNNAQDRFISAIRLVAKMPTLAAMSYKYSIGMPYMYPKNKMSYAENFLHMMFGVPSEDTTPDPVLVRAMDTIFILHADHEQNASTSTVRLAGSTGANPFACISAGIGALWGPAHGGANEACLNMLKEIGDVSRIDHYIKRAKDKNDPFRLMGFGHRVYKSYDPRAKVMRKTCYDVLEAVGAKDAPLFKLAMELERIALEDEYFIEKKLYPNVDFYSGLTLSAIGIPTNMFTVIFALARTVGWMSHWMEMVATKSRIGRPRQLYTGEKIRDVK

SEQ ID NO: 14910 - protein, 488 aa, Burkholderia sp. 383
MQTQLFIDGRFVDAVDRGTIDVLNPHDGSVITKIAAATAADVDLAVEAATRAFPKWSALPAAERGRLLLRLADAIEANAEELAQLESLDTGHPIRDSRALDVPRTAACFRYFGGMADKLQGSVIPVETGFLNYVQRAPIGVVGQIVPWNFPLMFTSWKMGPALAAGNTVVLKPSEITPLSTLRIVELMAEVGFPAGVVNIVPGYGHTAGQRLAEHPGVGKIAFTGSTATGRRIVEASQGNLKRVQLELGGKGANIVFDDADLDAAINGAAWAIFHNQGQACIAGSRLVLHERIADAFLERFVALASSIRIGNPLDANTEMGPLTSKQHLDRVLSFVDVAREQGGRVLTGGSAPQDPALANGYYVRPTVIEAKSAADRVAQEEVFGPFVTVLRFGSDDEALAIANATEYGLGSGLWTKDLSRAHKMASQINAGMCWINCYKRVNPGSPFGGVGQSGYGREMGFEAMHDYTEARSVWVNVDGNVPPHFKR

SEQ ID NO: 14911 - protein, 187 aa, Arabidopsis thaliana
MHTWKNQIFSDSQFVLLFMGKNCSIIFPEPHLFISHVFIIHLNVLFLVKKINKNNLRFVGSTSGQSQLVCSGCRNLLMYPVGATSVCCAVCNAVTAVPPPGTEMAQLVCGGCHTLLMYIRGATSVQCSCCHTVNLALEANQVAHVNCGNCMMLLMYQYGARSVKCAVCNFVTSVGGSTSTTDSKFNN

SEQ ID NO: 14912 - protein, 409 aa, Oryza sativa (japonica cultivar-group)
MALHAAPPPPPPFTAGRLPTTSRRPCFSAGRIFRCSLPAAAARPRNAAFLAPLRTSSAARSGSQALPKGWDTAAGVVEIDGTPGTSSSPHVVCFGELLIDFVPTVNGVSLAEASAFKKAPGGAPANVAVGIARLGGSSAFIGKVGDDEFGYMLADILKENNVNNQGLLFDAHARTALAFVTLRNDGEREFMFYRNPSADMLLEEKELDLDLIRKAKIFHHGSISLITEPCKTAHIAAAKAAKDAGVLISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 14913 - protein, 439 aa, Bacillus cereus ATCC 10987
MAVENITMPQLGESVTEGTISKWLVNVGDHVNKYDPLAEVMTDKVNAEVPSSFTGIVKELIASEGDTLAVGEVVCVIQVEGADEVAATAVEEKTKEEPKAEVATPEKAPKAKQPTDGKPRFSPAVLKLAGEHNVDLDQVEGTGANGRITRKDILKLVESGNIPQAGAAKKEEAVAAVVEARPEAPKAAPVAQKVESAKPVSVPTMPGDIEIPVTGVRKAIAANMLRSKHEAPHAWMMIEVDVTNLVSYRNSIKGDFKKREGFNLTFFAFFVKAVAQALKEYPQINSMWAGDKIVQKKDINLSIAVATEDELFVPVIKHADEKTIKGIAREITELAGKVRTKSLKADEMQGGTFTINNTGSFGSVQSMGIINYPQAAILQVESIVKRPVIMDNGMFGARDMVNLCLSLDHRVLDGLICGKFLGRVKEILENTSENNTSVY

SEQ ID NO: 14914 - protein, 361 aa, Mycobacterium avium subsp. paratuberculosis K-10
MSQTVRGVISRKKGEPVELVDIVVPDPGPGEALVDVIACGVCHTDLTYREGGINDEYPFLLGHEAAGRVEAVGPDVTAVQPGDFVVLNWRAVCGQCRACKRGRPHLCFDTFNATQKMTLTDGTELTPALGIGAFADKTLVAAGQCTKVDPAADPAVAGLLGCGVMAGLGAAINTGAVARDDTVAVIGCGGVGNAAIAGAALVGARRIIAVDTDDTKLDWARGFGATHTVNARQADVVAAIQDLTDGFGANVVIDAVGRPETWKQAFYARDLAGTVVLVGVPTPDMTLEMPLVDFFSHGGSLKSSWYGDCLPERDFPTLIELYLQGRLPLEKFVSERIGLGDVEAAFHNMHDGKVLRSVVML

SEQ ID NO: 14915 - protein, 500 aa, Xylella fastidiosa 9a5c
MDGWVVVAVALMVPQARCMMSFACVGLGGEERRGIARDAGIFWCVARGITDTGGVSDGRLPVLAGVGTAWRCSQAVAVIGGRLVGWTLGVYLLPDEPGQWRFVSIKEIEMSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLEHPVKPLLAIVGGSKVSTKLELLSNLVNNVEQLITGGGIANTFLAAAGYSIGKSLYEGDLIETAREIITAAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 14916 - protein, 471 aa, Frankia sp. EAN1pec
MREYLKFYIGGQWAEPAEQRTFDVVNPATEQVAGRVALGSATDVDRAVAAARAAFPSWSATSREERIAVLESILDVYQKRAGDLATALTEEMGAPAALANGFQVGLGAGHLTTAIEILKNFSFEEQRGVTRVVLEPIGVCGLITPWNWPINQIAVKVLPALATGCTVVLKPSEESPFTGQILAEIFEAAGVPAGVFNLVQGDGPSVGVPLSAHPDVDLISFTGSTRAGIEIAKNAAPTVKRVTQELGGKSPNIVLDDQDFAENVAKGVINMMGNSGQTCTAPARLLVPSARMEEAISAAREAAAQVTVGDPNGEFTIGPVASGRQFEKIQGLIQQGIDEGATLVAGGTGRPDGLETGFYVKPTVFADVTNDMIIGREEIFGPVLTIHGYDSVDHAVELANDTEYGLAGYVAGADLDAARAVARRIRAGWVAINDGFDFGGPVGGYKKSGNGREWGEFGFHEYLETKGIHGY

SEQ ID NO: 14917 - protein, 203 aa, Triticum aestivum
AGGGGVEPARSLEIAAKLLAARDLVGCKRFAEHAVDADPLLPGADELLAVADVHLAAQRLLPSGRPDPLAILQLQPNPDSADVKRAFRRLANLLAPRRNPHPGADTALRAVEEAFAHLSESTSTGAAPAPAVPGGASAAEDTFWTVCPHCCHVHHYQRLLVGRSLMCASAGCRRAFVPTELPAVPPIVPGTDSYYCAWGFIPK

SEQ ID NO: 14918 - protein, 478 aa, Oryza sativa (japonica cultivar-group)
MTSLPDRGVSSSSSDPLCEGNIAPCSSSSEQKEDCSLKQSKTSILSCVFNSPFNIFEAHQDSSANKSPKSSSGSYDWSRVLRRIVCSGSMWRFLGTSKVLTSSDVWFLGKCYKLSSEESSSDSDSESGHATFLEDFSSRIWITYRRGFDAISDSKYTSDVNWGCMVRSSQMLVAQALIFHHLGRSWRRPLEKPYNPEYIGILHMFGDSEACAFSIHNLLQAGNSYGLAAGSWVGPYAMCRAWQTLVRTNREQHEVVDGNESFPMALYVVSGDEDGERGGAPVVCIDVAAQLCCDFNKGQSTWSPILLLVPLVLGLDKINPRYIPLLKETFTFPQSLGILGGKPGTSTYIAGVQDDRALYLDPHEVQMAVDIAADNIEADTSSYHCSTVRDLALDLIDPSLAIGFYCRDKDDFDDFCSRATELVDKANGAPLFTVVQSVQPSKQMYNQDDVLGISGDGNINVEDLDASGETGEEEWQIL

SEQ ID NO: 14919 - protein, 145 aa, Oryza sativa (japonica cultivar-group)
MVHGKLEVLLVCAKGLEDTDFLNDMDPYVILTCRTQEQKSSVAKGAGSEPEWNETFVFTVSDDVPQLNVKIMDSDAFSADDFVGEANIPLEPVFLEGSLPPAVHRVVKEEKYCGEIKVALTFTPAAETRHHHNHENEGEGYSSWN

SEQ ID NO: 14920 - protein, 451 aa, Thermus thermophilus HB8
MPKEILMPELAESVVEGEILKWLVEEGDYLKKDQPFVEVMTDKVTVELPSPYEGVLLKKLAKEGEVVKVHAPIALIAEPGEAVEGVKEAPPVQAVEERSIVEPGLPAKEEKEDLSLFKPDPTQVAVKNPFLSGEKPQEGARPGRVLAVPAARKLARELGIPIEEVPGSGPLGRVRVEDVRAYAERRKAPPERPEEGPQVLPAGFPPPPKYAPPKGYEHLEERVPLRGIRRTIAQGLWQSHLYTVRTLNVDEADLTELVRLRERLKPQAEAQGVKLTYLPFIVKAVVRALKKFPMLNTSLDEERQEIVYKRYYHIGLAVATERGLIVPVVRDADRKSVLELAQEIAELSQKAREGRLAPEEVTGSTFTITNIGSVGATLSFPIIHLPDAAILGVHSIRKRPWVMPDGSIRPRDIMFLSLSFDHRLVDGAEAAMFTREVIRLLENPDLLLLEM

SEQ ID NO: 14921 - protein, 464 aa, Thermus thermophilus HB8
MTPMKTYDLIVIGTGPGGYHAAIRAAQLGLKVLAVEAGEVGGVCLNVGCIPTKALLHAAETLHHLKVAEGFGLKAKPELDLKKLGGWRDQVVKKLTGGVGTLLKGNGVELLRGFARLVGPKEVEVGGERYGAKSLILATGSEPLELKGFPFGEDVWDSTRALKVEEGLPKRLLVIGGGAVGLELGQVYRRLGAEVTLIEYMPEILPQGDPETAALLRRALEKEGIRVRTKTKAVGYEKKKDGLHVRLEPAEGGEGEEVVVDKVLVAVGRKPRTEGLGLEKAGVKVDERGFIRVNARMETSVPGVYAIGDAARPPLLAHKAMREGLIAAENAAGKDSAFDYQVPSVVYTSPEWAGVGLTEEEAKRAGYKVKVGKFPLAASGRALTLGGAEGMVKVVGDEETDLLLGVFIVGPQAGELIAEAALALEMGATLTDLALTVHPHPTLSESLMEAAEAFHKQAIHILNR

SEQ ID NO: 14922 - protein, 1136 aa, Zea mays
  misc_feature (598)..(598): Xaa can be any naturally occurring amino acid
MTGAREPVAMEIPAEEGPAAARAPPRRIRRRLVEGARGGGAPASVEEIEARLREAELRRQQFREWLACKARKKPRSPSWSSQEEDHGQRLEAKLLAAEQKRLSLLAKAQNRLAKLDELRQAAKNDVEMRFEKEREELETRVESRVRQAEENRMRLLHADMQKRAALKERTARSLVQKAKSESKYMEQVRSAISLKRAAAEKKRLRLLEAEKTKAQARLLRIQKAAMTVCSRRESERRKLKEQLDNKLQRAKRQRAEYLKQRGSPRGSTHADYLKHAYALSRKLARYWRIFVKSRKTTFALAQAYDALGINEKSVKNMPFEKLAMSMESPVVLRSTKALLDRLEKRLVISHSVASSSVENVDHLLKRLGSPPRRRAPPSREGKTRAVVKRPAKSSEASIKLPRYSLRVVLCAYMILAHPSAVLSGQGEREKQLIESAANFIKEFELLIKVILDGPGQSSGVTGQRKFRAQLANLDKAWCSYLYSFVVWKVKDARLLEEDLVRAACKLELSMMQTCKLTADRHSQNNLTHDMKAIQKQVIDDQKLLRDKVQHLSGDAGLERMNSALSDTRSKFFEAKENGSPLTAPVANVSTPSKDARVXSSGKAPLSEVPESSRTNVVGTSSVVRSLFSASSSSVSSSPEKQPTENEKMVNEMLHEDASALAGRSDSASTAEEEFQNKVRETMEKAFWDMVTNSMRGERPDYSQLINLVKEVRDSLHDLAPKEWKEKILENIDLEILSQVLGSGSQDAQYLGQILEYSLDMVRKLSAAAKEDEMKKNHDKLLSELSTNSEVNGDGINSFVIAVIKGLRFILEEIKELKAEVSKARIQMMQQIIKESAGVEYLQKAFADRYGPPETAPASLPLTLQWILTSKNIAEEEWSEHSDCLSVMPAAGQAPALVPVLRSGHGAPVGQPSPSAGDTSGQPECKGEKLDKLIRIGLLQLIGSVEGLQLQSTPESFQINLLRLRAVQSQFQQVIVIATSMLVLRQILMSENSRATPLELENAISELVKALADILDSSPDSGTEEIVQAMVNASASVGSPSEEKVQARMQMITRVFLKSLQPGDVVFKKVSRAVYCAFRGIILGGSGPKGQKLADAALRRIGAIKVVDRVLKAAEVLIKVATVSEKVHGPWYKALIV

SEQ ID NO: 14923 - protein, 746 aa, Salinibacter ruber DSM 13855
MIQASAVPQKSEIEIDPKYEERLEELLLCCRTHLPTVDENMIRRAFRLSYWAHRNDWRESGEKYVSHPLRVATIVARDIGLDDTSVAAALLHDVVEDTELSLDLIRDEFGDTMATIIDGLTKIEGVFSSQKLGQAENVRKLMLSMASDLRVILVKFADRLHNMRTIEALPKKKQLQKASETQELFAPLAHRFGLFKIKSELEDLSFKVLDPEAYTHIVDRLEEMAEQREAYIAGFIEPLAEHLEEEGFEFDIKGRVKNVYSIHRKMERKNKPIDEIYDIFAIRVILQSGGRKGKEDCWRVYSLVTDLYKPLPERFRDFISVPKSNGYQSLHTTVFGPGGRRVEVQVRTQEMHEVAERGVAAHWKYKEGTENVDEEMERFLEWVRDLLENPEPEEATEFVKEFRLNLYDEEIYVFTPQGDLLTLPQGATPVDFAFKVHTEVGMQCLGAKVNGKMVPLSQELESGDQVEVITSEKQNPSPDWINFVVTHKARSRIRKWTNEERRKAVELGKEIWGKTKDQADLEISDQDLQEVAHELKFPDLQQLFYEIGKGLYDPDELVDYIKGNTQTEEKTVEEFDEESLREQYEQFLDAAQETEKQALVIDGEVQKDLAVNYASCCNPIPGDEVFGFVSKTGTVNIHRSNCRNASDLLVNKADRILDVDWSHQKDVQFVAALRLMGEDRVGMVNDITTVISKNLKTNIRSITIDTEDGIFSGTIMLHVSDLEHLQRLIERLKRIDGIQGVYRFKE

SEQ ID NO: 14924 - protein, 454 aa, Haemophilus influenzae R2866
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEHYFENFIEDVESGVVKPAAVILEAIQGEGGVVPAPISFLQKVREVTQKHGILMIVDEVQAGFCRSGRMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQSKDATGAYPRDCELAAAIQKACFKNKLLLERGGRGGNVVRVLCAVNINQNECEEFIKRFKQSVADALKVVRS

SEQ ID NO: 14925 - protein, 445 aa, Bacteroides fragilis YCH46
MNIEKIMSSLEAKHPGESEYLQAVKEVLLSIEDIYNQHPEFEKSKIIERLVEPDRIFTFRVTWVDDKGEVQTNLGYRVQFNNAIGPYKGGIRFHASVNLSILKFLGFEQTFKNALTTLPMGGGKGGSDFSPRGKSDAEIMRFCQAFMLELWRHLGPDMDVPAGDIGVGGREVGYMFGMYKKLTREFTGTFTGKGLEFGGSLIRPEATGFGGLYFVNQMLQTKGIDIKGKTVAISGFGNVAWGAATKATELGAKVVTISGPDGYIYDPNGISGEKIDYMLELRASGNDIVAPYADEFPGSTFVAGKRPWEVKADIALPCATQNELNGEDAKNLIDNNVLCVGEISNMGCTPEAIDLFIEHKTMYAPGKAVNAGGVATSGLEMSQNAMHLSWSAAEVDEKLHSIMHGIHAQCVKYGTEPDGYINYVKGANIAGFMKVAHAMMGQGII

SEQ ID NO: 14926 - protein, 259 aa, Legionella pneumophila subsp. pneumophila str. Philadelphia 1
MMTLITGATRGIGLALAYEFASHGHDLILIGRDSEQLEHISKQLNTQYQVNVEYKVHDLSKPGSAFKLYTDLKEQGVEVNCLVNNAGIGYMGSFVEMGMNKLDDLMNINMISLSELTLCFLHDFVARNEGSVLQVSSTAAFQPGPFMAAYYASKAYVATLSHAIAYELKDTKVSMSILCPGATKTNFFHASGMESSMLERGYIGMMTPEKVAKIAYKGLKKGKLYIIPGLRNKILAYAAAISPKAIALRIASYLHHKIL

SEQ ID NO: 14927 - protein, 473 aa, Bacillus cereus ATCC 10987
MAKEYDLVIVGGGTGGYVAAIRASQLGLKTALVEKENLGGTCLHKGCIPSKALLRSAEVYATAKKSEEFGVIASNVELNFAKVQERKEKIVTQLHKGVQHLMKQGKIDVFEGIGRILGPSIFSPMPGTISVELASGEENEMLIPKNVLIATGSRPNSLPGLELDGEYVMSSDHALKMETLPSSIIIVGGGVIGIEWASMLADFGVEVTVLEYAKTILPLEDQDVSKEMQRLFKKKGIKVVTGAKVLPETLVKDNGVTIQAEHNGENKEFKAEKMLVSVGRQANTQNIGLENTDIVVEKGYIQTNEFYQTKESHIYAIGDVIGGLQLAHVASHEGIAAVEHIAGKEVTPIDYSMVSKCVYSSPEVASVGLTEQEAKEKGYKLKVGKFSFRAIGKALVYGESDGFVKLVVDEETNDILGVHMIGPHVTDMISEAGLARVLDATPWEVAHTIHPHPSLSEAIGEAALAVDGKALHA

SEQ ID NO: 14928 - protein, 79 aa, Glycine max
YAFLFACSFEFRLRIALGPGGDLMLTSRIRNTNSEGKPFSFTFAYHTYFSVSDIRLVLEICLFHTLSYFSNDFLFLFIN

SEQ ID NO: 14929 - protein, 514 aa, Alteromonadales bacterium TW-7
MTEHKKPLVLMILDGWGYREDEQSNAILAANTPVLDNLWASRPRTLISASGFDVGLPDGQMGNSEVGHVNLGAGRVVYQDFTRITKAINDGEFDSTPALVENIDKAVNAGKAVHVMGLLSPGGVHSHEDHIVASIELAAKRGAKEVYFHAFLDGRDTPPRSAKESIERIEALFAKLECGRLATLVGRYYAMDRDNRWNRVEKAYDVMTSGIGEFNYSDGVTALNAAYERDENDEFVAPTTITPAGREAAQINDGDTVIFANFRADRAREITRAFVEPEFDGFTKKKSPALSAFVMMTEYAADIDAPVAFGPTPLTNVLGEWLEKQGKTQLRISETEKYAHVTFFFSGGREDEFEGETRELIPSPQVATYDLQPEMNSEMLTDKLVEAIKSGKYDAIICNYPNGDMVGHSGVFDAAVKACEAVDTCIGRVVDALNEFGGEALITADHGNAEQMANLKTGQAHTAHTSEPVPFIYVGRDATPSEGKALSDVAPTMLHLMGMEQPSEMTGTPIMTLK

SEQ ID NO: 14930 - protein, 495 aa, Mycobacterium avium subsp. paratuberculosis K-10
MVTDRFDAIIVGAGFGGIGAAIQLKRLGFDNIVILDREDDLGGTWHVNHYPGIAVDIPSTTYSYWFEPNPGWSRLFAPGGEVKQYAADVADKYDVRRHMRFNTTVEGAQWDEDAEVWRVALAGGESLTTRFLITATGFLSQPHTPDIPGIGSFGGKVVHTTAWDHDYRYQGRRIAVIGTGASAVQVVPELAKEAGELTVYQRTATHVLPKVDFEFDPAVRRLFARVPAAQRALRWVTDVLLEIIMIVGALHFKESRGRGNISASDLAKINRFRWIRDKELRAKLTPDYDCGCKRPTFSNSFYRVLTQPNVHLETNPIERIEPDGIVTADGRKTVIDTLVLATGFDLWEANFPAIEVIGRKGRNLGKWWRETRFQAYQGVSMPYFPNYLSLASPFAFSGLSFFHTIEYQMRHMDRLLGEVKRRGATIFEVTEEANDRFMERMTKLLDNSVFYAGNCATSRSYYFSPSGEASLLRPTSTLNSIREASSFPLSDYVIA

SEQ ID NO: 14931 - protein, 459 aa, Bordetella parapertussis 12822
MNDLATINDLHSVVEDDRNAIWHHMLQHDALQATAPWVVVEGKGTRIRDASGKEYLDATAGGLWTVNVGYGRERIANAMRDQMLKLNYFAQSAGNVPGALFARQLVSKMPGMSRVYFSNSGSEANEKVFKMVRQISARHHAGRKYKILFRERDYHGSSIATLAAAGQPERAAQYGPFPDGFVQVPHCLEYRKQWDVANYGERAADAIEEVILREGPETVGLLCLEPITAGGGIIVPPEGYWRRVQEICRRHDVLLHIDEVVCGLGRTGKWFGYQHFDIEPDFVTLAKGTASGYAAIACTVTHERIFEQFKDEPDDPLSFFRDVSTFGGCAGSAAAALENLRILEEEGLVEHAAQVGDYLQACLRQLADKHAVIGDVRGKGLLQGVELVSDRAAKTPVSEADAKRVVAQCKAQGVLIGVITRALPGLNTTLCLAPPLILTRDEVDELCGAIDRALATVFG

SEQ ID NO: 14932 - protein, 397 aa, Salinibacter ruber DSM 13855
MTSVPSRSRRRCTCSFGPWSWGFGPLRRTIRRELSSQHGPESQMSALIYGAYGYTGQLIARAAVERGLQPVLAGRNADRLAELGAALDLPTRTVSLSDPERLRTALDGISVALHCAGPFVRTAPPMIAACLETGTHYLDLTGEVDVFRRLADRGADAEAAGCMVLPGIGFDVVPSDCLSRFVAAHTPDADILEVALYAEGTVSQGTLKTLIEQMGRGGVVRREGRLHDVPPGWTSRNVDFGDRRRGVTSIPEGSVVTSGVSTDVPNVTAYIAVPLLVQSLLRASRHVQGILTWPPLKQLLKRLVEQGRPGPSAEERQQGRTVVWASARGSEGGVTTARLHGPEAYTFTARSAVEALQRVLDGTAPAGYQTPATAFGADFALAVDGTSRQIVEEPSRA

SEQ ID NO: 14933 - protein, 582 aa, Oryza sativa (japonica cultivar-group)
MSPRVRMSVARWLPSSPAHGKTKSRRSSSAVRPTLLVIAVTVIAVLLVAVVFGGAGRWTLSGGGDTSWVSAGARVVINAVSGQQRDGDDPVAAAVEPRNDRLLGGLLSPDFDDSSCLSRYRAGLYRRQSPHAVSPHLVASLRRYESIHRRCGPGTSAYERAVERLRSPPPSNTSDAECRYLVWTPLEGLGNRMLTLTSAFLYALLTDRVLLFHHPAGEGLRDLFCEPFPGSTWTLPEGDFPFSGMQGFNARTRESLGNALRRGEGAAKDHPPPPPPWMYVHLRHDYNRNANDPRFFCDDGQDALRRVGWVVLLSDNYFVPGLFLVPRFERALSRMLPRRDAAFHHLGRYLLHPSNTVWGMVARYHASYMACANERVGIQVRSFYWARISTDELYGQIMSCAHGENILPRVTQQGPNFTAAGDQPQPAARPGRRKAVLVVSLHGAYSERIKDLYYEHGAAGGESVSVFQPTHLDRQRSGEQLHNQKALAEMMLLSFSDVVVTSAASTFGYVGHGLAGLRPWVLMSPLDKKVPDPPCRLAATIEPCFHNPPNYDCRTRAKGDTGKIVRHIRHCEDFENGVQLVD

SEQ ID NO: 14934 - protein, 359 aa, Aspergillus oryzae
MAAARTLRIGLIPGDGIGREVIPAGRKVLESLPASLNLNFSFVNLDAGFDTFKQTGTALPDKTVETLKKECDGALFGAVSSPSTKVAGYSSPIVALRKKLDLYANVRPVKSTIGGGRNPVDLVIVRENTEDLYVKEEQTKDTPNGKVAEAIKRISENASFRISSIAGEIALRRQKIRDAASTTGLRTKPMVTITHKSNVLSQTDGLFRETARKALAAERFSSVEVEEQIVDSMVYKLFRQPEYYDVIVAPNLYGDILSDGAAALVGSLGLVPSANVGDGFAIGEPCHGSAPDIEGQGIANPIATLRSAALMLEFLGEEGAAAKIYTAVDANLDEGKYLSPDMGGKASTQEVLDDVLKRL

SEQ ID NO: 14935 - protein, 287 aa, Halobacterium sp. NRC-1
MADVIDAVFDAIADAAPEVRAGLPDHRATRDDQNASGDTQLEADVWADDLLFDRTESIEGVNWYASEERDAVVTVGDAEGGYAVALDPLDGSSNVKSNNPCGTVVGIYDQPLPAPGSSLVAAGFVLYGPTTTMVVARDDTVRESLVSETGATTDLGPVELPADPTVYGFGGRVPDWTPAFESFVRDVEDDLKLRYGGAMIADVNQVLVYGGVFGYPGMESAPDGKLRAQFEALPIAYIVETAGGASSDGTQSLLDVAPTRLHERTPTFVGTDDVIAALDAALPDHTN

SEQ ID NO: 14936 - protein, 339 aa, Rhizobium leguminosarum bv. viciae 3841
MKTPQSVAVLGANGHTGRFVVAELLRRGLKPIAIGRNAERLAAAGFMERGIECREASVEDDEELDRALAGAAAIINCAGPFMDTADAVVRAALRAGIHYLDVTAEQPSVQATFERHEVAAREAGVVVIPAMGFYGGLADLLVTAVMDEWEHADDIEIRIALDSWLPTRGTRVTGERNTVRRLAVSGGQLEPVHQPPAERISTLPAPFGQQTFVEIPFSEVPLIARHVRTKELHTFLSTVALRDVRDPSTPPPQAVDEFGRSAQRFAVEVIVTQEGVRRRIIAQGQDIYAVSAPIICEAVQRILSGEIRDIGAKPPAEIFNAASFLQALGPDLSVEISET

SEQ ID NO: 14937 - protein, 319 aa, Zea mays
TRARVQRRNGDGDAAILVPFPDPLSLSFSMAAPPLVFVAAAIAALAIFVLVLVVFAFRRWWWWRRQRRPLQAAAEASTPVAVQEEDIDRPLLSENRSDHSRQSISFLGSSVGEPSKIQTNRSNTSPRSHAIADTGRIYPAECCATQGETHVINVENDTSEEFQLGSTLRRTPPPKWPTPDQKHRRRVSGDDNHNGSVPLKDNTYHSRLDLEVIAGPSHGISCSRQSSRPSMLPITLGRVPPSDLVLKDSEVSGKHAQINWNGKTLKWELVDMGSLNGTFLNSQAVHHPNAGSRHWGEPAELAHGDIITLGTSSKLSVSS

SEQ ID NO: 14938 - protein, 120 aa, Plantago major
APEVIAEYTVRALQRTMPCAVPAVVFLSGGQSEEEATINLNAMNKLKTKKPWSLSFSFGRALQQSTLKAWAGKEENIGKAQAAFLTRAKANSEATLGTYSGSSTLSEGASESLHVKDYKY

SEQ ID NO: 14939 - protein, 390 aa, Lactobacillus plantarum WCFS1
MMNTNIRIQQIQVSGIRRFDEAISQIPDIIRLTVGEPDLPTPSHVKKAAIQSIHNDWTHYSPLMGFAALQDAASHYFQQKYQLTYAPEQIIATVGASEAVATTLLTLLNPGDTVLLPTPAYTNYQPVVDIANAQLAPIDTTATGYKLTPSALQAALDDHRHDHVKALILNYPTNPTGVTYTDDELWALQAVIATAGIYVISDEIYSELTYEQPHTAFATLYPSKTITINGLSKSHAMTGWRLGFIMAPSNLITEMKKTHQYLVTSTSSITQAAGIEALTHGLDDGSEMRGVYQTRRDYVVKRLSEIGFNYIYPTGAFYIFVQLPQDFQGTSWDFATRLAHEAQVAVVPGSAFGTSGEGWFRISYAASQSALREGLNRLALWRAQTTTQED

SEQ ID NO: 14940 - protein, 289 aa, Lactobacillus plantarum WCFS1
MNLASAHLITAMVTPFDDQQHIDFHRLEQLIEHLLATGTDGLLVGGTTGEGPTLSIAEKRDLYTQTARIVAGRVPIIANTGTNDTAATIHFTHIVSQIEGIDAALVVVPPYNKPNQTGMMAHFTAIAEKSDLPIIIYNIPGRVGVKMTVTTILTLAHNPNIIGIKQCGSDEELAAIVEKAPKDFLVYTGEDAQSLTTLVLGGQGTISVASHLFGNEMATMRRALNHGDITQAGQIQRRLMPKMAALFTQPSPAPVKAALNAQHWLVGSTRLPILPLTTNEQSQLLNSLK

SEQ ID NO: 14941 - protein, 138 aa, Aspergillus oryzae
MSGEAWLYLLAVLINAVNLFLQVFFTIMYSDLECDYINPIDLCNRLNAYIIPEAAVHAFLTFLFVINGYWLAILLNLPLLAFNAKKIYDNAHLLDATEIFRKLNVHKKESFIKLGFHLLMFFFYLYSMIVALIRDESH

SEQ ID NO: 14942 - protein, 555 aa, Mycobacterium avium subsp. paratuberculosis K-10
MTTARPVKTRNEGQWALGDREPLNDTEKIKLADGPLNVRERIINVYAKQGFDSIDKSDLRGRFRWMGLYTQREQGYDGSWTGDDNTDKIEAKYFMMRVRSDGKAMSAHTMRTLGQISTEFARDTADISDRENLQLHWIRIEDVPEIWRRLESVGLQTTEACGDCPRGIHGSPLAGDSLDEVLDPSPAIEEIVRRSLNNPEYANLPRKYKTAVSGLQDVSHETHDVAFVGVEHPEHGPGLDLWVGGGLSTNPMLAQRLSVWVPLDEVPDVWEAVTQLFRDYGYRRLRAKARLKFLVKDWGIEKFREILEQEYLNRRLIDGPAPAPVKHTIDHVGVQKIKNGLNAVGVAPIAGRVSGTTLSAVADLMEQVGSDRARWTPFQKLVILDVPDDKVDELVTGLDALGLPSRPSSWRKNTMACTGIEFCKLSFAETRVRTQTLVPELERRLADVDAQLDAPISVHLNGCPNSCARIQVADIGFKGQWIDNGDGTSVEGFQVHLGGGLGEQSGFGRKLRQHKVTSEELGDYIDRVTRKYLEGRNDGETFASWALRADEEELR

SEQ ID NO: 14943 - protein, 379 aa, Candida glabrata CBS 138
MSLANLYMCSVACAINLNINFTMDSKIIKNYLLPKAIYKPGNKIGATIFNDNRTINNKLPLSLEKNANSLNIMDNTNVLKSVLKNYKCNKSLPYSSLIDKENISNESSQIHIAKENSEVDLCNTTLDNAYEYLLKLDEDTYLPDTILNEYSSLRQTRDLLLNWVIKIHQNLKLENETLYMTIDLIDKFLIKKKLPIEKFQLLGLTCLYIASKYEEVLPPSIFQFALESNGIFDSEEIKESEFNILETLNFKIGYPSPIVLLDRQLDGYLNYNEMKFMSLYLLEITFVDFRFLSYRMSMRTKAAALITLKMYNHSIKDLKTRFQKEGLMQTIEKICRYILQYLLEPTIHTELQRKYSQLASYNVADRATKYVKCLIKKYA

SEQ ID NO: 14944 - protein, 170 aa, Zea mays
MAPTVMMASSATAVAPFQGLKSTASLPIARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 14945 - protein, 333 aa, Candida glabrata CBS 138
MDMDKRVERVPLAEVRASNVLSQPVTISSSKRKLEVYDGEETPAKKVKVVDQVAIRDVATVPEYSTDIFKNLFKSEEDTIPSHNYLLDEKSEYHIRANMRAILVDWLVDVHRNFKCLPETLLLAINILDRVLSSTKVSVSKLQLVAVTSLFIACKYEEVKLPKIANFAYITDGAATVEDIREAEFNILETLRFNINWPNPLNFLRRLSQIDDYNYELRDIAKFVLEFIMCTHYFVNYKPSFLSAMAIYLSKRICNDESSNHNEGILTTWSATHTEYSGGINPNNDPKFNDSLNVLIDEFKQPSNSTKSLLAKYKANTYHGMFFRVQDWCLNYI

SEQ ID NO: 14946 - protein, 572 aa, Bacillus licheniformis ATCC 14580
MLELKGIGASAGIAIAKAYRLEEPDLTVEKKNISDSDAEVNRFEDAIERSKKELETIKNHALKELGEDKAEIFSAHLLVLSDPELLNPIKDKIKSDSVNAEFALKETADMFVTMFESMDNEYMKERAADIRDVTKRVTGHLLGVEIPNPSLISEEVIIVAEDLTPSDTAQLNRNFVKGFTTDIGGRTSHSAIMARSLEIPAVVGTKAATKGIQNGVTVIVDGINGDVIVDPSQETISEYEEKHQAFLAQKAEWAKLVNEPTVTSDGHHVELAANIGTPDDVKGVLENGGEAVGLYRTEFLYMGRDQLPTEEEQFDAYKTVLERMEGKSVVVRTLDIGGDKELPYLELPKEMNPFLGYRAIRLCLDEQEIFRTQLRALLRASTYGNLKIMFPMIATVNEFKAAKAILLEEKEKLKAEGQQVSDDIEVGMMVEIPSTAVIADQFAKEVDFFSIGTNDLIQYTMAADRMNERVSYLYQPYNPAILRLITLVIEAAHKEGKWVGMCGEMAGDEIAIPILLGLGLDEFSMSATSILPARTQISKLSKKETESFKEQILSMSTTEEVVQFVKETFNLA

SEQ ID NO: 14947 - protein, 170 aa, Triticum aestivum
RREPTTQFAAFDFEFHRPHSKGNTSQVSKPTRGSMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 14948 - protein, 510 aa, Ralstonia metallidurans CH34
MNANILSGRQPARPVATEHFDVIIVGAGISGVGSAYHMRTQCPGKRFVVLESKDSFGGTWHTHRYPGVRSDSDLYTFGYRFKPWMGKPIATAEEILSYMAEVIEENDLAQHIRYRHRIDAASWSSAEGLWTLDTTRLESGERVRFTTNFLWMCQGYYRHDQGYLPEWTGMDNFKGPLIHAQTWPEELDVQGKRVVVIGSGATAATVVPGLARLGAKVTMLQRSPTYFISGRNANDLANELRRLEIDPMWIHAIIRKKVLMDGAIFARRSREEPEEVRKELLAGVRAQLGEDFELEPHFSPRYRPWQQRVAFIPDGDMFAEIREGNAIVVTDEIDRFVEDGVVLKSNEKLDADIVVAATGFQLSVLGDIPFSVDGQSLDFSKTVTYRGMMFTGVPNMVWVFGYFRASWTLRVDMVADFVCRLLKHMDATGAKQVTPQLREDEKDMPLSEWIDADNFNPGYLMRDIQLMPRSGNTREWQHTQDYWGEKDEFPEIDLTDGVFRYDANRPSGNA

SEQ ID NO: 14949 - protein, 214 aa, Synechococcus sp. CC9311
MEPRLSRRQALRMMEASYLAAAAALIWLALYYLPIGGALFRLALPLPLALLLVRRGSRAGVEGVVVAILLLVVLMGPLRGPLMLFPYGLLSLWLGWCWHKKVSWWISWGLGVVIGAAGFLVRVVALSLMVGENLWLVITRAGAGLLDRVLELMQLPLAPDLLLVQAMAITLVVVQQLVYVLALHALAYWIFPRLQAPIPEPPPLLHGLVALDPL

SEQ ID NO: 14950 - protein, 829 aa, Shewanella sp. ANA-3
MNRRDFIKANAVIAAAGAAGLALPASASNLITSSEQTKLEWNKAPCRFCGTGCSVIVATREGKVVATHGDANSEVNRGLNCIKGYFLSKIMYGSDRLTTPMLRMTDGKYDKHGEFTPISWDSAFDIMAQKWKETLKAKGPTAVGMFGSGQWTVWEGYAAVKLMKAGFGSNNIDPNARHCMASAVVGFMRTFGIDEPMGCYDDMEAADAFVLWGSNMAEMHPILWTRVTDRRLSASHVKVAVLSTFEHRSFDLADLPIVFTPQTDLAILNFIANYIIQNDKVNWDFVKKHVNFRQGTTDIGYGLRPTHPLEQKAKNVKTAGDSTPIDFDTFKAFVAEYTVEKVSKMSGVPEAKLIELAKLYADPETKVTSFWTMGFNQHTRGVWCNNLIYNIHLLTGKISTPGNSPFSLTGQPSACGTAREVGTFSHRLPADMVVTNPEHRKHAEEIWKIPSGIIPPKPGYHAVEQNRRLKDGDLNCYWVQVNNNMQAGPNINEEGLPGYRNPANFIVVSDAYPTVTTQAADLILPTAMWVEKEGAYGNAERRTQFWHQMVQAPGESHSDLWQLMEFSKRFTTDEVWSKEVLAANPQFKGKTLFEVLYKNGNVDKFPLADTDPKYLNNEAKHFGFYVQKGLFEEYATFGRGHGHDLAPFDAYHEAHGIRWPVVDGKETKWRFREGSDPYVKPGSGFEFYGKPDGRAVIYALPFEPPAESPDTEYDMWLSTGRVLEHWHSGSMTQRVPELYRAFPDAVCFMHPEDAKKRGLRRGDEVRVVSRRGEIKTRVETRGRNKPPVGLVFVPWFDASQLINKVTLDATDPLSKQTDFKKCAVKIVKV

SEQ ID NO: 14951 - protein, 246 aa, Zea mays
  misc_feature (98)..(98): Xaa can be any naturally occurring amino acid
  misc_feature (115)..(115): Xaa can be any naturally occurring amino acid
MSRFGRSGPPPPIRDTYSLLVLNITFRTTADDLFPLFDKYGEIVDIYIPRDRRTGDSRGFAFVRYKYEDEAQKAVERLDGRLVDGREIMVQFAKYGPXAERINKGRIVEPVPRQXGRSRSHSPRRRYRDDYRDDHDRDYRRRSRSRSRDRYTRDRYRDRDYRHRSPSRSYSPDDYKKRGRDSLSPERRSPRRSRSPDDYKRRGRDSASPASKSPSRSPPRKMSPSPERSPVRRNNDRSPRSRSPST

SEQ ID NO: 14952 - protein, 225 aa, Halobacterium sp. NRC-1
MKQAGGSAEQKRRAGEAAVAEEVTEGAVVGLGTGSTVAHAIRALGAEASDVSGVATSFESRRRAVDAGVTVTSLEAASVDVAIDGADQVADGVLVKGGGAAHTREKYVAASADRFVVVADPSKESDVVDVPVPVAVVPDAWPVVVDRVEALGGTATLRDAERKDGPVVTDTGSLVVDCDFGAIETPEAVAASLSAVPGVVEHGLFVGMADAVYVGTDDGVRVRDP

SEQ ID NO: 14953 - protein, 680 aa, Haemophilus influenzae R2866
MRWIIFQNELSQENKMATRRQLANAIRVLAMDSVQKAKSGHPGAPMGMADIAEVLWRDFLKHNPTNPKWADRDRFVLSNGHGSMLIYSLLHLTGYDLSIEDLKQFRQLHSKTPGHPEYGYAPGVETTTGPLGQGITNAVGMAIAEKTLAGQFNREGHEIVDHHTYVFLGDGCLMEGISHEACSLAGTLGLGKLIAFYDDNNISIDGHVDGWFSDDTAARFEAYGWQVIRNVDGHDAEQIRAATILAQAEKEKPTLIICKTIIGFGSPNKSGSHDSHGAPLGDEEIALTRKALGWEYAPFEIPAEYYAEWSAKEKGSAAEKSWEEKFAAYAKAYPELAAEFKRRVSGELPANWAAESKAFIEKLQANPASIASRKASQNAIEAYAHVLPEFLGGSADLASSNLTLWSGSKPIRAHENVGGNYINYGVREFGMSAIMNGIALHGGFIPYGATFLMFYEYAHNAVRMAALMKQRTLFVYTHDSIGLGEDGPTHQPVEQTASLRLIPNLETWRPCDQVESAIAWQQAVERQDGPSALIFTRQNLAQMNRTSAQLDAVKRGAYVLKDCDGTPELIFIATGSEVELAVQAAEALSAEGKKVRVVSMPSTNRFDKQDAAYRESVLPAAVTKRVAIEAGIADFWYKYVGFNGRVVGMNSFGESAPADQLFKLFGFTVENVVAKAKEIL

SEQ ID NO: 14954 - protein, 308 aa, Xanthomonas campestris pv. vesicatoria str. 85-10
MSLDPALRSRIDTLLQSSRVVLFMKGQPGMPQCGFSAKAVGVLDGLGIDYAHVNVLADQEIREGIKAYGDWPTIPQLYVDGELIGGSDIIVQMADSGELSSMLGLQAPDRSPPKITITPAAVEMLKSALADAPDASLTLAIDANFQPNFQLAPTNPNAIAAESNGLRVQFDLASARRADGITIDWVDDIRGRGLAIDNPNAPKPVQELSVRDADDRLKAGSLTLVDVRPADERALATVAAPFRTLDAHERAAIEQLPKDTPLAFLCHRGGRSLQAAEHFRGLGFTNVYNVTGGIDAWSDEVDNGVAKY

SEQ ID NO: 14955 - protein, 425 aa, Corynebacterium efficiens YS-314 [sequence omitted]

SEQ ID NO: 14956 - protein, 397 aa, Legionella pneumophila subsp. pneumophila str. Philadelphia 1
MSQFPRIKRLPPYVFNTINQLKMEARARGEDIIDFGMGNPDQPTPPHIVNKLIEVAQRPDTHRYSMSKGIPRLRRAMATWYLRHYDVHLDSEKQILATIGSKEGLAHLALAISGPGDTVLVPDPAYPIHTYGFIIAGANVKQIPLIDEVQFLAAVEDAINRTWPKPKALVLNFPANPSTHCVEYEFFEKVVDLAKRNNIWIIHDLAYADIVFDGYKAPSILQVPGAIDIAIETYSMSKSYNMPGWRVGFACGNEELVAALTRIKSYLDYGTFTPIQVAAITALEGPDDCVLEIRNLYEKRRNLLCDGLNDIGWEVSKPKGTMFVWAPIPLNYRAMGSLEFSKYLLKEAQVAVSPGIGFGQQGDGYVRFGLIENKDRIRQALRNLKALFKRDGLLKAI

SEQ ID NO: 14957 - protein, 1084 aa, Burkholderia xenovorans LB400
MPKRTDIKSILIIGAGPIIIGQACEFDYSGAQACKALREEGYKVILVNSNPATIMTDPNTADVTYIEPITWEVVERIIAKERPDAILPTMGGQTALNCALDLHAHGVLEKYKVELIGASPEAIDKAEDRQKFKDAMTRIGLGSAKSGTAHSMEEALAVQADIASQTGSGGYPVVIRPSFTLGGSGGGIAYNRDEFEEICKRGLDLSPTRELLIEESLLGWKEYEMEVVRDKKDNCIIVCSIENLDPMGIHTGDSITVAPAQTLTDKEYQVLRNASLAVLREIGVDTGGSNVQFSINPKDGRMIVIEMNPRVSRSSALASKATGFPIAKVAAKLAVGYTLDELKNEITGGQTPASFEPTIDYVVTKIPRFAFEKFREADSRLTTQMKSVGEVMAIGRTFQESFQKALRGLEVGVDGLDEKTDNRDEIIREIGEAGPDRIWYVGDAFRVGMTAEEIFEETSIDPWFLAQIEQIILKEKALAGRTLASLSKEELKYLKQSGFSDRRLAKLLGAKPAQVRQRRIELNVRPVYKRVDTCAAEFATKTAYMYSTYEEECEANPTNNKKIMVLGGGPNRIGQGIEFDYCCVHAALAMREDGYETIMVNCNPETVSTDYDTSDRLYFESLTLEDVLEIVDKEKPVGVIVQYGGQTPLKLALDLEANGVPIVGTSPDMIDAAEDRERFQKLLQDLGLRQPPNRTARAEDEALKLADEIGYPLVVRPSYVLGGRAMEIVHEPRDLERYMREAVKVSNDSPVLLDRFLNDAIECDVDCISDGEAVFIGGVMEHIEQAGVHSGDSACSLPPYSLSKETVAELKRQTGAMAKALNVIGLMNVQFAIQQVPQADGSKEDVIYVLEVNPRASRTVPYVSKATSLPLAKIAARAMVGQTLAQQGVTKEIDPPYFSVKEAVFPFVKFPAVDPVLGPEMRSTGEVMGVGQTFGEALFKSQLAAGSRLPESGTVLLTVMDADKPKAVEVARMLHELGYPLVATKGTAAAIEAAGVPVKVVNKVKDGRPHIVDMIKNGEIALVFTTVDETRAAIADSRSIRMSAQANKVTYYTTMSGARAAVEGLRYLKDLEVYDLQGLHARLN

SEQ ID NO: 14958 - protein, 476 aa, Halobacterium sp. NRC-1
MSTQLQHARDGTVTDAMRRVADREGRDPEVVREAVADGHAVIPANHHHDALDPMIIGRDFATKVNANIGNSDTTGDIDDELEKLHTAVHYGADTVMDLSTGENLDGIRTANIDNSPVPVGTVPIYEAVTRVEDVTDITPDLLIDVVEKQAKQGVDYMTLHAGVLAEHLPLTDDRTTGIVSRGGSILSQWMTEHGEQNPLYTHYDELCEILQAHDVTISLGDGLRPGSVADASDDAQFAELDTLGELTRRAWDHGVQAMVEGPGHVPMDQIRANVDRQQEVCDGAPFYVLGPLVTDIAPGYDHITSAIGATEAARAGAAMLCYVTPKEHLGLPDAEDVRDGMAAYRIAAHAGDVAAGKPGARDWDDALSEARYNFDWNRQFDLALDPERAQAFHDQTLPGDNYKDARFCSMCGVDFCSMRIDQDARDAGDDADDMTELTTETDLSESAAAEVNRPPTGTHDAPAAEQAPSPGDDDDD

SEQ ID NO: 14959 - protein, 360 aa, Streptomyces coelicolor A3(2)
MTEAILLVGGKGTRLRPLTVNTPKPMVRAAGVPFLTHQLARAKAAGVEHIVLATSYLAEVFEPYFGDGSTLGLHLEYVTEEEPLGTGGAIRNVASRLHSGPDEPVLIFNGDILTGLDIGALVRTHETTGADVSLHLTQVTDPRAYGLVPTDDTGRVLAFLEKPQTPEEIVTDQINAGAYVFRRSVIDTIPAGRPVSVERETFPELLATGAHLQGMVDSTYWLDLGTPAAFVRGSADLVLGRAPSPAVPGRCGDRLVLPTAQVAPDAKLTGGTVVGEGAFVAEGARVFGSTILPGAVIEPGAVITDSLIGTRARVGTRSVLADTVIGDGAVIGADNELRSGARIWCDAHIPPASLRFSPDT

SEQ ID NO: 14960 - protein, 461 aa, Candida glabrata CBS 138
MDDCQHIQSIFENPKNRAAWLNALSTTQSVLRHSPIKAKLLHAFRCSTCKEISNGSNFLCLQCGFCGCWNGSHFEQHSKETGHLFGINAQTELVFCFQCMDYVGDFDLFRDAALANRWDYYEEYTNVPTVDQIDGMAGLVNMGSTCYMSSIMQCIIHNPYMIRYFMCQQHSNNCTLKMASNCTSCAISSIIADFYGNSVQNDYKSKKNNNNKHEGFINLLTCSWKVNENLAGYSQQDAHEYWQFILNHIHQDYKSSMHSHSDDKLCNCVVHSSFQGSLKSSIVCPECNNDSKTTFDPFIDLSLGIKDKHTLTECLDNFHKKEQLHDYDFFCKKCQAQQNPIKQFTINKLPPVLVLQLKRFEHLMSGVNQKLNDYIEFPKILDMKPYLKDNQNPDEDPSILYELIGIISHTGSVNEGHYVAFCKIENGEWFKFNDSMVTKILEKDVLKEQAYLLFYIVKHIS

SEQ ID NO: 14961 - protein, 476 aa, Ralstonia metallidurans CH34
MQQRDKLFINGSWVTPHGTGFIDVIHSATEDVMGKIPEGDARDAENAIAAARAAFEAWSATPPSVRADYIRKIAEGLKARCEELAQMIAGEVGMPIKLARAIQVGGPVYNWGQAAALLDQFAFEEQVGNSLVVREPVGVVAAITPWNYPLNQITLKVAPALAAGCTVVLKPSEVAPLNAFVLAEVIEAAGLPPGVFNLVTGYGPVVGEVLASHPEVDMVSFTGSTRAGKRVSELAAQSVKRVALELGGKSASVILDDADLPTAVKGTIGACYLNSGQTCSAHTRMLVPRSRYEEVKAIAAKVVEGFTVGDPLADTTKLGPLISAVQKERVTGYIRRGLDEGAELVAGGPDTPAGLDRGFFVKPTVLGNVDPKATVAQEEIFGPVLSVICYDTEDEAIRIANDSIYGLGGGVWSGDESRAIRVARRIRTGQVDINGGPFNMNAPFGGFKQSGNGREGGKFGLEEFLEYKSLQLKKPA

SEQ ID NO: 14962 - protein, 201 aa, Shewanella sp. ANA-3
MKLLKPLFDNNRRWAGRIRQEHPDFFEQLAKQQNPEYLWIGCSDSRVPSNQIIDLMPGEVFVHRNIANMVIHTDLNCLSVLQYAIDVLKVKHIMVVGHYGCGGVRAAMGSQRLGLIDNWLGHLRDIYRIYHDELMQMDEAKRFDRLCELNVIEQVANVTSTTIVQEAWARGQELAIHGWIYGIDNGLLTDLDVTVDRAQKI

SEQ ID NO: 14963 - protein, 129 aa, Halobacterium sp. NRC-1
MEEFDVDLDFGGAGHTDDGDGLVAVIAQDADSRDVLMLAYATREAVARTATTGRAHYYSRSRDELWEKGATSGNTQSVDEIRVDCDGDALLYLVAQTGGACHTGHESCFHRTLDGDTVGDQVFDPDDAY

SEQ ID NO: 14964 - protein, 429 aa, Oryza sativa (japonica cultivar-group)
MSSPPPAAAAAMAVDDADDDQLASMSTENIVRATRLLDNETRVLKDELQRTNLEVESYKEKIKENQEKIKLNKQLPYLVGNIVEILEMNPEDEAEEDGANIDLDSQRKGKCVVLKTSTRQTIFLPVIGLVDPEKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 14965 - protein, 1074 aa, Bacillus licheniformis ATCC 14580
MNKLDGIPIPKTYGPLGNLPLLDKNRVSQSLWKIADEMGPIFQFKFADAIGVFVSSHELVKEVSEESRFDKNMGKGLLKVREFSGDGLFTSWTEEPNWRKAHNILLPSFSQKAMKGYHPMMQDIAVQLIQKWSRLNQDESIDVPDDMTRLTLDTIGLCGFNYRFNSFYREGQHPFIESMVRGLSEAMRQTKRFPLQDKLMIQTKRRFNSDVESMFSLVDRIIADRKQAESESGNDLLSLMLHAKDPETGEKLDDENIRYQIITFLIAGHETTSGLLSFAIYLLLKHPDKLKKAYEEADRVLTDPVPSYKQVQQLKYIRMILNESIRLWPTAPAFSLYAKEETVIGGKYLIPKGQSVTVLIPKLHRDQSVWGEDAEAFRPERFEQMDSIPAHAYKPFGNGQRACIGMQFALHEATLVLGMILQYFDLEDHANYQLKIKESLTLKPDGFTIRVRPRKKEAMTAMPGAQPEENGRQEERPSAPAAENTHGTPLLVLYGSNLGTAEEIAKELAEEAREQGFHSRTAELDQYAGAIPAEGAVIIVTASYNGNPPDCAKEFVNWLEHDQTDDLRGVKYAVFGCGNRSWASTYQRIPRLIDSVLEKKGAQRLHKLGEGDAGDDFEGQFESWKYDLWPLLRTEFSLAEPEPNQTETDRQALSVEFVNAPAASPLAKAYQVFTAKISANRELQCEKSGRSTRHIEISLPEGAAYQEGDHLGVLPQNSEVLIGRVFQRFGLNGNEQILISGRNQASHLPLERPVHVKDLFQHCVELQEPATRAQIRELAAHTVCPPHQRELEDLLKDDVYKDQVLNKRLTMLDLLEQYPACELPFARFLALLPPLKPRYYSISSSPQLNPRQTSITVSVVSGPALSGRGHYKGVASNYLAGLEPGDAISCFIREPQSGFRLPEDPETPVIMVGPGTGIAPYRGFLQARRIQRDAGVKLGEAHLYFGCRRPNEDFLYRDELEQAEKDGIVHLHTAFSRLEGRPKTYVQDLLREDAALLIHLLNEGGRLYVCGDGSRMAPAVEQALCEAYRIVQGASREESQSWLSALLEEGRYAKDVWDGGVSQHNVKADCIART

SEQ ID NO: 14966 - protein, 594 aa, Pseudomonas fluorescens PfO-1
MTTGSALYIPPYKADDQDVVVELNNRFGAEAFTAQPTRTGMPVLWVARAKLVEVLTFLRNLPKPYVMLYDLHGVDERLRTKRQGLPSGADFTVFYHLMSLERNSDVMIKVALSESDLSLPTVTSIWPNANWYEREVWDMYGIDFKGHPHLSRIMMPPTWEGHPLRKDFPARATEFDPFSLNLAKQQLEEEAARFRPEDWGMKRSGANEDYMFLNLGPNHPSAHGAFRIILQLDGEEIVDCVPDIGYHHRGAEKMAERQSWHSFIPYTDRIDYLGGVMNNLPYVLSVEKLAGIKVPEKVDVIRIMMAEFFRITSHLLFLGTYIQDVGAMTPVFFTFTDRQKAYTVIEAITGFRLHPAWYRIGGVAHDLPRGWEKLVKDFVEWLPKRLDEYTKAALQNSILKGRTIGVAQYNTKEALEWGVTGAGLRSTGCDFDLRKARPYSGYENFEFEVPLAANGDAYDRCMVRVEEMRQSVKIIDQCLRNMPEGPYKADHPLTTPPPKERTLQHIETLITHFLQVSWGPVMPANESFQMIEATKGINSYYLTSDGGTMSYRTRIRTPSFAHLQQIPSVIKGSMVADLIAYLGSIDFVMADVDR

SEQ ID NO: 14967 - protein, 233 aa, Bacteroides fragilis YCH46
MKWESSLVEHLQWSDTITNRESKEQLARMIAMRVQEGEIIGAGSGSTVYLALLAIAERIRTENLHVTVIPASMEISMECVRLGIPQTTLWMCRPDWTFDGADEVDPDHNLIKGRGGALFKEKLLICSSNRTFILVDESKQVSFLGSRFPVPIEVFPMALPYVEREVLTMGALRTELRLAKGKDGPVITENGNLILDAWFGNIHSSLEKEIKSITGVVENGLFMGYDVEVMVAK

SEQ ID NO: 14968 - protein, 846 aa, Coprinopsis cinerea okayama7#130
MAANFGQSSEDAVLEERSRVFKNFLTEGSELYNYQDEILRMLREDRTRLIINIDDLRDFNREYANGLLKQPTEYFPAIEDALSQIVKDVHNTEKHAIEGKTYHVGFSGSFGDHHVSPRTLNSGHLGKMICLEGIITRCSLVRPKMLRSVHYCPQTQNFHAREYRDATTSNSNLPPTTSITPQTDEDGNPLETEYGLCTFRDHQRISIQEMPERAPPGQLPRSTDIILDDDLVDKCKPGDRIQLVGVYRSVGGGASGAFKSLLLANNINLLSSKIGGGIAQTPLTDIDIRTINQLAKKSNIFNLLSESLAPSIFGHEQIKQAILLLLLGGAEKNLPNGTHIRGDINLLMVGDPSTAKSQLLRFVLGTAPLAIATTGRGSSGVGLTAAVTTDKETGERRLEAGAMVLADRGVVCIDEFDKMSDIDRVAIHEVMEQQTVTIAKAGIHTSLNARCSVVAAANPIYGQYDIHKDPHKNIALPDSLLSRFDLLFIVTDDVEETKDRMIADHVLRMHRYLPPGVEEGTPCHDNLSQPLSMEGPNVAAEVEAVETSPYEKFDPLLHMGLAQAGRERETRSSKKNKKKEILSIAFVKKYIQYAKSKPAPVLTKGAADYIVQVYATLRNEDMEGTKKTSPLTARTLETLIRLATAHAKARLSTKVEERDAIKAEEIMRFALFRQVPKRQRRKKRKLNHGGVRKRTDGDAEGSSDEGESESEDENENVDQRMSMPPAASGAGAAKSPPPQDPIWGDETQDVTMHEEESQQSTVVASTPAEGGQNKQERLQFFRSRMAHVFSTVMQDEESMFLKDILTHINQGLPAESLFGTGEATELCQIMGDNDELMISEGIVYKV

SEQ ID NO: 14969 - protein, 390 aa, Pseudomonas fluorescens PfO-1
MAQPYSARSRAIEPFHVMALLARANELQAAGHDVIHLEIGEPDFTTAEPIIRAGQQALTAGKTRYTAARGIPELREAISGFYQTRYGLNIDPRRILITPGGSGALLLASALLVDPGKHWLLADPGYPCNRHFLRLVEGAAQLVPVGPDVRYQLTPDLVARHWDHDSVGALVASPANPTGTILTRDELSGLSTAIKARHGHLVVDEIYHGLTYGTDAASVLEVDDSAFVLNSFSKYFGMTGWRLGWLVAPDAAVSELEKLAQNLYISAPSMAQHAALACFEPDTIAILEERRAEFGRRRDFLLPALRELGFNIAVEPEGAFYLYADISQFGGDAFAFCRHFLETEHVAFTPGLDFGRYQAGHHVRFAYTQNLPRLQEAVERIARGLKSWQG

SEQ ID NO: 14970 - protein, 325 aa, Oenococcus oeni PSU-1
MKINPMWDKYPLIKHELGLTLALMQKNIKTDNEPVSKAILEMINSGGKLLRPAYLLLFSMFQKTDRNKIIALAAAIEILHMATLIHDDVIDESPTRRGMSSIQKQFGQSTAVYSGDYLFVVCFNLLAEYASDFRGIQQYGHHMNAILNGEMTQMVERYDLNISIDQYFKQISGKTGQLFSLATFLGAYESGNKIKFAKNAEKIGLNIGVSFQLMDDILDYTDNSQQIGKPVHNDMREGVYSAPLILAMAQHKDLFFPFLKKKNKMTDQDTEEIAKLVIEFDGIKKAKKYAETYTKKALIQINDLPDKPAKKALIDITRELLDRQS

SEQ ID NO: 14971 - protein, 1282 aa, Oryza sativa
MVAHGVLLAKEIIGWRPAFGEAFPTPDTHEVVDSWNSLPMGEEAAQALALMDRMLKLKEQAFKFDGKHDTNREDPESLEFKEFALMKSDPPIAQRRSPRWRTGQASGGPKIQSDTQTNTSKSTSQSDSRKRKLVLSDDEGDNARKSGNKEVTGKQPRQTNPKKKTSSRPMPIWSEIWLEMDGDSVRWLRGGFLWSSGGWIGVDLLTLASAVKVLFGFIKQLIGYNIIAFCHPFTVFDYITREIKTDEAKALGLSFRIMREDYSVDCKGLRGYCGDYGYPIPTRHDKPRSGGGEGRKRAPAAPAGGMAAPPKAWKAEYAKSGRSSCKSCRSPIGKDQLRLGKMVQATQFDGLMPMWNHASCILSKKNQIKSVDDVEGIDTLRWDDQEKIRNYVGSAPATASSAAAISDKCTIEVAKSARTSCRRCGEKIKKGTVRVSSKLEGQGWYHASCFLEMSPAATVENFSGWEILSHEDKRAVLDLVKKDAPSSGQTSSKGSKRKNNQNDIHDCKAPKIIRSISEGTAEDKGKAVVSHDSNANSFDLQEKLKEQSDTLWKLKDELKKHVSTAELRNMLEANGQDTSGPERHLLDRCADGMLFGALGTCPVCSSFLYYHGGQYHCSGYVSEWSKCTYSTTEPVRSKKKWKIPDEMDNGYLTKWFKSQKAKKPERVLPPMSPEKSLCQSTQQNRSFLSEGLDKLRVSIVGQSKDVVDGWKQKLKDAGANFNATVTKDSSCLVLCSELESENAEVKKARRLKIPILREGYLGECIRKNRVLPFDLYKVEAALESSKGGTMTVKVKGRSAVHESSGLQDTGHILEDGKSIYNTTLNMSDLTRGVNSYYILQVIEEDNGSDCYVFRKWGRVGNEKIGGTKLEEMSKIHAIQEFRRLFLEKTGNPWEAWEQKTNFQKQPGKFYPLDIDYGVRQGPKRKDIDKMKSSLPPQLLELMNMLFNIETYRAAMLEFKINMSEMPLGKLSKENIQKGVEALTEIQNLLGNTNNQELAVRESLIVAASNRFFTLIPSIHPHIIQDEDDLMVKVKMLEALQDIEIASKLVGFDSDNDESLDDKYKKLRCAITPLPHDCEDYKLVEKYLLNTHAPTHKEWSLELEEVFSLDRDGEFSKYSRYKNNLHNKMLLWHGSRLTNYVGILSQGLRIAPPEAPVTGYMFGKGLYFADLVSKSAQYCYVDRKNPVGLMLLSEVALGDMYELKKATSMDKPPRGKHSTKGLGKTVPLESEFAKWRDDVVVPCGKPVPASIKTSELMYNEYIVYNTSQVKMQYLLKVRFHHKR

SEQ ID NO: 14972 - protein, 757 aa, Coprinopsis cinerea okayama7#130
MLQEDRQFYLEHLNNPNFDLRANRPSSIRSFGLDPKRKVHTGYESDFDTESQFDRYSSTQAESAIDFDDESPYPEVRAAVSSVDDPLMPYNTFRVWTLGLFLMIVGIFFNQIFAMRYPSVYLTGIVVQLVALPLGKGMERILPKTVFNFFGYKWSMNPGPFSVKEHVCITVMGNIATGGVYITEVALCQRMFYGQQVSYAFQILIAIGSQIWGYSLGGIMRQFVVWPSSMIWPGALVNSALFNTLHKNYGQRDKSHMSRERFFVLAMVGSAVWFFVPGYLFTALTMFNWVCWIAPDNVTVNALFGVNTGLGMSMLTFDWSMIAFIGSPLVTPWWSEMNTAAGFIIMYWIICPILYFTNTWDSAYLPISSYYSFDNTGNVYQVKEVLTDGVFDQAKYSAYSPVFMSTALALLYGIAFAAFPSVFVHTFLWFRKDIVRRFRTTLKDERDIHSRLMQYYPETPAWWYLTIGLISFVFLVIAIEINPNSQLPIWGLFLALALAVCLAIPLCMLQAITNQTVPTQVMAELIIGYILPGRPIANMLFKSLMFVGSNQAIIFAGDLKLGHYMKIPPRMMFSIQVFSATVSCFFVTGMQNWMLSNIPDVCTPTQKDGFRCPGSTTFFTASVIWGGVSPVRLFSPGQWYSGLLWFFLVGAILPIPFYFLARRFPLSIWRYINIPIFFASLGAMPPASGINYISWALTGFIFNYVIRRFHFRWWMRYNYILSAALDAGLGIGMIIVFFTLQMPKGGVQLNWWGNEYV

SEQ ID NO: 14973 - protein, 340 aa, Aspergillus oryzae
MGQTLSEPVVDKTSSEGEDDCCIYGVSAMQGWRISMEDAHAAVLDLHAKYTSPEETSTDPAKRLAFFGVYDGHGGDKVALFAGENVHKIVAKQDSFAKGDIEQALKDGFLATDRAILEDPKYEEEVSGCTAAVSVISKHKIWVANAGDSRSVLGVKGRAKPLSFDHKPQNEGEKARISAAGGFVDFGRVNGNLALSRAIGDFEFKKSPELAPEQQIVTAYPDVTVHELSDDDEFLVIACDGIWDCQSSQAVVEFVRRGIAAKQELYRICENMMDNCLASNSETGGVGCDNMTMIIIGLLNGRTKEEWYNQIAERVAKGDGPCAPPEYGKSLEDSTASNPY

SEQ ID NO: 14974 - protein, 477 aa, Chlamydophila abortus S26/3
MLCATISGPTFAEAKQQLLHSLPLVDSIELRIDCLLSLSSNELKHLVSLAKKPILTLRKHTSLSEIAWIERTLQLAELQPEYLDIDKDFPKEALAKIQKNYPKIKIILSYHSETSEHIPNLCKEMLRQQAHHYKIAITSTKSTDTLRCIQIKKHLPENTTLLCMGNAGIASRILSPLMKNAINYASGIHAPKVAPGQLSIEDLLAYNYTNLSAEARIYGLIGNPVDRSISHLSHNKLFSELQLNMSYIKILLAPYELNEFFSLTRDLPFGGLSVTMPFKTAVLEYIDILDPSVQQCQSCNTLVFHNNKIAGYNTDGLGLLNLLKRKNIPLQNMHVGIVGSGGAAKAIATTFAYSGAQISIFNRTKAHAEKLSVLCHGQAFPLHSLSEHHNIDILILCLPPGVDIPEIYPPVIIDINTLPKESLYTKKAKERGCQILYGYEMFAEQALLQFSLWFPDKLSQENRERFRLSVENIISTM

SEQ ID NO: 14975 - protein, 269 aa, Burkholderia xenovorans LB400
MRGKMRTLFRPHKAERHNQPMQALPAVLSPGETAFFFDFDGTLVELAPTPDGVLVQPRVIDLLSELRSLTNGAVAVVSGRGIDSIDSFLGIPDLPIAGLHGAERRDANGDTQRIGFHDERLLRMEQVLAQVVNENPGMLLEIKGAAVALHYRNAPDREPVAREATSRLVADYAGAYVLQPGKMVYEIKPKDVDKGRALRAFLDEPPFVGRQPVFAGDDLTDEKGFAVVNERGGLSIKVGPGETMARTRIDSVPALLDWLASIVAAARAA

SEQ ID NO: 14976 - protein, 924 aa, Oryza sativa (indica cultivar-group)
  misc_feature (334)..(334): Xaa can be any naturally occurring amino acid
MPSASAALVLLFVAFSLSNAQPGFISLDCGGDDDYTDGIGIQWTSDAKFVSAGQKANLLLQNQQLQQYTTVRSFPADNRKYCYTMNVRNRTRYLVRATFLYGNFDNSNVYPKFDLSLGPTPWTTVVIDDATTPVVQEAIILAAAPTLSVCLSNASTGQPFISTLELRQFNGSLYYTTDEKQFFLRLSARINFGAESNASVRYPDDPFDRIWESDLVRRANYLVDVAPGTERISTTKPIFVSTNEEPPQRVMQTAVVGKNGSLTYRIDLEDFPGNAWGVSYFAEIEDLAPNQTRKFKLVIPGKPEFSKPTVDVEENAQGKYRLYEPGYTNIPLPXVFSFGFKKTNDSSEGPILNAMEIYKYIEISVGSQDANIMASLVSRYPEAGWAQEGGDPCLPASWSWVQCSSEAAPRIFSISLSGKNITGSIPVELTKLSGLVELKLDGNSFTGQIPDFTGCHDLQYIHLEDNQLTGALPPSLGELPNLKEFFSGNSDLRMGHSNTGRTIVIIVCAVVGAILILVAAIVCYLFTCKRKKKSSDETVVIAAPAKKLGSFFSEVATESAHRFALSEIEDATDKFDRRIGSGGFGIVYYGKLTDGREIAVKLLTNDSYQGIREFLNEVTLLSRIHHRNLVSFLGYSQQDGKNILVYEFMHNGTLKEHLRGGPDDVKINSWVKRLEIAEDAAKGIEYLHTGCSPTIIHRDLKSSNILLDKNMRAKVADFGLSKPVVDGSHVSSIVRGTVGYLDPEYYISQQLTEKSDMYSFGVILLELISGHEPISNDNFGLHCRNIVEWARSHMESGDIHGIIDQSLDAGYDLQSVWKIAEVATMCVKPKGVLRPSISEVLKEIQDAIAIELQRELPSSIHHLMSKTSPSEAVNTTGSLQDLEQNASFDELLMRPGLRLNGTGRAAQAASEILNETAILVTSRC

SEQ ID NO: 14977 - protein, 385 aa, Ralstonia metallidurans CH34
MSEAQPLATPKPKKSVALSGIAAGNTALCTVGRSGNDLHYRGYDILDIADTCEFEEIAHLLVHGKLPTKSELAAYKVKLKALRGLPANVKAALEWVPASAHPMDVMRTGVSVLGTVLPEKDDHNTPGARDIADRLMASLGSMLLYWYHYSHNGRRIEVETDDDSIAAHFLHLLHGEAPSKLWERAMQTSLILYAEHEFNASTFACRVVAGTGSDMYSAICGGIGALRGPKHGGANEVAFEIQKRYDTPDEAEADIRRRVENKEVVIGFGHPVYTISDPRNVVIKEVARKLSKDAGSMKMFNIAERLETVMADAKKMFPNLDWFSAVSYHMMGVPTAMFTPLFVIARTSGWAAHVIEQRVDNKIIRPTANYTGPENLKFVPIEKRA

SEQ ID NO: 14978 - protein, 490 aa, Ipomoea batatas
LNNNVLLSQSRKSLRLDGNKRKIKPGVAFSVLTRENGTETLTVEAPILERRRANPKNVAAIILPGGAGTQLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKHVVITNKDGVQESDRPDEGFYIRSGITIIMEKATIRYGTVI

SEQ ID NO: 14979 - protein, 838 aa, Oryza sativa
  misc_feature (728)..(728): Xaa can be any naturally occurring amino acid
  misc_feature (738)..(738): Xaa can be any naturally occurring amino acid
MSGQSNSPDMIFQVYTPRKRKFLNSVHYSESNRAVSHGSGLVTSAKDSHQGEESFLNGPAGLSSILSNSQGFAPQDILSGTTELSGIRYSTDQSQTAVAHKLLFSCEKGDQSIVAMVHPSQSSLEKIQQKQGISSYEAKHDVQGSTKADDSSSILSPHSLDDEIMSVVGLLSPSAYESLCDAEKKNHDITWPKIIEIKGRVKLDAFEKFVQELRRCQTRSLMVISLCWKFGTSKAGLLGMKEVAENFEASQKVGFADVCDGSNLYVCPRSDAVITILAKCGFFKGMSAADTNQDSLIGCIVWRRNPLSKIVDHSRSETIGKGSPCVPHVGARHPTSLPFSDGHQATSCSNNPGMDSRTNTGNIQNDIDQMQEIQSNSVKTHPVATGLLSQCGHAKSTGERDPTEKVVPHSLFKLASKLTPQPPFKAPSLIGCQLSQVSPFELASHEVPEIQQHVQSIIDSHSGSFGVWHPTSHSQGLSLKSLHVQQRTTHYDLAAQKNHMAEAFSGSITQEYASNAVESSKQQETNPFFLQPDTYGAHRANDIDDLPKVDFANLHRVELKFDVHPINRETTITSDVLICPRLSDKKSNSPFQQSSQPSFRVEGIKNHEKVEVKENVTDMISREITNQVSHRKAEIENFKSKDDIDAEDMPECHFQGLDNEKLHQSGSSKHTSPSLKNSTGSKAPSQVFPPITQKSYTPLEVEDISSGHDPNMPSGCLNIPRDQGSFPXHPPPAQGDQXGQDLYPWRPPFHANQGPFPRHAPPHPCPPFTPGHVRPPSNFAPPGPWRPVLHPGQEHHHHHYGHPGRSNGPSGSGNKPGYHNPSYGNGPGGCRPPHQAQG

SEQ ID NO: 14980 - protein, 182 aa, Pseudomonas fluorescens PfO-1
MFKYIGDIVKGTGTQLRSLVMVFGHGFRKRDTLQYPEEQVYLPPRYRGRIVLTRDPDGEERCVACNLCAVACPVGCISLQKAETEDGRWYPDFFRINFSRCIFCGLCEEACPTTAIQLTPDFEMAEFKRQDLVYEKEDLLISGPGKNPDYNFYRVAGMAVAGKPKGAAQNEAEPINVKSLLP

SEQ ID NO: 14981 - protein, 455 aa, Thermus thermophilus HB8
MYDLLVIGAGPGGYVAAIRAAQLGMKVGVVEKEKALGGTCLRVGCIPSKALLETTERIYEAKKGLLGAKVKGVELDLPALMAHKDKVVQANTQGVEFLFKKNGIARHQGTARFLSERKVLVEETGEELEARYILIATGSAPLIPPWAQVDYERVVTSTEALSFPEVPKRLIVVGGGVIGLELGVVWHRLGAEVIVLEYMDRILPTMDLEVSRAAERVFKKQGLTIRTGVRVTAVVPEAKGARVELEGGEVLEADRVLVAVGRRPYTEGLSLENAGLSTDERGRIPVDEHLRTRVPHIYAIGDVVRGPMLAHKASEEGIAAVEHMVRGFGHVDYQAIPSVVYTHPEIAAVGYTEEELKAQGIPYKVGKFPYSASGRARAMGETEGFIKVLAHAKTDRILGVHGIGARVGDVLAEAALALFFKASAEDLGRAPHAHPSLSEILKEAALAAWERPIHL

SEQ ID NO: 14982 - protein, 406 aa, Thermus thermophilus HB8
MQELKVPSVGESIVEVEIGAWLKGEGESFAQDEPLVELITDKATLELPAPFAGTLKQILKRTGETARVGEAIALLEEGRAEAAPKAQAPAEAPKEPSPEPLAMPAAERLMQEKGVSPAEVQGTGLGGRILKEDVMRHLEERAPAKPQEAPPPPPPSRPAPPPSTPPQPPADKPWRVSEAVPMTPLRRRIAERLLMVRQTTAMLTTFNEADMSAVIALRKEFGEAFQKKYGVKLGFMSFFVKAVVQALKEIPELNAEIRDNHIVYHRYYDIGIAVGGGEGLVVPVIRDADRLSFAEIEQKIADFAERARTKKLKPEELMGGTFTITNGGIYGSLNSTPLLNPPQVGILGMHAIQERPVVRDGQVVIRPMMYLALSYDHRIVDGREAVTFLRRVKELIENPARLLLEV

SEQ ID NO: 14983 - protein, 114 aa, Glycine max
KLAKERKEKMGDRITALQQLVSPFGKTDTASVLSEAIEYIKFLHEQVTALSTPYMKSGAPIQIQQNSGKSKEAEGPKQDLRSRGLCLVPVSSTFPVTHETTVDFWTPTFGGTPR

SEQ ID NO: 14984 - protein, 196 aa, Salmonella enterica subsp. enterica serovar Typhi str. CT18
MSAQALVCLAPGSEETEAVTTIDLLVRGGIHVTTASVASDGNLTIVCSRGVKLLADAPLVEVADGDYDIIVLPGGIKGAECFRDSPLLVETVKQFHRSGRIVAAICAAAATVLVPHDIFPIGNMTGFPALKDKIPAEQWQDKRVVWDARVKLLTSQGPGTAIDFGLKIIDLLVGREKAHEVASQLVMAAGIYNYYE

SEQ ID NO: 14985 - protein, 588 aa, Glycine max
  misc_feature (431)..(431): Xaa can be any naturally occurring amino acid
  misc_feature (481)..(481): Xaa can be any naturally occurring amino acid
MAMVDQPLYPIAVLIDELKNEDIQLRLNSIRRLSTIARALGEDRTRKELIPFLSENNDDDDEVLLAMAEELGVFIPYVGGVEHANVLLPPLETLCTVEETSVRDKSVESLCRIGAQMREQDLVEYLIPLVKRLAAGEWFTARVSSCGLFHIAYPSAPEAVKTELRAIYGQLCQDDMPMVRRSAATNLGKFAATVEAPHLKSDIMSVFEDLTHDDQDSVRLLAVEGCAALGKLLEPQDCVAHILPVIVNFSQDKSWRVRYMVANQLYELCEAVGPDPTRSELVPAYVRLLRDNEAEVRIAAAGKVTKFSRILNPDLAIQHILPCVKELSTDSSQHVRSALASVIMGMAPVLGKDATIEQLLPIFLSLLKDEFPDVRLNIISKLDQVNQVIGIDLLSQSLLPAIVELAEDRHWRVRLAIIEYIPLLASQLGVXFFDDKLGALCMQWLKDKVYSIRDAAANNIKRLAEEFGPDWAMQHIIPQVXLDMVTDPHYLYRMTILQSISLLAPVLGSEISSSKLLPLVINASKDRVPNIKFNVAKVLQSLIPIVDQSVVESTIRPCLVELSEDPDVDVRFFASQALQSCDQVKMSS

SEQ ID NO: 14986 - protein, 163 aa, Aspergillus oryzae
MAPAIPRNGDEETEEISIAGRTKMTVPKDRNNPERQVQGSGTDERVEAKTELNSILKRSPIIIFSKSYCPHSARAKSILLDKYSIVPAPYVVELDQHSLGQPLQALLAENTGRRTVPNILVSGRSIGGGDDVVALDEKDELASTFKKLGGQWVHEVSRNEAGH

SEQ ID NO: 14987 - protein, 111 aa, Sinorhizobium meliloti 1021
MSGINDFIDNEVKSNDVVLFMKGTPQFPQCGFSGQVVQILDYVGVDYKGINVLADADLRQGIKDYSNWPTIPQLYVKGEFVGGCDIVREMFQAGELQSLLQGQGISVKGAA

SEQ ID NO: 14988 - protein, 554 aa, Pseudomonas fluorescens PfO-1; identical to SEQ ID NO: 1228

SEQ ID NO: 14989 - protein, 482 aa, Triticum aestivum
  misc_feature (448)..(448): Xaa can be any naturally occurring amino acid
MAGGAVGSLVPRQAPGSYGLPFVSAIRDRLDFYYFQGEAKYFESRVEKHGSTVLRINVPPGPFMARDPRVVAVLDAKSFPVLFDVDKVEKKNLFTGTYMPSTSLTGGFRVCSYLDPSEPTHTKVKQLLFSLLASRKDAVIPAFRSHFSSLLATVESQLVLAGKSNFNTLNDFTSFEFIADAYFGVLPSASDLGTTGPTKAAKWLIFQLHPLVTFGLPLILEEPLLHTVLLPPIFVSGDYKALYKYLYAAATKALDMAESLGLNRDEACHNLLFATVFNSYGGLKVMLPGILGRIAEAGEKFHQRLAAEVRTAVADAGGKVTIEALEKMELTKSAVWEALRLEPPVKFQYGRAKADMNIESHDAVFAVNKGEMLFGYQPCATKDPRVFGSTAREFVGDRFVGERSKLLQYAYWSNGRETESPSVDNKQCPGKNLVVLVGRLLVVELFLXRYDTFTADVGVDLLGTKVEFTGVTKATSGPESAV

SEQ ID NO: 14990 - protein, 531 aa, Chlamydophila abortus S26/3
MMDRKGFLDSPSTKILQDLAVAPVDLTTPGIISQERVERFSLSIGGFTLSYATERVDEGVVSALTDLASERGLVSSMQAMQSGEVVNYIDNFPSESRPALHTATRAWVKEIPLTGNAEDIALRSKIEAQRLKDFLHQYRDAFTTIVQIGIGGSELGPKALHRALKGCCPSDKKVYFVSNIDPDNAAEVLQEIDCSKTLVVTVSKSGTTLETAVNEEFIADHFLKQGLHFRDHFIAVTCEGSPMDDRSKYLEVFHIWDSIGGRYSSTSMVGGVVLGFAYGFDVFFQLLEGAAAMDLAALAPQMSENLPMLAAMLGIWNRNFLGYPTSVIVPYSAGLEYFPAHLQQCGMESNGKSIAQTGEIIGFATSPILWGEVGTNSQHSFFQCLHQGSDVIPIEFIGFLDNQRGRDIVISGSTSSQKLFANMVAQSIALAKGRENTNPNKSFRGNRPSSLLVAERLTPYTMGALLAFYEHKIVFQGFCWGINSFDQEGVTLGKDLANQVLGIMQGQAKEGACLEAEALLKLFNSTQKKKS

SEQ ID NO: 14991 - protein, 315 aa, Sinorhizobium meliloti 1021
MREPKPQEDLQAIIDDIYRELTPRLGEGKVADYIPQLARVDARHFGMAIVTTGGEVYRVGDAEMPFSIQSISKVFTLTLALGKHGENIWNRVGREPSGSAFNSIVQLEHEGGKPRNPFINAGAIRISDLILAGHTPKELIGEIVRFVRYLADDENIVIDHEVARSETATGYRNIALANFMRSFGRLDHPVEHVLGVYFHHCALAMTCSQLAKAGLFLAAGGTNPLTGHSVVSRQRARRINALMLTCGHYDGSGDFAYRVGLPGKSGVGGGIMAVAPGKASIAVWSPGLNDYGNSLLGSLALEMLAARTGWSVFGP

SEQ ID NO: 14992 - protein, 533 aa, Anabaena variabilis ATCC 29413
MTKAPVAPVVLVILDGWGYCEETRGNAIAAAKTPVMESLWTAYPHTLIHTSGKAVGLPEGQMGNSEVGHLNIGAGRVVPQELVRISDAVEDGSILSNSALVKICQEVRNRNGKLHLVGLCSEGGVHSHITHLFGLLDLAKEQRISEVCIHAITDGRDTAPTDGINAISALEDYINHVGIGRIVTVSGRYYAMDRDRRWDRIQRAYDVMTQDGAGDGRKAVDVLQASYAEGVNDEFIVPVRIAPGTVESGDGVIFFNFRPDRSRQLTQAFVSPEFTGFARQQIKPLSFVTFTQYDSDLSVSVAFEPQNLTNILGEVIANQGLNQFRTAETEKYAHVTYFFNGGLEEPFAGEDRELVSSPMVATYDKAPAMSATAVTDTAIAAIQKGIYSLIVINYANPDMVGHTGQIEPTIQAIETVDRCLGRLLEGVSKAGGTTIITADHGNAEYMLDEAGNSWTAHTTNPVPLILVEGEKVKIPGYGTNVELRSDGKLADIAPTILDILQLPQPPEMTGRSLLQPAEYDVQSPRTRIPVGLN

SEQ ID NO: 14993 - protein, 240 aa, Glycine max
SYVGPPPSVYQAIRCMSSKLFVGGISYQTDDHSLRDEFAKYGQVIEARIIIDRESGRSRGFGFVTYTSSEEASAAITALDGKTLDGRSIRVNHANEKTGGFRGGGGYGGGGYGGGGGYGGGGGGYGGGGGYGGGGGGGGYGGGDYGGNRNRGGGGDYGVAGGGGGTFTAGGSDSFANSNFGSDSSFGGNGAGGFDATGGSTGDDGFSGTPDDNFGGNKNEETMDDIFKDDEPDSYADKRS

SEQ ID NO: 14994 - protein, 551 aa, Mycobacterium avium subsp. paratuberculosis K-10
MSSAGENTRRAEPVEPRGAAVLDSAHLGDIEGAFGRIRVGETEHARTWKTRLLTLLAIVGPGIIVMVGDNDAGGVATYAQAGQNYGYSLLWVLLLLVPVLIVNQEMVVRLGAVTGVGHARLINERFGRGWGWFSVGDLFLLNFLTIVTEFIGISLAAEYIGVSKYVVVPVSAAALVAIMASGSFRRWERAMFIFIAITLLQIPMLLMSHPQWGRAAKSFVVPSISGGVSSDAVLLIIAIVGTTVAPWQLFFQQSNVVDKRITPRFMGYERADTVLGAFVVVIGAAALVMTGDWAARSTDTVGGFTDAGATAHLLGQHRQVLGSIFAIVLMDASIIGAAAVTLATSYAFGDVFGLKHSLHRGFADAKQFYLSYTAMVVVAAAIVLIPGAPLGLITTAVQALAGLLLPSASVFLLLLCNDREVLGPWVNRAWLNWVAGLIVGTLLLLSGILMATTLFPDLNVVAVAGYLTLALIILAAGAAPVLRWLARRQPARPGPRLPARGVDRSTWRMPPLALLEPVTWSPGTRLAMIALRGYLVVGALLLVVKAIQLSR

SEQ ID NO: 14995 - protein, 370 aa, Thermotoga maritima MSB8
MRVLGLILAGGKSDRLWPLTKVRASAAVPVFGKYRAIDFTLSNMVNSGIRKVGILTQYNPRSLMDHLGSGKEWDLDRKSGGLFILQPYVGPNREVWYRGTADAIFQNMTILRRGEEDHVLIGSGDHIYKMIYRDLFNYHLKKGADITLVVKELDETYNLSEYGIVQLDDDMRVVEIEEKPAHPKGNIAFLGVYFMNKELLKELLYATVPQGKYDLLLDIVIPNLDRLKVYAYRFDGYWRNVKKGIKEYYRINMDILKKEVRDELFYRNGKVYTKLKDLPPPKFTTTAVVENSLIADGSIVSGTVRNSVIFRNVRIKVGAVVENSIIMENTVVEEGAVLRNVILDKNCIVREGRVIEGDTELPVFEKRAVL

SEQ ID NO: 14996 - protein, 423 aa, Thermotoga maritima MSB8
MGNTVAMILAGGQGTRLGVLTERIAKPAVPFGGKYRLIDFTLSNCVNSGIYRVGVLTQYRPHVLSKHIGIGRPWDLDRKDGGVEILPPYVGRHESDWYKGTANAVYQNLEFLEENDAELVLILSGDHVYAMNYNDLIDYHLLKEADGTIACMEVPIEEASRFGIMITDVDGRIVDFEEKPAKPRSNLASLGIYVFNYEFLKKVLIEDENDPNSSHDFGKDVIPRILRENLGSLYAFRFDGYWRDVGTLRSYWEANLELVLPVPPFNLYDPNWRFFTHTEEMPPAYVAPGSKVSTSLVSEGAEVYGNVFNSVIFQGVKIGRGTVVKNSVIMTRTEIGENCYLENVIIAENVKIGSNVRMGVGEDAESKLDPKVYSGLLTVVGMNSVIPDDMVIGKNCVIGIGVRPEDFKSKTLESGDYVIVREE

SEQ ID NO: 14997 - protein, 475 aa, Oryza sativa
  misc_feature (272)..(272): Xaa can be any naturally occurring amino acid
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQATIKIQTAFRGYLARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAXGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMAPPSPMRRHSGPPKVEVVKDIAEPPQPEALVINGGSK

SEQ ID NO: 14998 - protein, 1579 aa, Candida glabrata CBS 138
MLVKVPILGRETIHVGYGVRSHIVETIVGLKSSTYVVINDSNVGRVPYFQELLSDFEAQLPAGSRLLRYVVKPGEANKTRATKEQIEDYLLSEGCTRDTVIVAVGGGIIGDMIGYVAATFMRGVRVVQVPTSLLAMVDSSIGGKTAVDTPLGKNFIGAFWQPEFVLVDIKWLQSLPKREFINGMAEVIKTACIWNADEFQRLETHADEFLHVVNTPKISEKEGFQLYDTDIESIKEHIFKLVLESIKVKAEVVSSDERESSLRNLLNFGHSIGHAYEAILTPQALHGECVSIGMVKEAELSRYLGILSATQVARLSKILVAYGLPVSKDEKWFRELTLNKKTPLDTLLKKMSIDKKNDGSKKKVVLLETIGKCYGKSAHVVSDEDLRFVLTDETLVYPFNNIPRDQNKTVTPPGSKSISNRALVLAALGKGTCRIKNLLHSDDTKHMLTAVQELKGANISWEDNGETVVLEGQGGSTLVACENDLYLGNAGTASRFLTSVAALVNSTSQKDHVILTGNARMQQRPIGPLVDSLRNNGIKIDYVKNEGCLPLKVHTDSVFKGGRIELAATVSSQYVSSILMCAPYAENPVTLALVGGKPISILYVEMTIKMMEKFGIKVEKSTTEEYTYIIPKGHYVNPAEYVIESDASSATYPLAFAALTGTTVTVPNIGSASLQGDARFATDVLQPMGCSVTQTATSTTVTGPPVGHLKPLKHVDMEPMTDAFLTACVVAAVAHDNDPTSKNTTTIEGIANQRVKECNRIEAMCTQLAKFGVRTNELPDGIQVHGLHSINDLKVPSIGNEAVGVCTYDDHRVAMSFSLLAGMVNSEQPNSSNPTPVRILERHCTGKTWPGWWDVLHTELGAQLDGAEPLELNSMKNAKKSVVIIGMRAAGKTTISRWCAAALGYKLVDLDTLFEERYGHGMIKDFVSQHGWEKFREEEARIFKEVIENYGDAGYVFSSGGGLVESSESRRILKSFSKSGGYVLHLHRDIEETIMFLQKDPTRPAYVEEIREVWNRRESWYKDCSNFSFFAPHCNSEVEFQNLRRAFTKFIRTITGVTTVDIPTRRSAFVCLTFENLTEYTNSLKAITYGCDAVEVRVDHLSNMDEDFVSKQISILRASTDGLPIIFTVRTKKQGGKFPDEDYETLQKLLITALKVGVDYIDLELTLPIGIQYKVLNMKRNTKIIGSHHDFASAYPWDHSEWENRYNQALAMDVDIVKFVGMAKSFEDNLMLERFRDSHTTKPLIAINMGAHGRVSRVLNTILTPVTSEHLSEVAAPGQLTVAEINRIYTEMGGITKKDFFVVGSPIGHSRSPVLHNTGYSVLGLPHHFDKFETTSAEEVKKHLLDNKANLGGLAVTIPLKLDIIKYMDELTESAKVIGAVNTVIPLGNSKFKGDNTDWLGIRNSLVSNGVPESVSGLSGLVVGAGGTSRAAIFALHKLGCQKIFIVNRTTEKLEELVKFFPEEYNIVPIKEAEEAEAVNETIGVAVNCVPADKPLDAKLESLLERLLLKSSHTHFVSTLVEAAYKPSVTPVMKLAKDKYQWRVVPGAQMLVHQGVAQFETWNNCRAPFKAIYDAVTEI

SEQ ID NO: 14999 - protein, 383 aa, Streptomyces avermitilis MA-4680
MTPTTETMVGIGGAAESTDMVLNIGPQHPSTHGVLRLRLVLDGERIQHAEPVIGYMHRGAEKLFEARDYRQIIMLANRHDWLSAFSNELGVVLAVERMLGMEVPERAVWTRTLLAELNRVLNHLMFLGSYPLELGGITPIFYAFTEREELQHVMEEISGGRMHYMFNRVGGLKEDLPAGWATRARACVAALRSRLDVYDDLVLGNEIFRGRTRGVGVLTPEAVHAYGVSGPIARGSGVDFDLRRDEPYLAYGELQDTLKVVTRQEGDCLARFECLLEQTHNALDLADACLDRLAELPPGPINQRLPKVLKAPEGHTYAWTENPLGINGYYLVSKGEKTPYRLKLRSASFNNIQALTELLPGTLVADMVAILGSLFFVVGDIDK

SEQ ID NO: 15000 - protein, 445 aa, Triticum aestivum
  misc_feature (98)..(98): Xaa can be any naturally occurring amino acid
  misc_feature (316)..(316): Xaa can be any naturally occurring amino acid
MAAHAALAATRIPTSARLHSKAASRQRVDFADFSGLRPGSCSVSAAAREASFSDVLGAQLVARASGENAVRAPAEAKLKVAINGFGRIGRNFLRCWHXRENSPLEVIVINDSGGVRNASHLLKYDSMLGTFKADVKIVDNETISVDGKNIQVVSNRDPLKLPWAELGIDIVIEGTGVFVDGPGAGKHLQAGAKKVIITAPAKGADIPTYVVGVNEGDYDHDVANIVSNASCTTNCLAPFAKILDEEFGIVKGTMTTTHSYTGDQRLLDASHRDLRRARAAALNIVPTSTGAAKAVSLVLPQLKGKLNGIALRVPTXPNVSVVDLVINTVKTGITADDVNAAFRKAADGPLKGILDVCDEPLVSVDFRCSDVSTSIDASLTMVMGDDMVKVVAWYDNEWGYSQRVVDLAHLVAAKWPGAGTGGSGDPLEDYCKTDPNAVECKVFDE

SEQ ID NO: 15001 - protein, 282 aa, Zea mays
MTAVALALPTDDDKDGGRRGVDHSPTAPAPPPPPPPPQELVMVARAVQRLVARNDAVVPPAPDGRGGGRRLGMRAFEAAEGAAAPRIGVPEYLERVHRYAALDPECYVVAYAYVDMAAHRRPAAAVASRNVHRLLLASLLVASKVLDDFHHSNAFFARVGGVSNAEMNRLELELLDVLDFAVAVDHRVYRRYREHLEKETTLMMLRRDDGHGPPVPVPGSGAAPTKSRTAASSVVKPPLTEDRRRPAEAGDADGGGEHDDRRKLPNSATAAASLRELWAFDY

SEQ ID NO: 15002 - protein, 451 aa, Salinibacter ruber DSM 13855
MPQTQKPDFPGNDLGDQFRFWPKHNEKIYERLENKHAWLEEKRAAAQGDGKPPATQRSEVDPLENEMILNIGPQHPATHGVLRCVVKMDGETIEKSVLDIGYLHRGIEKLAEHKTYQEFMPYTDRMDYLSPYSNNVAWCLAVEKLADIEVPERAQWIRMIMSELARISSHCLWLGVGMMDAGAVSGFVWTFQEREEIYSIMDEVAGARFTVSHSRIGGVANDFSPRAIEMIRDFVDTFPDRIAGWEGLLNKNRIWVERNKGVGRVTKEEALELGLTGPNLRGSGVPYDVRRFEPYLKYDEVDFTIPVREEGDCLARYFLRLDEMKQSVRIIEQCLDRMTEGPIRSDDAKEAYPSKEEVYYSMEGMIHDFMYTDVGTVPPKGAHSYHAIEGPKGELGFYLTSDGTGRPWRVRINAPSFTNLQAMEHMLEGEMVADTVVIIGSLDPVMGEADK

SEQ ID NO: 15003 - protein, 452 aa, Shigella flexneri 2a str. 2457T
MLSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFFYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHEQLLQKRNGG

SEQ ID NO: 15004 - protein, 529 aa, Salinibacter ruber DSM 13855
MPTGRRTTDCTLKFSAPRFGKALFPSKLSLFVSGMPDTFENYIGGRWTGAASQATFDNRNPADPDDHIGDFPDSAPADVDAAVQAAQDAFSDWGSTPAPDRGKILKASGDLLAERKDEIARSMTREMGKPFFETKGDVQEAIDTAYYAASETRRLFGTTVPSELPDKMNMAIRRPLGVCGIITAWNFPVAVPSWKIFPALAAGNTIVFKPSEDAPHSGLRFVQTLIDAGIPDGVINVVHGADEAGQALVEHPEVDAIGFTGSYEVGTAIAETCGRLNTPVSLEMGGKNPMIVMDDADLDLALEGAIWGAYGTTGQRCTATSRLICHESVHDELVAMIRDEAEALVLGDGNDADTDVGPLINQAAAETVHRYVEIGQEEGATLEMGGAPASVDGLDGHFYEPTLFTDVTPDMTIAQEEIFGPVLATFEVGSYDEAVTVANDTQYGLSSSIYTQDVNKSFRAMRDLEAGITYVNGPTIGAEAHMPFGGVKDTGNGQRDGGYAAFEFWTEHKTLYVDYSGQLQKAQMDSVED

SEQ ID NO: 15005 - protein, 458 aa, Oenococcus oeni PSU-1
MLELPKEFIAKYRRLLGKEADDFLASFQMEADNGFHLNPLKDLRQFASLKRQAPIPWNRENGRYGKIFGESVAFLSGVAYSQEPSAQFVARVVDAQPGEKILDLAAAPGGKSTQIAADMNNQGLLIANEISFSRAKILSENIERSGITNCIVTNHRPDELAEHFENYFDKILLDAPCSGEGMFRKDPQAIKYWHSDYSSECANRQKEILKSVLSMLRPNGQLIYSTCTFAPEEDEQIVAWLLDNYSELSLLKIRKKDGIEDGRPQWADGNRELKNTARLWPNKIKGEGHFVARLIKSKGKNQKNKVNQLRSNLSRNDSQNLQNTFKENQFDFPIKQIYRFGDYLYLFPENCPEISGLKVLRLGLQIGRLKNKRFLPTHSLALSSLGNKISQTYDLSDYEFRQFIHGDIITNLKGNFVKGWVLMTKQSNGIGIGRYSDKVIKNFYPKGLRKTIHDQPRS

SEQ ID NO: 15006 - protein, 363 aa, Oryza sativa
  misc_feature (34)..(34): Xaa can be any naturally occurring amino acid
  misc_feature (81)..(81): Xaa can be any naturally occurring amino acid
GSTTGAARTGGSGGDAAAGGGGGSAGNGKPLPPXCVKARAAAPESEAKCHATVVSGWFTEPRSRGGKTSKVQYYNNPMWPXSTYGKVLVLDGIVQLTDKDECAYQEMITHLPLCSIPSPKKVLVIGGGDGGVLREICRHGSVESIDICEIDQLVIDVCKDFFPDLSVGFKDPRVRLHVGDAVEFLRNAPEGTYDAIIVDSSDPIGPAQELVEKPFFDTIARALRPGGVLCNQAESMWLHTHLIQDMLSICRETFKGSVHYAWTSVPTYPSGVIGFLLCAKEGPPVNFLTPANPIEKLEGAMEAGRDIRFYNSEMHRAAFVLPTFARRELEAYCTTVEREQQEETTAEPLKMNIMPNSEILTAS

SEQ ID NO: 15007 - protein, 223 aa, Aspergillus oryzae
MSGHHHHDHGSHCHGDDGHDHSNDITPALQSLLYSQIQFDSIVTLNETIPNAGAAIVRKTWAERLNDQPELESDADEQLLMYIPFTGQVKVHSLLIYTAPTPAAPKTLKLFKNRDDLDFATASELKPTQSVEIPQPVPGADVYDLPLNRAQWNATTSITLFFEGNWSDGNEDVTKVGYVGFKGQFMALNREPISFLYEAAANPSDHVAIQGVTGVGGRIMPGQ

SEQ ID NO: 15008 - protein, 181 aa, Coprinopsis cinerea okayama7#130
MSAAQKLQQHPVFVQAQNKASFYVNQLDKELTKYPVLNNLEQRTQVPKAYAVIGTLLLVVVLHTFNALAAPVSNLVGWGLPAYLSFKAIESPSPHDDVQWLTYWVVFGFFNFLESFALRLVLYYVPWYFAFKSAFIVWLQLPAFRGAQKIYFTALKPILQNISSQTKVVAPTTSTNAEQSD

SEQ ID NO: 15009 - protein, 455 aa, Oryza sativa (indica cultivar-group)
MSKPQQQSPPSTTTSSPPPPPASTPPPASSSRSLLSALRRSPVTTLVAAFFLLALFMYGEDVRTLAELSIDDYLYPDADFYNVSALPPLLLPPTTCDLSRGRWVFDNNSLPAYREKECTFLTKQVSCLANGRPDDLWQYWRWQTNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGVPDVWNQILYTRILSKSSPPSTHPSLPPQ

SEQ ID NO: 15010 - protein, 350 aa, Zea mays
MAGSDEVNRNECKGAVPIHTWVLISNFKLAYNMLRRADGTFDRDLAEFLDRRVAPDARAQEGVSSFDHVIDTSTGLEVRIYRAAANNNGGGGATLPILDFLGGTPAASTPFPVILFFHGGSFAHSSSGTAIYDNLCRRLVRLSKGVVVSVNYRRAPEHRYPCAYDDGWAALKWATSQPSLGSGSSGGARVFLSGDSSGGNIAHHVAVRAADAGINICGNILLNAMFGGTERTESERRLDGKYFVTLQDRDWYWKAYLPEDADRDHPACNPFGPNGRRLRGLPFTKSLIIVSGLDLTCDRQLAYAEGLQQDGHHVKVVYREKATVGFYLLSNTDHYHEVMEEIGDFLAANL

SEQ ID NO: 15011 - protein, 408 aa, Xanthomonas oryzae pv. oryzae KACC10331
MSVRQCYRTCPSTVRAVCRVVLPGKRPVRGRKSSPDRPLRPPARLHGAVKVKRPVVPSGTDPARAPIIDAHHERLRMTIAEDLPTVLGLPQIQSLAAPDMAAVDAVIRRRLASDVMLINQIADHIISAGGKRLRPMLVILAGHAAGGSGPEHHQLAAIIEFIHTSTLLHDDVVDESDLRRGRSTANALWGNAPSVLVGDFLYSRSFQLMVELDRMEVMQILADTTNRIAEGEVLQLLHVHNPDTDEAAYLRVIERKTAVLFAAGTRLGALASGADAQVQQQLYDYGMQLGFAFQIADDVLDYAAEAAELGKNLGDDLAEGKATLPLIHAMAHSDATTRERLRQIVEQGDAAAMPDVLAAIHATGGLDYSRQRAGEYAAAAEQALDTLPYSPAVAALRGLARYAVERTH

SEQ ID NO: 15012 - protein, 720 aa, Shewanella sp. ANA-3
MSSLESSSESIAVNTLGQTSRRAARAQAQAFIDTLKPLQHPNSQKLYLQGSREDLRVGMRQILQTDTRIGGTAAEPTVEKNPPIPVYDCAGPYSDPAAQINVRQGLAKLRLPWIIERQDTEVLDCATSDFTQQRLKDDGLDHLRFEAGSSAIVRPRRALPGKRVSQLHYARQGIITPEMEYVAIRENMALAEVQDEILNRRGQGESFGTVIGKSITPEFVRDEIARGRAIIPLNINHPEAEPMIIGRNFLVKVNANIGNSAVTSSIEEEVEKLVWSTRWGADTVMDLSTGRYIHETREWIIRNSPVPIGTVPIYQALEKVNGVAEHLTWEVFRDTLIEQAEQGVDYFTIHAGVLLRYVPMTAKRVTGIVSRGGSIMAKWCLSHHQENFLYTHFREICELCVAYDVSLSLGDGMRPGSIADANDEAQFAELETLGELVKIAWEYDVQTIIEGPGHIPMQLIKENMDKQLIHCAEAPFYTLGPQITDIAPGYDHFTSGIGAAMIAWYGCAMLCYVTPKEHLGLPNKQDVKQGLIAYKIAAHAADIAKGHPGAQIRDNALSKARFEFRWEDQYNLGLDPDTARAYHDESLPQESAKVAHFCSMCGPKFCSMKITQDVRDYAASLAAGALAGASSSQNNETTEALASINSAPQGQASKEAIQQIRVKTQDELAAAMAQKSAEFAASGAKLYLPLGDANAANTANESAKHQDGTELQPTVQVAEV

SEQ ID NO: 15013 - protein, 248 aa, Triticum aestivum
MAARLHHFLLLAALLLLIGGASSAGDVVAAGNGKVRMELYYESLCPDSFEFMVDSLARVFKDGLLDAADLTLVPYGNAKVDAHGAITCQHGPDECLLNTVEACAIDAWPDVNVHFGFINCMEELAMEYKHQEWQSCFQKQGLHPKPVMECYKSEHGHKLSLRYGRQTDALLPRHTSVPWVVVDGKPLYDNFGDFVAYICKAYKGRPPKICQHKQPGRDHPAVQQAAEAGHRVGYTPAISCSMMRRRQD

SEQ ID NO: 15014 - protein, 444 aa, Synechococcus elongatus PCC 7942
MISTVSKPRVVVIGGGFGGLYTALNLGKTSVELTLIDKRNFHLFQPLLYQVATGEISPGDIAAPLRAIVGRNPNTRVILGEVTDIDPQAHWVRVGDEIVEYDYLVVATGASHHYFGNDQWQPFAPGLKTVEDALEMRRRIYFALEQAEQESDPERQQAWLTFTIVGAGPTGVELAGAIAELTRGEMRKEFRNVDTTKAKVILIEGMDRVLPPFPPELSAQAQVQLEGLGVTVQTKAMVTDIQEDRVVFKTGDDLHEIPSRTTLWAAGVKASPLGKLLAQRTGAELDRIGRVIVQPDLQLPTDPNVYVLGDLAHCPDQAGNPLPGVAAVAMQQGAYLGKALKRRLKSQPVDPFRYQDFGSMAVIGRNAAVARLAGIRLSGFPAWLVWAFIHVWYLIEFDSKLLVMVQWAWTYFNQKRGTRLIVNHHRMSAPAAMTNPAEKELAKS

SEQ ID NO: 15015 - protein, 525 aa, Zea mays
MTAPGHDHTLNASAPPPPSPLSSLRSPPLPFRALPPEGKQSPRYLRSVVGQTLAHVRGGHASAAPPPSALRCPLASAPERQSLLAPAPPPPRGVGQTLAHRTRRPARSHSPPPPMAALSAPLRAVAAGSRVAASDPVKVSCVRSTGSAHFGCAFPYIRASSSAARNLEPLRAIATQAPPAMPQYSSGEKTKIGINGFGRIGRLVLRIATSRDDIEVVAVNDPFIDAKYMAYMFKYDSTHGPFKGSIRVVDDSTLEINGKKVTITSKRDPAEIPWGNFGAEYVVESSGVFTTTDKASAHLKGGAKKVVISAPSADAPMFVVGVNENSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKTASEGALKGILGYTDEDVVSNDFVGDSRSSIFDAKAGIGLSSSFMKLVSWYDNEWGYSNRVLDLIAHMALVSAKH

SEQ ID NO: 15016 - protein, 449 aa, Synechococcus sp. CC9311
MHVSEPKVNGAKIGLPARRLALEVLEAVAAGAYADVALERALRQNPLSPADRGLATELAYGCIRWRQWLDGWLDRLGKVPAHKQPPRLRWLLHLGLYQVLRMQRIPASAAVDTTVELAKRQRLSKLSPVVNGVLRSALRAKEAGETLPVPDQSAERLALCHSLPVWFAESLLSWSGPDKAERVAVACNQVPPLDLRVNRLCSSPDLVAAELAAAGVPTKPIDACPDGLQVLAPAGDLRRWPGFEQGHWSVQDRSAQGVAPLLAPRPGDRILDACAAPGGKATHLAELMGDGGEIWAVDRSAGRLKRVAANAARLGCGSIHALAADATNLLEQQPEWRGFFQRILLDVPCSGLGTLSRHPDARWRVTPATVEELLPLQAQLLAAMLPLLAPGGRLVYATCTIHPAENLAQVNKLLQDHADFQLESEQQRWPDPEGGDGFYTAVITAPVRA

SEQ ID NO: 15017 - protein, 213 aa, Brucella melitensis 16M
MADLPDSLLAGYKTFMSEHFAHETARYRDLAEKGQSPETLVVACCDSRAAPETIFNAAPGEIFVLRNVANLIPPYEPDGEYHAASAALEFAVQSLKVKHIVVMGHGRCGGIKAALDTESAPLSPSDFIGKWMSLISPAAEAISGNALMTQSERHTALERISIRYSLANLRTFPCVDILEKKGKLTLHGAWFDISTGELWVMDHQTGDFKRPEL

SEQ ID NO: 15018 - protein, 266 aa, Thermus thermophilus HB8
MGAVASAVFFRGLFQMVPVLVGVGAGYLLALLLGRVDLSPVREAPWFALPAFTPATLEWGAVLLIAPVALVTVMEHIGDILTNGRVVGKDFFVKPGLHRTLLGDGLATSLAGLLGGPANTTYSENTGVLAVTRVYDPLVLRIAAGFAILLAFIPKLSALLQTLPQGVLGGISMLLFGMIASIGIRTLAEAEIDFTQSRNLIVVSAILVLGLGGAVANLGTVQVAGAAVPLKVSGMALAALVGVVLNLLLPPRLEPRTLLEEEERLP

SEQ ID NO: 15019 - protein, 473 aa, Glycine max
MVVAGGAKFNLRRGNGSSHNVVNGYSSDGDLCRISKSGCFSSVAEVDRDPSCVSFTTFNILAPIYKRIDPQNQGLRESDFRAFWLARNERILDCLLSESSSIMCLQEFWVGNEELVNMYEERLGDAGYNLFKLARTNNRGDGLLTAIRKECLRVMDYKELLLNDCGDRVAQLLHVQSATPFVQNPKGSVPQEFLIVNTHLLFPHDSSLCVVRLNQVYQILQYVELYQRENRLKPMPIILCGDWNGSKRGHVYKFLRSQGFVSSYDIANQYSDSYADSHKWVSHRNHRGNICGVDFIWLCNPNQARKPLKTSWAEAVFSILKFQLRKASLSEDDAFAFLKGDNYADSVTYFSFSEALRQVKLIGVPYGLRFQQLQDLWNQADADGNGVIDFEEFKQKIWNSTCPEHVLENLNGCTEDCNTEQEQEAIGFKVKNAMLYPREVEKGLWPEDYSLSDHARLTAVFSPARMRCSASQN

SEQ ID NO: 15020 - protein, 334 aa, Salinibacter ruber DSM 13855
MSIKLGINGFGRIGRLCFRALLEREEDEIEIVGINDLTDAETLATLLKYDSVHGQFPGDVHLEDSTLVVDEQEFPVFSKKDPTNLPWGDHDTDVVIESTGVFRTYDKASQHLEAGADQVVISAPAKSEVDAMVVLGVNDEILTGDEKVVSNASCTTNCLAPLVKVLDDAFGVESGLMTTVHAYTASQNIVDGPHGDLRRARTAAESIIPTTTGGAKAVGKVLPHLDGALDGMAMRVPTPDGSVTDLTAVVEQDVTVEDVNEAFYEAANGALDGILAYSDDPIVSRDIIHDPHSCIYDAPWTKVAGSQVKLVGWYDNEWGYANRTVDLVERLMNV

SEQ ID NO: 15021 - protein, 252 aa, Lactococcus lactis subsp. lactis Il1403
MSRKPIIAGNWKMNKTLSEAQAFVEAVKNNLPSSDNVESVIGAPALFLAPMAYLRQGSELKLAAENSYFENAGAFTGENSPAAIVDLGVEYIIIGHSERREYFHETDEDINKKAKAIFAAGATPILCCGETLETFEAGKTAEWVSGQIEAGLAGLSAEQVSNLVIAYEPIWAIGTGKTATNEIADETCGVVRSTVEKLYGKEVSEAVRIQYGGSVKPETIEGLMAKENIDGALVGGASLEADSFLALLEMYK

SEQ ID NO: 15022 - protein, 544 aa, Oryza sativa (japonica cultivar-group)
MASAEAECAAAAVGGGGRAEIDTSAPFESVREAVDRFGGSAAWSSHLIRRMFAPPNPKEQSEESKQPVDIKEQAAQLEHDLIIKEKETLDVLKELESTKKIIADLKQRIQKESNETSPSAVKSDDQSEIPITESEEQKPENVNIDMDMEGLDEHPQPLSGSVLLELEQAKANLNRTTGDLAAVRAAIELLHNSIAKEKLLLERSREKLSSNTALASSLEDELDQTTQKLQTLKDLQARREDPSDIFIEIKKMASEVQQLRGMANASKSEAMMLAAEIEQTKASIGTAEIRCIAAKKMEEAARAAEALALAEIKALLSSESSSECGSSVCDGVTLSAEEYFTLCSKAQEADENSRKKVEEAMLQVDVANSSETDSVKKLDDARLEVEECKRALQEALKRVEAANRGKLAVDEILRRWKSENGHKRRSIGGSPKFKNAAQRRKDSHSMDIISDASTNSCKQTLSIGQILSMKLMGPEGYDKTIWDDKTSEMPNVSLGQILNRGRVLSREETAVRKRVSGKRKKFALTGLSVLLAKQAKNKKKRESL

SEQ ID NO: 15023 - protein, 225 aa, Populus x canadensis
MAEGNKSHEYETKVGEESGAVETKDRGLFDFLGKKEEEKPQEEVIATDFEEKLQVSEPETKVEEEHKKKEEEEKKPTLFEKLHRSGSSSSSSSSDEEEGDDEEKKKKKKEKRSLKEKMKISGEKGEEKEHEDTSVPVEVVHTETPHEPEDKKGFLDKIKEKLPGHKKADEVPPPAPEHVSPEAAVSHEGDAKEKKGLLEKIKEKIPGYHPKTEEEKEKEKESASQ

SEQ ID NO: 15024 - protein, 443 aa, Crocosphaera watsonii WH 8501
MNLPPTLSQPRLLRLFKLIFYPLDYLEDNYQRYGDIFVAGKSETPFVYISNPQGIQTILTRDKTDFKTGGGSGFLSTLLGDNSLLFLQGERHRRERKLLMPPFHGERLKSYANLIYSISDKVTDKLQINRSFNVRDIMQEITLKVILKAVFGITEGERYQRLQELLKSWLSFFDSPANAILIFFPWLRKNWGNWTPWGRFLQIKAEIQELIYTEIRERREQKKYEGTDILTLLMLAKDEEGKPLSDQELHDELITLLIAGHETTASALTWALYWIHFCPDVEDKLRFHFSNLNNNTDLLDIVKLPYLDAVCKETLRIYPVLLTTFIRVLQTPLELMGYQFKPGTVFAPAIYLVHHREDIYPNSQQFRPERFLERNFSPYEYFPFGGGSRRCIGMELAKMEMKIVLYTILSKHKLKLPSSRPLKAVRRGLTVAPPSNFKMILSN

SEQ ID NO: 15025 - protein, 616 aa, Populus x canadensis
MAGVNKSHEYETKTSAGEESGATETKDRGLFGFMGKKKEEVPATEYEEKIHRSDNNYPGDGEKKHEDTTVPSNTETPLTQEKKKSYFEQAKDMIPAYKKIEEVPPPTEAVYPSETPLTPEKKKSYFEQAKDMIPAYKKTEEVPPPTESETPLTPEKKKSYFEQAKGIIPAYKKTEDGPPSPAEAAVHPTGTPLEPEKKSYFEQAKDIIPAYKKTEDSPPSPAEAAVHPTGSRPLEPEKKKSYLEQAKDIIPAYKKTEDSPPSPAEAAAHPTGSRPLEPEKKKSYFEQAKDIIPAYKKTEDSPPSPAEAAAHPTGSRPLEPEKKSYFEQAKERTPGYKKTEEVSPRPAEAVVHHTETPLEPEKKGFLDQAKERTPGYKKTEEVSPRPAKAAVHHTETPLEPEEKKGFFDQAKERTSGFKKTEEVSPRPAKAAAHLTETPLEPEDKKSFFDLAKERIPSHKKTEEVPPHPAKSASNEGAFSQTETPFEPEEKGFLDKVKEKVPAHKTEEVPPPAEEKRGFLKEKVPTHKKTEEFPFPAKPAYTEAAVSNTNTPLEPEEKRGLLDKIKEKMPGHKKTEEIPPSEFDSIENVVSHKGEPMVKKGMMEKIKEKLPGHRPQI

SEQ ID NO: 15026 - protein, 294 aa, Populus tremula x Populus tremuloides
MDQYEKVEKIGEGTYGVVYKARDRVTNETIALKKIRLEQEDEGVPSTAIREISLLKEMQHGNIVRLQDVVHSEKRLYLVFEYLDLDLKKHMDSSPEFAKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQKPLFPGDSEIDELFKIFRILGTPNEDTWPGVTSLPDFKSAFPKWPSKDLATVVPTLEKAGVDLLSKMLFLDPTKRITARSALEHEYFKDIGFVP

SEQ ID NO: 15027 - protein, 432 aa, Pseudomonas fluorescens PfO-1
MSHRIVIVGGGAGGLELATRLGKTLGKRGTASIMLVDANLTHIWKPLLHEVAAGSLNSSEDELNYVAQAKWNHFEFQLGRMSGLDREQKKIQLAATYDENGVELVPAREVPYDSLVIAVGSTTNDFGTQGAAQHCLFLDTRKQAERFHQQLLNHYLRAHAGQTDAVQQISVAIVGAGATGVELAAELHNAAHELAAYGLDRIKPENMHITLIEAGPRVLPALPERISGPVHKTLEKLGVNVMTNASVSQVTADSLITADGNEIKASLKVWAAGIRAPAFLKDIDGLETNRINQLQVLPTLQTTRDENIFAFGDCAACPQPGSDRNVPPRAQAAHQQASLLAKSLKLRIEGKTLPEYKYTDYGSLISLSRFSAVGNLMGNLTGSVMLEGWLARMFYVSLYRMHQMALYGPFRTAMLMLGSKIGRGTEPRLKLH

SEQ ID NO: 15028 - protein, 236 aa, Crocosphaera watsonii WH 8501
MSRQSSPSLQPLLGGIIAALLVVISFNSFVVINPGQAGVLSVLGKAQNGALLEGLHFKPPLVSAVDVYDVTVQKFEVPAQSATKDLQDLSASFAINFRLDPVQVVTIRRTQGTLQNIVSKIVAPQTQESFKIAAAKRTVEQAITQRSELKEDFDNALNSRLEKYGIIVLDTSVIDLNFSPEFAKAVEDKQIAEQKAQRAVYIAQEAEQEAQADINRAKGKAEAQRLLAETLKAQGG

SEQ ID NO: 15029 - protein, 484 aa, Mycobacterium avium subsp. paratuberculosis K-10
MSRDDWISADEGPRRTVSTTIPVFNPSTEEQIAEVPDSDQAAVDAAVARARETFELGVWRKAPASHRANVLFRAARIIEERKDELAALESQDNGMNLTAAGHIIPVSVDMLKYYAGWVGKIHGESANLVSDGLLGTWETYHTFTQLEPVGVVGLIIPWNGPFFVAMLKVAPALAAGCSAVLKPAEETPLTALKLEEIFREAGLPDGVLNVITGYGETTGAALTAHPDVDKISFTGSTEVGRLIVKAAAGNLKRLTLELGGKSPLIMFDDANLDKAIMGAGMGLLAGSGQNCSCTSRIYVQRGIYDQVVEGLAEFAKMLPMGGSDDPNSVLGPLISEKQRQRVEGIVNDGVAAGAKVITGGKPMDRKGYFYEATIITNTTPDMRLIREEIFGPVGCVIPFDDEDEVIAAANDTHYGLAGAIWTENLSRAHRVVNELRAGQIWVNSALAADPSMPISGHKQSGWGGERGRKGIEAYFNTKAVYIGL

SEQ ID NO: 15030 - protein, 1883 aa, Coprinopsis cinerea okayama7#130
MTKGYLMNSLIEKMQSPDQDFRFMGLNDLMTEIKQDPASFQGDEAVENKVLNQVLSLVEDKISEVKNQAVKCLGQLIKILRQNQMELVVDKLIDFSGGKDEELRDISGLALKTITAELPPDGRIAATACAKLTPKLLGQVENTETPPETLVETLSILSILISRFPNHLSNATLSPQPLKVLPPLLSHSRPVVRKRAITTVSQFIPISQRILFDDLLKNIILPNLAEGASVERQRTIVQLVAAIVRHSPGHVAPVLGDIVPCILKAIQKDDEELRESCLQALEAFVLRCSAEVTPYQSAIIQAGNQFIKYDPNYAGDDEDEEMADADDDEDDDELDDEYSDDEDTSYKIRRSATKLLGAVIGTRPELLASIYKDISPVLISRFGDREENVRLEIWSTYANLLKQTSVYGGVPQNKDDTSPRGKRKRDTEEVMDIEETAYTLLKSQVPTLSKALLNQIKSPRTSPVVLQAGFSLLNALLAVLPGSLAPQIPQIITVAKNVLSQSPSTSTASLHLTTLSFLSLLFSSHSPASFSSSLPTVTPVLLQSVGERHPRIASESFRVFTSLLASLAPIKGEAPWVDQVYQQAFSRLSSHDTDAEVRTTAEECIGELWIAAPEIMRTKDRREWEFICRSSGKTDGAVKVVTKVAREAPVGDDWVNGCVQWVMGLLQKSGRLGKVEAFGALEVLLKSYTSGIPADLPPALVPQLRHYLSTSDIALLAQALTILALLLELSPAVTYPHVESTSLNDIYKVSASPLVSGPALEALFKFYANLVQADNQISTHLVPNLVIAVQKAPKAEASPANVAKCIAQVVRNAQGVAAGTIAEYSKNIRPNSKAQPSLVILSLLIVGELGRFIDMSNQAEVFNNSIELFASDQEEIRSAAAFAAGNIAIGNLHQFLPVIVKMVETDPKKRLLALHAAKEVVTHCSTGQLEGVADFLWKPLFENSQNAEEATRNVAAACLGKLATTHPSKYLPQLHARVKDDSPATRATVVSAIRYTFADVSQSYDELLAPLLVDFLSLMVDSDLTVRRLALSSLNSAARTKPHLVRDHLKTLLPDLYKETHINPDLVRTVQMGPWTHKVDDGLETRKTAYETMYTLLDTCLTKLDLHVFLSRVIPGLSDDSDEIKVISHMMLFRLSQVAPAAVAQRLEEATPQLENTMKGATVTKDTVKQDLERAAELQRSALRAIAALSKIGAGVSTKFDAFVEDLKKNTKWNTEFKELIGSDRDRDRDRRRDRDRDSDRGHRSSHSGRDRDYDRDRDRDRDRDDKDRDRRRKRGDDDYSDRGGDDRAKRKRSDDDDEQPQPPNGAPPPPPPARDSPRPSDRRNGRDDYDASPRYRDRDRDRRDRRRRDYDDRDRSRRTRSPMPPRRRHSPIYTGPPPDDYNPDEPKDDDSEARSVFVSQLAARLTARDLGYFFEDKLGEGTVMDARIVTDRLSRRSKGIGYVEFRSIDLVEKAIALSGTIVMGLPINVQLTESERNKSHAGDGSLHLPPGVTASGAILYVGSLHFNLTESDIKQVFEPFGELEFVDLHKDPMTGRSKGYAFVQYKRAEDARMALEQMEGFELAGRTLRVNTVHEKGSVRYTQTDSLDDSGGANLNAASRQALMQKLARTEQPVVPAEPVKPIIPQAMQSRSVLLKNMFNPEEETEQNWDKDLADDVKGECENKYGKVLAIKVEKDSQGEIYVKFDTVDTAKSAVQGLNGRWFGGRQISANFISDAIMAAHQTKPTLMTWEQHTIHGGGKPRVDNDVPFAFSRAMSIEHINSNENATFSHILSHATKIASSTGLVFVSGQVPVDATGNLIQGTIQEKTVACLNNIANVLRASGTEWTKVVKVNIYLKDMNDFSRVNQVYETYVPSPKPARTCVQAAKLPNDVDIEIEAIATT

SEQ ID NO: 15031 - protein, 500 aa, Oryza sativa (indica cultivar-group)
MEPWAIRVAYFIVFSFLVTARFGSCAPHSEEGRALPGYRESEQDQSIGSLSNWGEGKLIGRVFNLLLKENMFASETPSESKEHSSISESVPHDSAGFEPCRKCLAKTVHNATPRRLLQARELASNQTQTHPKSQSSPVQSSASHLVPRWAIYALPVAGVLFIAAVATAIYVFFSRRKKDNTVMPWTTGLSGQLKKAFVTGVPSLERTELEAACEGFINVIGTLPECTLYKGTLSSGVEIAVLSTSVNSSQQWSAQSEEQFRNKISVLSRVNHKNFMNLIGYCACEEPFTRMMVFEYAPCGSLFEHLHIREAEHLDWKTRLRIIMGVAYCLEHMSQLDPPPLLPTNLSSSSIYLTEDNAAKIADIEFWKDDINKQDDQESVVYKFGILVLEVISGRRPFSEDDRLLVLWASSYLDGKRPLSAMADRTLVRSSSAAPEKDVAALCDVVRQCVRRPEGGKRAISMGEVARLVRGIAGLSPEQAAPREKPLWWAELEIASSETA

SEQ ID NO: 15032 - protein, 1052 aa, Gossypium hirsutum
MLGNGVVGILSESSKKWERRVPLTPSHCARLLHSGREKTGIARIIVQPSTRRIHHDSLYEDVGCHISDDLSECGLILGIKQPKLDMILPNRAYAFFSHTHKAQKENMPLLDKILAERVSLYDYELIVGDNGKRLLAFGKYAGRAGMIDLLRGLGQRYLSLGYSTPFLSLGASYMYPSLAAAKAAVITVGEEIASQGLPSGICPVIFVFTGSGNVSVGAQEIFKLLPQVFVEPSRLPELFGKGRNVTSKRVFQVYGCIVTSCDMVSHKDPSKTFGKADYYAHPEHYTPIFHEKIAPYASVIVNCMYWERRFPRLLSSKQIQELNKKGCPLVGISDITCDIGGSIEFVNQTTSIDSPFFRYEPLTDSYHNDMDGDGVICSAVDILPTEFAKEASRHFGDILSQFVGSLASTADFTKLPAHLTRACVVHGGTLTTLYEYIPRMRKSDTLDISDNHTNGHINNKKKYSVLVSLSGHLFDQFLINEALDIIEAAGGSFHLVKCQVGQSTDAMSYSELEVGADDGKVLDQIIDSLTSIANPTENHGTPSQQLNKISLKVGKLQETGMKKDSESDPKRKMLVLILGAGRVCQPACELLASIGTAASRQWYKTCLQNDSEEQMDVHVIVASLYLKDAEEIIQGIPNTAAVELDVTDHRALHQYISQVEIVISLLLASCHVAIAEVCVKLKKHLVTASYVDDSMLMMDEKAKNAGITILGEMGLDPGIDHMMAMKMINQAHLKKGKIMSFTSYCGGIPSPAAANNPLAYKFSWNPAGAPKAGRNPATSKSQGETVHVNGDDLYDSAVRFRIPDLPAFALECLPNRNSLTYGDLYGIGHEASTIFRGTLRYEGFSEIMATLARIGIFNAETLPLLKHEGRPTFRNFLCELLKIDTKDMNEVVVGEKKIAERILELGHCKEPGVAVKAAKTIVFLGLNEQTGIPVSCQSAFAVTCHRMEERLTYSNTEQDMVLLHHEVEVDFPDSKQTERHTATLLEFGKAKNGKMISAMALTVGVPVAIGALLLIVNKIKTRGVLGPIVPEVYLPALEIAQAYGIKLMEKTE

SEQ ID NO: 15033 - protein, 651 aa, Burkholderia vietnamiensis G4
MSPLNFPTDRPIDLACLGRVAVDLYAQQYGSRLEDARSFQMYLGGSSGNVAFGVARLGLKTAMISRVGDEQMGRFVRETLEREGCDTSQLQTDPERLTALVLLGLKDRDTFPLLFVRENCADMAVRADEIDEGFIARCRALAITGTHLSTPATREASLTALGYARRHGVVRILDIDYRPVLWGLTARGAGENRYVPDAQVTRQLQQVLGEFDLLVGTEEEFLIAGGAPGDLIASLEAVRRASGAVLVVKRGALGCCVIDGDVPARIDDAPTFHGERVEVLNVLGAGDAFLSGLLSGLLRGRDWAEATRIANACGAIVVSRHACSAAMPTPAELAHWFGGSRNPQVDADRTLAHLHRVTVPRRDWDDLCVMAFDHRSQFYELAVQAGADEARIKTLKRLLVRAAEQVERERHIEGHVGVLIDGGAYGRDALAAATGRGWWVGRPVELPGSRPLCFDDTRSVGSTLTHWPTEQVVKCLVHYHPDDDVDLRVAQEQRVLELWEATRASGNELLLEIIPPRAVTPPGTEDDAVLRTVARFYNLGVMPEWWKLAPMSADGWARLESLVAERDRYCRGAVILGLNQPLQYLVDSFRSATNPIVKGFMVGRSLWVDASLAWLAGRIDDRALIDEVAANFAQLVDAWLGRRDPARAAAA

SEQ ID NO: 15034 - protein, 518 aa, Gossypium hirsutum
MLGNGVVGILSESSKKWERRVPLTPSHCARLLHSGREKTGIARIIVQPSTKRIHHDSLYEDVGCHISDDLSECGLILGIKQPKLDMILPNRAYAFFSHTHKAQKENMPLLDKILAERVSLYDYELIVGDNGKRLLAFGKYAGRAGMIDLLRGLGQRYLSLGYSTPFLSLGASYMYPSLAAAKAAVITVGEEIASQGLPSGICPVIFVFTGSGNVSVGAQEIFKLLPQVFVEPSRLPELFGKGRNVTSKRVFQVYGCIVTSCDMVSHKDPSKTFDKADYYAHPEHYNPIFHEKIAPYASVIVNCMYWERRFPRLLSSKQIQELNKKGCPLVGISDITCDIGGSIEFVNQTTSIDSPFFRYEPLTDSYHNDMDGDGVICSAVDILPTEFAKEASRHFGDILSQFVGSLASTADFTKLPAHLTRACVVHGGTLTTLYEYIPRMRKSDTLDISDNHTNGHINNKKKYSVLVSLSGHLFDQFLINEALDIIEAAGGSFHLVKCQVGQSTDAMSYSELEVSIHN

SEQ ID NO: 15035 - protein, 527 aa, Oryza sativa (indica cultivar-group)
MTKPQQQSPPSTTATTTTTTSPPPPPPSTPPPASSSSSSLAKLPLRLHSLASSSRSLLSALRRSPVTTLVAAFFLLALFMYGEDVCTLAELSIDDYLYPDADFYNVSALPPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSSKIGIGGRWFNTDAVITFCQFNIDEPCISATGSLELWNILKYRHRVRWFPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGVPDVWNQILYTRILSKSSPPSPHPPLPPQ

SEQ ID NO: 15036 - protein, 454 aa, Pyrococcus furiosus DSM 3638
MELRPNVKEIPGPKAREIIEKHHKYMATTTNDPNEYFLVIERAEGVYWIDVDGNVILDFSSGIGVLNVGLRNPRVVEAIKKQLDLVLHAAGTDYYNPYQVALAEKLVQITPGDFEKKVFLSNSGTEANEAALKIAKWSTNRKMFIAFIGAFHGRTHGTMSLTASKPVQRSRMFPTMPGVEHVPYPNPYRNPWHIDGYENPDELINRVLEYIEEYLFSHYVPAEEVAGIVFEPIQGEGGYVVPPRNFFKELKKLADKYGILLIDDEVQMGIGRTGKMWAIEHFGIAPDIITTAKALGGGIPIGATIFRKDLDFGVSGVHSNTFGGNAVAAAAALAVMEELENGLLENVQKLEPLFRERLEEMKEKYEIIGDVRGIGLAWGVEFVKDRKTKEYATKERNEVVVEALKRGLALLGCGKSAIRLIPPLIISEEEAKIGLDIFEEAIRVVSERYGYKIH

SEQ ID NO: 15037 - protein, 432 aa, Wolbachia endosymbiont of Drosophila ananassae
MRKLRFNVMNKIINNVFAREILDSRGYPTIEVEIELCDGAIGRASVPSGASTGKLEALELRDQDEKRYCGKGVLKAVQAVNGIIADEIIGMNAADQNAIDKALIELDGTKNKSKLGANATLGVSLAVAKAAANSFKMPLYRYLGGKQTSVMPVPLINIINGGVHADNKLDFQEFMILPVGAETFSEAIRISAEVFHNLRSILKKKGYSTNVGDEGGFAPNIESTEEALDLIIYAIESAGYSAQSDFALGLDVASSTFYEDGIYEFESKGLTSEELTEYYCNLVERYPIISIEDAMSEDDYEGWKLLTAKLGNKIQLVGDDLFVTNCELICKGIEEKMANAVLIKPNQIGTLTETFAAIEMAKSNGYKAVVSHRSGETEDTTISHIAVASNCGQIKTGSLSRSDRLAKYNELMRIESTLGKDAKYYRGLAWVL

SEQ ID NO: 15038 - protein, 424 aa, Brucella melitensis 16M
MIEKNTSLDGLTDNAHGHPQYLALEPRDRALVRAILGSALHNRGSIERAINKRLDRPLPENAVALKHLLHVAVAQIFYLDLPDHSAVDLAVEAANSDPRNRKYAGLVNALLRRLARNKERALAHTFEPEANVPEWFAKSITDAYGTEKAATILAMHAYEPPIDFTVKGDAKAWAEKLGGVALPNGSVRLQTVESNLTDLPGFAEGEWWVQDVAASLPARLMDDIKGKRVADLCAAPGGKTAQLVLQGADVTALDLSENRLKRLNANLERLGFEAKTVATNLMDFKPDELFDAVLLDAPCSSTGTVRRHPDVPWTKTPQDIAKLAELQGKLLAHAATLVKPGGVIVFSNCSLHPLEGEEMARKAPENPLLEPFPITEQDCPGLEGLVTAEGFLRSTPADLPPDRLDGNPHMAGMDGFFAARFKRV

SEQ ID NO: 15039 - protein, 205 aa, Haemophilus influenzae R2866
MSEIKLNYHKTHFLTSAPNIRSIPEDTGIEIAFAGRSNAGKSTALNALTNQKNLARTSKTPGRTQLINLFEVEPNCKLVDLPGYGYAAVPEQMKIQWQKSLGEYLQKRECLAGLVVLMDIRHPLKDLDQQMIEWAVSANLPILLLLTKADKLSQSARSKQVKMVREAILPFQGDIQVEAFSAQNKIGIDKLAAKLDFWFSPLFAK

SEQ ID NO: 15040 - protein, 517 aa, Oenococcus oeni PSU-1
MIELEKKYDKILVLDYGSQYNQLITRRIREFGVFSELKSRKMTIDEIKDYVPKAIILSGGPKSVYADDAFTIDPEIFRLGIPILGVCYGMQLMAYVLPGGKVLPNDGNGEFGQAALHFDENSLLFANTPEGQKVLMSHGDSVEAVPEGFVVAAKTDKTKIAAIADDDKKLYGAQFHAETTLSEYGNQILKNFVFKIAQCQANWQMKDFINDQIEKIRTEVGNKKVLLGLSGGVDSSVVAVLLHKAIGRQLTCIFVDHGLLRKNEAKLVMESLAGKFGLNIIKVDAQKRFLDKLEGISEPEQKRKIIGKEFIETFNDEAKKLDGIDFLAQGTLYTDVIESGTDTAQTIKSHHNVGGLPKEMHFKLIEPLRTLFKDEARKLGEEMQMPHALVWRQPFPGPGLAIRILGEITEEKLAVVRDSDAILRDEIAKAGLEDSVWQYFTILTGLRSVGVMGDGRTYDWTIAIRAITSVDGMTADFAKLPWDLLGKISERIVNEVGHINRVVYDITSKPPATIEWE

SEQ ID NO: 15041 - protein, 434 aa, Lactococcus lactis subsp. lactis Il1403
MSQKNEQSQEQSNSKSAVLGLQHLLAMYSGSILVPIMIAGALNYSATQLTYLISADIFMCGLATFLQLQLRKHFGIGLPVVLGVAFQSVAPLIIIGQRHGSGAMFGSLMVAGVFVILVSGIFSKIRKLFPPIVTGSVITTIGLSLIPVAIGNMGNNVDKPTIQSLILAVSTIVIILLINIFTTGFIRSIAILIGLIAGTILAASMGLVDFSVVSQAPWAHLPQPFYFSAPKFYLADSLMMIIIAIVSLVESTGVYLALADITGENLDEKRLRNGYRAEGFAVFLGGVFNTFPYTGFSQNVGLVQLSGIKTRKPIYFTAGFLIVLGLIPKFAAVAQLIPTPVLGGAMLIMFGMVATQGIRMLAKVEFEGNQNLLIAAVAIAMGVGFNSTNLFTALPSFIQPFVSNGIVMSTVSAIILNLVFNHGKKDELVTDETK

SEQ ID NO: 15042 - protein, 463 aa, Yersinia pestis KIM
MELPVKNKLKRGLTTRHIRFIALGSAIGTGLFYGSADAIRMAGPSVLLAYLIGGVVAFVIMRALGEMSVNNPQASSFSRYAQDYLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMLLSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 15043 - protein, 270 aa, Arthrospira platensis
MTIATETKLKLDWMTIVFMAFLHIGALFVLVPSNFSWAAVGLALFLHWVTGGLGITLGFHRLITHRSFETPKWLEYFLAFCGTLACQGGPIQWVGLHRMHHLYSDQTLDPHDSNKGFWWSHMGWMLREIPADADVPRFTKDINEDPVYLFLQNYFIPIQVALGVVLYLLGGWPLVVWGIFFRIVVVFHCTWFVNSATHKFGYQTYQSNDNSKNCWWVALVTYGEGWHNNHHAFQYSARHGLKWWEIDLTWMTIQLLQFLGLAKKVKLVEN

SEQ ID NO: 15044 - protein, 467 aa, Listeria monocytogenes str. 1/2a F6854
MLYSEDDKRKQESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKDMSYLGTSTVGSSEACMLGGLAMKFRWRNNAEKRGLDIQAKRPNLIISSGYQVCWEKFCVYWDVDMRVVPMDKNHLSLDVDKVFDLVDEYTIGVVGILGITYTGKFDDIQLLDEKVEAYNATNEHQLVIHIDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTALYLAKTVEKSGYFEIINDGANLPIVCYKMKEGLDVEWTLYDLADQLLMKGWQVPAYPLPADLSDTIIQRFVCRADLGYNVAEEFAADFADAIHNLEHARVLYHDKERNDSYGFTH

SEQ ID NO: 15045 - protein, 483 aa, Mycobacterium avium subsp. paratuberculosis K-10
MPATPIGLRAQLLRRRPVVGAHVAPGTADHLRRGIGTFQLTMFGVGSTIGTGIFFVMSQAVPEAGPAVIVSFLLAGVAAGLAAVCYAELASAVPVSGSSYSYAYTTLGEVVAMGVAACLLLEYGVATAAVSVNWSGYLNKLLSNVVGFQLPHALSAAPWDAQPGYVNLPAVMLIGMCALLLIRGASESAKVNAIMVMIKLGVLVVFGILAFTAFDVHHLDDFAPFGVAGVGTAAGTIFFSYIGLDAVSTAGDEVTNPQKTMPRALIAALSTVTGVYVFVALAALGTQPWQDFGGQQEAGLATILDHVTHGSWASTILAAGAVISIFSVTLVTMYGITRILFAMGRDGLLPPRFARVNPRTMTPVNNTVIVAVAASTLAAFIPLQNLADMVSIGTLTAFVVVSVGVIVLRVREPDLPRGFRVPGYPVTPVLSIMACGYILASLHWYTWIAFSGWVLLALIFYFVWGRHHSALNDAAVDPSGQER

SEQ ID NO: 15046 - protein, 420 aa, Ralstonia metallidurans CH34
MKNAELVRRKDAATPRGVGVMCNFYADRAENSEIWDVEGKRYIDFAAGIAVLNTGHRHPRLVAALQAQLNRFTHTAYQIVPYASYVELAEKINQRAPGRSARKTAFFTTGAEAVENAVKIARAATGRPGVIAFSGGFHGRTMMGMALTGKVAPYKTGFGPFPGEVFHAPYPSALHGVTVEDSRRALEHLFKADIDPRRVAAIIFEPVQGEGGFNVAPPEFVRMLRAVCDEHGILLVADEVQTGFGRTGKLFAMEHYDVAPDLTTMAKSLAGGMPLSAVCGRAEIMDAPAPGGLGGTYAGNPLAVASALAVLDVLESENLIARGAELGERLTARLNSLKPRVPQIAEVRGIGAMVAVEFRRADGSPDAEFTREVQNRALERGLLLLSCGVYGNVIRFLFPLTIQDAVMNEGLDILADVLTR

SEQ ID NO: 15047 - protein, 881 aa, Thermotoga maritima MSB8
MAKKYVYFFANGKAEGRADMKDILGGKGANLAEMTNLGIPVPPGFTISAEVCKYYYDHGRTYPEELKEQVEEAMRRLEEVTGKKFGDPNNPLLVSVRSGAAISMPGMMDTVLNLGLNDETVKGLAKLTNNERFAYDAYRRFLQMFGDVVLKIPHEKFEKALEELKKEKGVKLDTELDAEDLKKLVERYKQIYKEEGKEFPQDPWKQLWLAIDAVFGSWMNERAIKYRQIHGIKEGDLLGTAVNIVAMVFGNMGEDSGTGVAFTRDPNTGEKKPYGEFLPNAQGEDVVAGIRTPLKLEELKNRMPEVYNQLLEIMDKLEKHYRDMQDIEFTVERGKLYILQTRNGKRTSQAAIRIAVDMVHEGLITKEEAILRVRPEDVEQVLHPVFDPKEKAQAKVIAKGLPASPGAATGKVVFNAKKAEELGKAGEQVILVRPETSPEDVGGMAAAQGILTSRGGMTSHAAVVARGMGKPAVVGAESIEVHPEEGYFKVGDVVVKEGEWISIDGTTGEVLLGKVTTIKPQGLEGPVAELLQWADEIRRLGVRTNADIPRDAEVARKFGAEGIGLCRTEHMFFEKDRIPKVRRMILAKTKEEREKALDELLPLQKEDFKGLFRVMKGLPVTIRLIDPPLHEFLPQEDEQIKEVAEQMGVSFEELKNVVENLKELNPMLGHRGCRLTITYPEIAVMQTKAIIGAAIELKKEEGIDVIPEIMIPLVGHVNELRYLKKIIKETADALIKEAGVELTYKIGTMIEVPRAAVTAHQIAEEAEFFSFGTNDLTQMTFGFSRDDVGKFLPEYLEKGILEHDPFKTLDYDGVGELVRMGKEKGRSTRPDLKVGVCGEHGGDPRSILFFDKIGLDYVSCSPYRVPVARLAAAQAALKNKK

SEQ ID NO: 15048 - protein, 428 aa, Trichodesmium erythraeum IMS101
MSDSLFDDASRRLERALQYVSLSEDTKERLKYPKATLIVSIPVRMDDGSLRVFQGYRVRYDDTRGPTKGGIRYHPNVSIDEVKSLAFWMTFKCAVVSLPFGGAKGGITVNPKELSRMELERLSRGYIDAIADFIGPDTDIPAPDMYTNPMIMGWMMDEYSIIRRQLSPAVITGKPVSIGGSLGRNTATAMGAFFAIETIMPKFEYTPEKTTVAIQGFGNAGAFLAELLCLHGYKVVAVSDSQGGIYSAQGLDIPSIRQYKEVNKQIQAVYCKDSVCNIVEHTVLTNEELLALDVDILIPAALENQITEENVKDIQAKFIFEAANGPTTSGADKILEDRGVYVFPDILINAGGVTVSYFEWVQNRSGLYWTLDEVNQKLKAKMVAETENIWQISQELSISMRTAAYVHGLDRLGQAINAKGTRAFYAKR

SEQ ID NO: 15049 - protein, 499 aa, Ralstonia metallidurans CH34
MSELKDLEYWRGRARALPIPAHAYIDGQWTSAADGATFDCINPATGEQLARVAACGAADVDRAVAAARRAFEAGVWSAMPRRERKAVLLRLAALIETHREELALLETLDMGKPIGDTMLYDIPEAARTYAWYAEAIDKVYDEIAPTDAGVLATITREPLGVVAAVVPWNYPLLMASWKVAPALAAGNSVVLKPAEQSPLTAIRLAALAEEAGVPPGVFNVVPGLGAEAGQALGRHPDVDCLAFTGSTATGKRFMEYSGQSNLKRVWLECGGKSPHIVFDDCPDLDRAALAAAIGIFNNQGEICIAGSRLYVQRGIYDTFMAKLEAHAAAMQPGDPLDPRSAMGAIVDGRQFDRVMSYVEAGQREGARLRAGGQAARADSGGWFVQPTIFECPTQSLSIVKEEIFGPVLAVTVFDTEAEAVAMANDSAYGLGAGLWTSDLSRAHRVSRRLRSGLVWVNCYMDGDITVPFGGVKQSGFGRDKSLHALEKYQDLKTTWIRLE

SEQ ID NO: 15050 - protein, 447 aa, Candida glabrata CBS 138
MATNEEFIRTQIFGTVFEITNRYSDLNPVGMGAFGLVCSATDTLTNQQVAIKKIMKPFATAVLAKRTYRELKLLKHLRHENLICLQDIFLSPLEDIYFVTELQGTDLHRLLQTRPLEKQFVQYFHYQILRGLKYVHSAGVVHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPSDVIDTICSENTLKFVTSLPHRDPIPFSERFKTVEPDAVDLLEKMLVFDPKKRITAADALAHPYLAPYHDPTDEPVAEAKFDWHFNDADLPVDTWRVMMYSEILDFHKIGGTDGQIDTSATFDDQVAAATVAAAQAQAHALAQAQMSQNMIDPNQLLNEDGTPVSGSIAENSSNSATTNLNGAAAGMNSASDTINEYANQAVHFANEFQQ

SEQ ID NO: 15051 - protein, 290 aa, Oryza sativa (japonica cultivar-group)
MGRSHRLPALQDNKKRQLISSRQVKAAKTEVRRATRTNWTEEENLRLISAWLSNSVDPTDGNDKKGEYYWKDVADEFNNNRPTNGHKRTVKQLKTHWGNVKKDIGKFCGVYAQVRRTCTSGHSDDMIMEKAHLWYKNQSNQKKPFTLEYMWRELKDQPKWRSIIKKEENKNKRTKISESGAYTSSSNQETEEESSNKERHPEGQKKAKERLKGKGKGKAQSSPLGNQPSQNIVLYNEAMKIKAEALLKSAEATAKSAEAKREQIRMEKWQAYIKLEEKDTSNFSGEAEKA

SEQ ID NO: 15052 - protein, 369 aa, Arabidopsis thaliana
MAHISDIKLIRTDTTLDLSQKAEKGMIWTMGGASYLYYNAYDHGSLTCRCGTLLIASSGGKYNPIRTFSSHQILEATNNFDWSYAIGVDRFVWYKGTIENRAVLIKYYKGEPFNFDPDNFYRDIAVSSMMSSHKNVLKLLGCCLEFPRPVLVCEYPEKGALAYIGGAGEVIKPLAWSVRLKIAKEIADAVTYLHTEFPRTIIHRDLKLTNIFLDENWTAKLSSFSLSIPIPEGELGVEDIVCGTQGFGEPHYMVTGFVTENVDIYSFGFIMLSLLTGKHGFYQEPANGDSYNMILLPDYVEKCLGRGPLAKLIDPSMLNSTDDDIPDHSKLQMEAFVNLALRCVGFRSGETKLHMIDVAKELKRIQKQT

SEQ ID NO: 15053 - protein, 430 aa, Oryza sativa (indica cultivar-group)
MEAWTIRVVYFIVFSFFLVSARFGSCAPCSEEGRALLRYSESERDKSTDSLSNRGEGKVIGRVLNLLLKEKMFSSETPSELKELGTISESVADAVATAIYVFFSRRKKDNTVMPWATGLSGQLKKAFVTGVPSLERTELEAACEGFINVIGTLPECTLYKGTLSSGVEIAVLSTSLNSAQQWSARSEEQFRNKISVLSRVNHKNFMNLIGYCACDEPFTRMMVFEYAPCGSLFEHLHIREAEHLDWKTRLRIIMGVAYCLEHMSQLDPPPLLPTNLSSSSIYLTEDNAAKIADIKFWKDDINKQDDQESVVYKFGILVLEVISGRRPFSEDDRLLVLWASSYLDGKRPLSAMADRTLVRSSSAAPEKDVAALCDVVRQCVRRPEAGKRAISMGEVARLVRGIAGLSPEQAAPREKPLWWAELEIASSETA

SEQ ID NO: 15054 - protein, 567 aa, Arabidopsis thaliana
MVARRNKPKAPLVKHRFSGGDSHKPKPPPATKQPFSGVESHKPKTSPATKQKFSGVESHKPKTPPGKQRFSGAESRKPKTPPATKQKFSSLERSALYARREAANILRTVLRGDAERRAVASIKSLVLSPSVRNKRGTFALVCETLKYLTVIKDVLDIANVLNSKWKRQEPLVFIVCYDILFGKDTPSIGDAEKFLMRHKEALLSGLATLLVRKKVDSVDQLLGSKLTGHLKPRYVRVNTLKMDVDSAVQELEKHYTVQKDETVPDLLVLPPGSDLHAHRLVANGRIFLQGKASSMVAAALQPQAGWEVLDACSAPGNKTIHLAALMEGQGKIIACELNEERVKRLEHTIKLSGASNIEVCHGDFLGLNPKDPSFAKIRAILLDPSCSGSGTITDRLDHLLPSHSEDNNMNYDSMRLHKLAVFQKKALAHALSFPKVERVVYSTCSIYQIENEDVVSSVLPLASSLGFKLATPFPQWQRRGLPVFAGSEHLLRMDPVEDKEGFFIALFVRANKLDNPKSSELPDRVCRRRPKERTMQLHPYLCPKMFRAWSGTLHRLKTRFLLSRNGC

SEQ ID NO: 15055 - protein, 634 aa, Photorhabdus luminescens subsp. laumondii TTO1
MEQQKKFDVICMGRIAVDLYGQQIGARLEDMGSFAKYLGGSSGNVAYGTARQGLKSSMLARVGDEHMGRFLREELQSVGCDTSHLTTDKERLTALVLLGIKDKTTFPLIFYRDNCADMAITGDDFSEEYIASARCLAITGTHLSHPNTRDAVLTALNYARRNRVKTVMDIDYRPVLWGLTSLGDGETRYITSEQVTAQLQEVLSLFDLIVGTEEEFHIAGGSTDTIEALRNIRKLTSAALVCKRGSLGCSIFTAEIPNDLNDSITIQGVSVDVLNVLGAGDAFMSGLLRGYLNNEGWEKACTYANACGALVVSRHGCAPAMPDKTELDNYLSRANQILRPDLDETLNHLHRISARKNQWDELCVMAFDHRIQFIELARQANASIKRISSLKQLLLRASREVATEAGLQGKIGLLCDSTFGQDVLNEITGQGWWIGRPIELPGSRPLCLEHGNIGSQLIDWPLEHIVKCLVFFHPEDAHPLRLEQEKKIREIYAACCKSGHELLLEVILPAEMKHSDEFYIRALRRFYNLGVKPDWWKLPPLSSESWDNINYLIEQRDPYCRGVVILGLDAPQEELEMGFNAAAGKSIVKGFAVGRTLFGQPSLKWLKNEIDDNRLIQKIKTNYHNLISLWRQRG

SEQ ID NO: 15056 - protein, 543 aa, Silicibacter sp. TM1040
MGWLADETGLERRAANYVALTPLSHLQRAAHVFADEPALVYGQTRRSYAQYHDRCTRLASALAGMGVAPGDVVATLLPNIPAQAEAHFGVPACGAVLNTINIRLDVDTVAYIFDHGQAKVVLVDSEFLPLAEAAKERLQGAGPTLIEVPDTEAGHAASGRYTTYEDLIAHGATDFDWIMPEDEWESLALNYTSGTTGRPKGVVYHHRGAYLMTMGTVVSWRLQLRPVYLTIVPLFHCNGWNHTWMMPVLGGTVVCCRNTTAEAIYNAIADEGVTHFGGAPIVLNMIVNAKDTERRAFDHTVEVFTAGAPPAPATLEKIERLGFHVTQVYGLTETYGHVTECLWKGDSWDELDQQGRAAIKARQGVAFPMMDHITVMDADMQQVPMNGSDQGEIVMRGNSVMKGYLKNPEATEEAFAGGYFHSGDIAIQHPDGYIQIADRAKDIIISGGENISSVEVEGVLMGHPDVNLAAVVAKPDEKWGEVPCAFVELKEGADVDEASLIAFARQTLAGFKTPKAVVFCELPKTSTGKIQKFELRKSFAGGS

SEQ ID NO: 15057 - protein, 428 aa, Zea mays
LEKVCGAGSTQGRGRQREEGERNLPVSLPGTGTPSPSPSPSPSPAPPPPPPPPPQVAGCDLYRGRWTFDAAGEQAPLYRESECEFLTEQVTCMRNGRRDDSYQKWRWQPDGCDLPRYDARLLLERLRNKRLMFVGDSLNRNQWESMVCLVQSVVPWGHKTLHKFVNNGSLNVFTAHDYNATVEFYWAPFLVESNSDDPQAHSVMNRVIAWRAIAKHAKNWKGVDYLVFNSYIWWLNTFEMKVIRRHQHQLEKEEEGVRWSKYALVDRPVAYREVLKTWARWVDRHIDPNRTRVFFMGMSPNHVTPWAWGNDGGIKCAMETQPISNNRTGRLDIGTDWRLHGVARGVLARYLRRVPVHFVDITGLSELRKDAHTSVHTLRQGKLLTPEQQADPKTYADCIHWCLPGLPDTWNHFLYAHILSLSSSAQDH

SEQ ID NO: 15058 - protein, 195 aa, Lactococcus lactis subsp. lactis Il1403
MTINTNNLTITISAASKKQYPENDWPEIALAGRSNVGKSSFINTLLNRKNFARTSGQPGKTQLLNFYNIDDQLHFVDVPGYGYARVSKKEREKWGKMIEEYLTTRENLKAVVSLVDIRHEPSEDDLMMYEFLKYYHIPVILVATKADKVPRGKWNKHESIIKKAMKFDSTDDFIIFSSTDKTGFEEAWEAILRYL

SEQ ID NO: 15059 - protein, 277 aa, Sulfitobacter sp. EE-36
MSLAKIPLAGVIGSPIAHSKSPQIHGHWLKTLGLQGAYIPLHVEPEDLRQVLEAMPKMGFIGANVTIPHKEAVIEIADIITDRAAMIGAVNTITFRADGKIQGDNTDGYGFIENLKAGAPNWVPGDGPACVLGAGGAARAVISSLLDAGVPEILLANRTRVRAERLRSVFGNRVTVYDWSQAGTMVSHAGLVVNTTSLGMIGKSELRVPLDGLRADTVVTDLVYAPLKTTLLATAEAAGCVTVDGLGMLLHQAVPGFERWFGARPTVDHETRLAALR

SEQ ID NO: 15060 - protein, 168 aa, Crocosphaera watsonii WH 8501
MVKAVTMGKRNPSKNRFKSLITKTGKLLRDDNFMVGIHFVENAVSKILSVALIIVVGVSLFELTLILAKDLFTTEPVGFFNKTLIEIFGLFLNILIALELLENITAYLRKHIVQVELVVVTALIAVARKIIIFDPSKYAKNDLIALAFACFALAASYALIRFINQRDN

SEQ ID NO: 15061 - protein, 419 aa, Thermotoga maritima MSB8
MAERLGILVGGGPAPGINSVISSVTIEAINNGLEVIGIYDGFKHLVEGKTNMVKKLSIEDVSRIHIEGGSILRTSRVNPAKSEETLEKTVQTLKKLGIKYLVTIGGDDTAFSASKVCERSKGEIKVVHVPKTIDNDLPLPENMPTFGFETARHVATELVYNLMQDSRTTNRWYFVAMMGREAGHLALGVGKAASATITIIPEEFKEGVTLEEVCDVLDGAILKRKLMGRDDGVAVIGEGIAEKMDPEELANIPGVIVEKDPHGHLRLAEIPLATILKRAIERRYAERGERIHIVDVTIGYELRSARPIPFDIVYTRTLGYGAVRFLLGDYSDLPGGMVCVVGGRIKILPFDAFMDPKTGRTKVRVVDVRSEDYRVARKYMIRLEKKDLEDPETLEKLAKLAKMEPEEFKKKYWHTTELP

SEQ ID NO: 15062 - protein, 127 aa, Glycine max
LAIKSADRPDIVLAIPEGGNPKGLWFTLKEGSRYRLMFTFQVENNIVSGLKYTNTVWKTGIKVDSSKEMIGTFSPQAEPYTHEMPEETTPSGMFARGQYSARSKFVDDDNKCYLEINYTFDIRKEWQ

SEQ ID NO: 15063 - protein, 530 aa, Candida albicans SC5314
MSANIDDVPIEVSKVFDTILVLDFGSQYSHLITRRLREFNVYAEMLPCTQKIAELSWKPKGIILSGGPYSVYAEDAPHVDHDIFKLGVPILGICYGMQELAWINGKGVARGDKREYGPATLNVEDPECALFKGVDHSQVWMSHGDKLHALPTGFKVVATSDNSPFCGISNESEHIYGIQFHPEVTHTVQGKKLLKNFAVDICQAKTNWSMENFIDTEIARIKKLVGPTAEVIGAVSGGVDSTVGAKIMKEAIGDRFHAIYVDNGVMRKNETESVKKTLDEGLGINLTVVDAGDLFLGRLKGVTDPEKKRKIIGNTFIHVFEEEAAKIKPRDGSEIEYLLQGTLYPDVIESISFKGPSQTIKTHHNVGGLLEDMKLKLIEPLRELFKDEVRHLGELLGVPEDLVWRHPFPGPGLAIRVLGEVTKEQVKIAREADAIFIEEIKKAGLYRQISQAFAALLPVKSVGVMGDQRTYEQVIALRAIETLDFMTADWFIFEAAFLKKVASRIVNEVDGVARVTYDITSKPPATVEWE

SEQ ID NO: 15064 - protein, 183 aa, Salmonella enterica subsp. enterica serovar Typhi str. CT18
MTATAQQLEFLKNSIKSIQDYPKPGILFRDVTSLLEDPKAYALSIELLVERYKNAGITKVVGTEARGFLFGAPVALGLGVGFVPVRKPRKLPRETIAETYELEYGTDQLEIHVDAIKPGDNVLVVDDLLATGGTIEATVKLIRRLGGKVTDAAFIINLFDLGGEQRLEKQGITCYSLMPFPGH

SEQ ID NO: 15065 - protein, 466 aa, Candida albicans SC5314
MSSTGENKNQIKIKFFTNEEDESLQVADTPLYVPVTLKRFGLSEVVNHLLGNFKGEDETKAPIPFDFLIDGVLLRTSIEDYLTKNGLSNEAFLTLEYTRAILPPSFLASFNNDDWISSIDSINPTTKIVMSSQLSISQPKILSGSYDGIVRTYNMSGKVEKQYVGHSAPVKAVKWISPTRIVSAGNDRQVRLWKTSYEEIIDEDEEEIEDGKTLALLEGHKAPVVDLAVDTQTNRILSAGYDQNIGFWSTNYKEMTSIQPLEYDSNVVSSSSKKRRKMAVQDATIRRRAPLSLLQGHSEPVEGVIFDAKDSTVGYSVSQDHTIKTWDLVTSRCVDTRTTGYSLLSVLQLPQVNLIASGSSARHINLHDPRVTTTSDQTISKLVGHTNFVVGLTASPHNQNMFASSSHDGTVKVWDVRAEKSLYTITRQDGSTNAKIFDVCWDDRIGIISGGEDKKLQINKGSDIAK

SEQ ID NO: 15066 - protein, 322 aa, Pseudomonas fluorescens PfO-1
MQPQAFYRAVADDFSAVDGIIKKQLTSRVPLVSKIGDYITSAGGKRLRPLLVLLCGKALGREGDDMRLLAATIEFLHTATLLHDDVVDMSGMRRGRSTANAMWGNAPSVLVGDFLYSRSFEMMVELGSMPVMKILSQATRIIAEGEVLQLSKVRDASTTEETYMEVIRGKTAMLFEASTHSAAALAGATAEQSEALRTFGDHLGVAFQLVDDLLDYKGDAETLGKNVGDDLAEGKPTLPLIYTMREGTPEQAALVRQAIQKGGIEDLESIRIAVEASGSLEYTAQLARDYVARAIKCLDALPASEYRDALVELSEFAVARTH

SEQ ID NO: 15067 - protein, 446 aa, Anemone leveillei
MAEKRRSISSDDLRSHNKPGDVWISIQGKIYDVTEWGKDHPGGEGPLLNLAGQDVTDAFVAFHPGSAWKNLDKFHIGYLQDYVVSDVSKDYRKLVSEFSKAGLYEKKGHGHLIRLLVMSLVFIASVSGVVLSDKTSVHVGSAVLLAVIWMQFGFIGHDSGHYNIMTSPELNRYMQIFSVNVVSGVSVGWWKRYHNAHHIAVNSLEYDPDLQYVPFLVVSTAIFDSLTSHFYRKKMTFDAVARFLVSFQHWTFYPLMAIGRVSFLAQSIGVLLSKKPLPDRHLEWFGLVVFWAWYSLLISCLPNWWERVIFIAVNFAVTGIQHVQFCLNHYSAQTYIGAPCANDWFEKQTKGSIDISCSPWTDWFHGGLQFQIEHHLFPRMPRCNLRKISPFVKELCRKHNLVYTSVSFFEGNRRTLATLKNAALKARDLTSPIPKNLVWEAVHTHG

SEQ ID NO: 15068 - protein, 205 aa, Pseudomonas fluorescens PfO-1
MSEVNLSTDETRVSYGIGRQLGDQLRDNPPPGVSLDAILAGLTDAFAGKESRVSQEAMSASFKVIREIMQAEAAAKAEAAAGEGLAFLAENAKKEGITTLASGLQFEVLTQGEGAKPSREDTVRTHYHGTLIDGTVFDSSYERGQPAEFPVGGVIAGWTEALQLMNAGSKWRLYVPSELAYGAQGVGSIPPHSVLVFDVELLEVL

SEQ ID NO: 15069 - protein, 446 aa, Anemone leveillei
MAEKRREISSQELAQHTNKGDLWISIQGKVYDVSEWVKDHPGGDAPLMNLAGQDVTDAFVAFHPGSAWKYLDKFHIGYLSDYVVSDVSKDYRKLASEFSKAGLFEKKGHGIFMSLLSVGIMFVVILSGVLLSGNTWVHAACAGLLGILWMQIGFVGHDSGHYNVMLTPKLNRFVQIFTGNCVTGISIGWWRWTHTAHHIAVNSLDYDPDLQHVPFLAVSKDILSSLTSKFYGRKMTFDAAARFLVSYQHWSFYPVMAVARINLFTQSFLLLLSSRPMQDRYLELLGLMVFWGWYSLLVSCLPNWGERAMFVAVSFAVSGIQHVQFCLNHFSAHTYVGPPRANDWFEKQTKGSIDISCSTWMDWFHGGLQFQVEHHLFPRLPRCHLRKISPFVKELCRKHNLPYVSVSFFEANKMTIATLRNAALQARDLTNPIPKNLVWEAFNTHG

SEQ ID NO: 15070 - protein, 700 aa, Burkholderia thailandensis
MTNQNRRDFLRLAAGTAGAAALQLFPPVIREALAIPANRRTGTIRDVEHIVILMQENRSFDHYFGKLRGVRGFGDPRPLTLQNGKPVFHQPVLLGPAELLPFHPDASNLGMQFLQDLPHGWQDTHGAWNKGRYDRWIANKGTTTMAYLERGDIPFHYQLADAFTICDAYHCSIPSSTDPNRYYMWTGYVGNDGAGGGPVLGNEEAGYGWSTYPETLEQAGVSWKIYQDIGTGLDAAGSWGWTQNPYIGNYGDNALLYFNQYRNAQPGSPLYDKARTGTNVSAGGTLFDVLQQDVKNGTLPQVSWICAPEAYSEHPNWPANYGAWYVEQVLKALTSNPDVWSKTALFITYDENDGFFDHVAPPFAPQSRDNGLSTVSTAGEIFPGDAAHMAGPYGLGPRVPMLVVSPWTKGGWVCSQTFDHTSLLQFIEARFNDRYPVRAPNVTPWRRAVCGDLTSAFNFSSPDGSWPQLPDTSGYAPPDRNRHPSYVPVPPVAQSMPKQEAGLRAARALPYELFVLGRIDQSTGKFKLTFAKTGRAGAAFQVTAGNRVDGPWAYTVEARKRLSDEWSTALTLSLYDLTVYGPNGFLCQFRGSTAAALGLNANPEVIYGYDVANGNITLRLSNRGRATVRLTVANAYGKESPRVYELKPGQRINDYWDLRDSHSWYDLTVSDGAPNGFLRRFAGHVETGRPSTSDPLIATV

SEQ ID NO: 15071 - protein, 353 aa, Saccharomyces cerevisiae
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMVEFVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHYKEALTTKDLKKLIWNEIFS

SEQ ID NO: 15072 - protein, 400 aa, Anabaena variabilis ATCC 29413
MSKKTVASLSAADISGKRALVRVDFNVPLDDQGNITDDTRIRAALPTIQDLTQKGAKVILASHFGRPKGVDEKLRLTPVAKRLSELLGQEVVKTDDSIGDEVAAKVAALQNGQVLLLENVRFYKEEEKNDPEFAKKLAANADFYVNDAFGTAHRAHASTEGVTKFLSPSVAGYLVEKELQYLQSAIENPQRPLAAIIGGSKVSSKIGVIETLLEKCDKLIIGGGMIFTFYKARGLNVGKSLVEEDKLELAKSLEAKAKERGVSLLLPTDVVLADNFAPDANSQTVSIDNIPDGWMGLDIGPDSVKVFQEALADTKTVIWNGPMGVFEFDKFAAGTEAIAHTLAEIGKTGTTTIIGGGDSVAAVEKVGLADQMSHISTGGGASLELLEGKVLPGIAALDEA

SEQ ID NO: 15073 - protein, 452 aa, Escherichia coli
MTQRRDLQALIDAAPVGKMQWRVIICCFLVVMLDGFDTAAIGFIAPDIRTHWQLTAGDLAPLFGAGLLGLTAGALLCGPLSDRFGRKRVIELCVFLFGALSLASAFSPDLQTLVFLRFLTGLGLGGAMPNTITMTSEYLPARRRGALVTLMFCGFTLGSAVGGIVSAQLVPVIGWHGILVLGGVLPLMLFVALLVVLPESPRWQVRRQLPQAVIAKTVSAITRERYVDTQFYLIESASVTKGSIRQLFMGRQLPITLMLWVVFFMSLLIIYLLSSWMPTLLNHRGIDLQHASWVTAAFQIGGTLGALALGVLMDKFNPFRVLALSYATGAICIVMIGLSQDGLWLMALAIFGTGIGISGSQVGLNALTATLYPTQSRATGVSWSNAVGRCGAIVGSLSGGVMMAMNFSFDTLFFIIAVPAAISAVMLTLLITVVRQSTSIPDSLPHAGVVNE

SEQ ID NO: 15074 - protein, 315 aa, Thermotoga maritima MSB8
MNVLCTGEILIDFISEDKGKNLSQSELFRKKAGGSPLNVAVALKRLGREVSFLGKLGGDQFSEFLLEVMKKEGIDTTHIIFDSSCKTTLAFVARDAQGNPDFVFFREKPADTNLRPEEVNIDPAQFSFLHIGSYSLAVEPSRSAYLKVMETFLEEGKPVSYDPNVRPSLIEDRNTFVKDFLEISSKVDIVKLSDKDLEYIFQEDLETAVDKIPIKENGLLFVTMGERGCLVKFKGEKRMVPSFKVKPVDATGCGDSFTAAVIHKYLEKTPETIEDAVEIGKFANAVAAIVITRVGGVDAMPVLDEVEMFLSNQER

SEQ ID NO: 15075 - protein, 472 aa, Hordeum vulgare
  misc_feature (118)..(118): Xaa can be any naturally occurring amino acid
MDVPLASKVPLPSPSKHEQCNVYSHKSSSKHADLNPHAIDSVLGIILGGGAGTRLYPLTKKRAKPAVPLGANYRLIDIPVSNCLNSNISKIYVLTQFNSASLNRHLSRAYGSNIGGYXNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLEDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 15076 - protein, 513 aa, Hordeum vulgare
  misc_feature (159)..(159): Xaa can be any naturally occurring amino acid
MAMAAAASPSKILIPPHRASAVTAAASTSCDSLRLLCAPRGRPGPRGLVARPVPRRPFFFSPRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYXNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLEDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 15077 - protein, 389 aa, Arabidopsis thaliana
MRNDIISELPDSLITQILLWLPTKDSVKTSVYRPDGEIFGLKFQEWIAAAVDRGIQHLDFETKNPSLFLKDSMPMNIYKSKTLVSLKLVCVELENPKFVVSLPCLKIMHLENNWYGYDAPLVVEKLIAGCLVLEDLTVVRIHDMVIPDLPLLHVKSLTLKILRLVFDLEMMTTIPISVEIDAPKLEYMSFINRHSDTIMVKNLSSLFKLNLDTEFGYSSLEPRDIIRDVLTGISSVRQMIISQRTLEVICRYSKLGPIPKFHHLSHLKAAFSSTSLQLLPAFLESCPNLKKLILDLYVSAEPEEIDLTNVPRCITSTLECIEINKLIRKEATGVKLVHYFLENSPILKKLKPSFTDSPMSTMTNLPLDHLYKMYLTARKRSRRCQVIIS

SEQ ID NO: 15078 - protein, 193 aa, Monacrosporium haptotylum
MADIRRKLVIVGDGACGKTCLLIVFSKGTFPEVYVPTVFENYVADVEVDGEHVELALWDTAGQEDYDRLRPLSYPDSHVILICFAIDSPDSLDNVQEKWISEVLHFCQGLPIILVGCKKDLRFDSKTMEELRKTSQKPVTPEEGEQVRGKIGAAKYLECSAKTNDGVREVFEHATRAALTTFKKKKSSKCSIL

SEQ ID NO: 15079 - protein, 125 aa, Dehalococcoides sp. CBDB1
MSKKYFSAPGAQGPYSLAVKAGDYLYISGQIGHTDADGRPLASVETQTKRCLEKMADLLKTAGASFDDVVKTTVFLKNQEDFTKMNGVYTIFFSGAKPARSTVIAGMVFPEIMVEIEAVAYLPEA

SEQ ID NO: 15080 - protein, 330 aa, Kluyveromyces marxianus
VRIAINGFGRIGRLVLRIALSRKNIEVVAINDPFITVDYAAYMFKYDSTHGRFDGEVSHDGKSLIIDGKKVLVFQERDPATLPWGAEKIDIAIDSTGIFKELDSAQKHIDAGAKKVVITAPSSTAPMFVVGVNEDKYAGQTIVSNASCTTNCLAPLAKIINNAFGIEEGLMTTVHSITATQKTVDGPSHKDWRGGRTASGNIIPSSTGAAKAVGKVLPELQGKLTGMAFRVPTVDVSVVDLTVKLAKPATYEEIKAVVKKASENELKGVMGYTEDAVVSSDFLGDTHSSIFDAAAGIQLSPQFVKLVSWYDNEFGYSTRVVDLVELVAKN

SEQ ID NO: 15081 - protein, 194 aa, Monacrosporium haptotylum
MTTQSLKCVVTGDGAVGKTCLLISYTTNAFPGEYIPTVFDNYSASVMVDGKPISLGLWDTAGQEDYDRLRPLSYPQTDVFLICFSLVSPPSFENVKTKWFPEISHHAPNVPIILVGTKLDLRDDPKIQQSLKDKKMAPIQFTNGVAIAKDIGAVKYLECSALTQKGLKNVFDEAIRAVLSPPPKPTKSKKCTIL

SEQ ID NO: 15082 - protein, 196 aa, Monacrosporium haptotylum
MADHDEDLTATATEGYKVGEKKSLAEYQKLDANDESLNKWKASLGLGDGAAASSDPAKVTIKKLSLLVDGREPLEIDLTKPNALETLGTHPFIVKEGTEYQIEITFVVENQIITGLRYVQVVKRKGIKVDRSEEMMGSYGPNTATNPTYSKKLPLETAPSGMLLRGTYDAASAFIDDDKHNHLSFNWAIKIAKDWS

SEQ ID NO: 15083 - protein, 812 aa, Pseudomonas veronii
MSRLQPHILWFKTLGLNDVAQVGGKNASLGEMYQKLTGEGIRVPNGFAVTSDAYRYVLEHNNAWAPLHAALDGLDPDDIKDLQARGKRARAVVYGCTLPDDLKAAILQGYAELQHEYGNSLSLAVRSSATAEDSPQASFAGQNETYLNIAGEEALLDAYKRCLASNFTDRSIHYKFDNGFDCFKVDLAVVVMKMVRSDLGASGVMFSLDTETGFKDVVFINATWGLGENVVQGTVAPDSFYVHKPSFVAGYRAVLKRSLGSKEKKMVFTDTLNTGNIAQEYTANIDTPSEEQTRFCLSDADVMVLADYAIKVENHYSSNAGAYKPMDMEWAKDGIDGQLYMVQARPETVASQKKGNVLQIYHLKQRSPVLLRGKAVGTRIGAGIARVVNDVKQLSAFQPGEVLVSEATTPDWEPVMKTAAAIVTNRGGRTCHAAIVARELGIPAIVGAANAAALIKTGTSLTVSCAEGENGTVYEGILEFEVEETDLSQLGHPDTHIMMNLANPDRAFSLASLPVDGIGLARMEFIINECIKIHPMALVHPEKLDDATRQQIAVLSAAYKDPTDFFIKTLAEGVATIAAAVYPKPCVVRMSDFKSNEYATLLGGQYFEPAEHNPMIGFRGASRYSHPAYAEGFALECAAMKWAREHIGLTNIKLMIPFCRTVAEGERVLATMASHGLQRGENGLEVYIMCEIPNNVIQIDAFAKLFDGFSIGSNDLTQLTLGVDRDSDIVAFDFDERDPGVKQMIRLAVEGAKRNGRHSGICGQAPSDYPEMAEYLVSIGIDSMSLSPDAVLATIRHVLAVQKSLLSSDGRS

SEQ ID NO: 15084 - protein, 326 aa, Synechococcus elongatus PCC 7942
MAETFMFNALRAAIDEEMARDPNVFVLGEDVGHYGGSYKVTKDLYQKYGDFRLLDTPIAENGFTGMAVGAAMTGLRPIVEGMNMGFLLLAFNQIANNAMLRYTSGGNFTIPIVFRGPGGVGRQLGAEHSQRLEAYFHAVPGLKIVACSTPYNAKGLLKAAIRDNNPVLFFEHVLLYNLKEDLPDEEYICPLDKAEIVRPGKDVTVLTYSRMRYHCLQAVKTLEKEGFDPEVIDLISLKPFDFEAIEASVRKTHRVVIVEECMKTGGIAAELSAAIMERCFDELDAPVVRLSSQDIPTPYNGKLENLTIVQPEQIVAAVKDLLTAKV

SEQ ID NO: 15085 - protein, 680 aa, Oryza sativa (japonica cultivar-group)
MAALVVLWPTLLPLVLLANLLPLPRHGRALELMNWSCNNGSSYAANTTYHSNVRAVLTALSAITPNSTARFATASAGRGGADAVWGLALCRGDTDRAGCASCLAAVPAVAFGECRGDRDVAVFYDRCLARFSYADFTSRPDNTEVLIGSPSENRVTVDAGRFDALVARLAGALADWAAYNSTRRYAAGLMASGDGFTSTTEDMVHNIHGVVQCTPDQAAAACRACLETLRVDMPKVFAGRIGGRFDAVWCNLRYETFLFYDGDPTVRLAASPSPGSSSSPLPSPSPSLPPLEGKRRNRPKNAAIVVVSVLASLVVLLSLLSFYLWRKLQAKQYTDENDIYSGSLLFDLATLRKATASFAEHNKLGHGGFGAVYKGFLPDGREIAVKRLDKTSGQGLEQLRNELLFVAKLRHNNLAKLLGVCIKGEEKLLIYEYLPNRSLDTFLFDPEKRGQLNWETRYQIIHGIARGLLYLHEDSQIKIIHRDLKASNVLLDANMNPKISDFGLARLFDGTKTASITNHVVGTLGYMAPEYAVLGHVSVKLDVYSFGILVLEIVTGRRNTDVSGEVEESNNLLSYVWDHWVKGTPLEIADASLLGDGRSLSDMELLKCVHFGLLCVQENPVDRPTMLDILVMLHDVDTNSFVAPSKPAFTFAHGGNTTSSSQGVAALSTNEVSISEFVPR

SEQ ID NO: 15086 - protein, 511 aa, Arabidopsis thaliana
MDIISGQALFLLFCFISSCFLISTTARSRRSSGRAATLPPGPPRLPIIGNIHQVGKNPHSSFADLAKIYGPIMSLKFGCLNSVVITSPEAAREVLRTHDQILSGRKSNDSIRCFGHEEVSVIWLPPSSARWRMLRKLSVTLMFSPQRTEATKALRMKKVQELVSFMNESSERKEAVDISRASYTTVLNIISNILFSVDLGSYDSKKSNEFQDTVIGAMEAAGKPDAANYFPFMGFLDLQGNRKAMRGLTERLFRVFRGFMDAKIAEKSLGNYSKDVSNRDFLDSLLILNEGDEAELDNNDIEHLLLDMFTAGTDTSSSTLEWAMAELLRNPKTMVKAQAEMDRVLGQNSVVQESDISGLPYLQAVVKETFRLHPAAPLLVPRKAESDVEVLGFMVPKDTQVLVNVWAIGRDPSVWENPSQFEPERFMGKDIDVKGRDYELTPFGGGRRICPGLPLAVKTVSLMLASLLYSFDWKLPNGVVSEDLDMDETFGITLHRTNTLYAIPVKKQTIN

SEQ ID NO: 15087 - protein, 472 aa, Pseudomonas putida GB-1
MPVGNHSAHGQATEGGPLKRELGERHIRLMALGACIGVGLFLGSAKAIEMAGPAIMFSYIIGGLAILVIMRALGEMAVHNPVAGSFSRYAQDYLGPLAGFLTGWNYWFLWLVTCVAEITAVAIYMGIWFPDVPRWIWALAALGSMGAVNLVAVKAFGEFEFWFALIKIVTIIAMVIGGIGVIAFGFGNDGVAVGISNLWSNGGFMPNGVTGVLMSLQMVMFAYLGVEMIGLTAGEARNPQKTIPQAIGSVFWRILLFYVGALFVILSIYPWNEIGSQGSPFVMTFERLGIKTAAGIINFVVITAALSSCNGGIFSTGRMLYSLAQNGQAPAAFARTSKNGVPRNALLLSIGALLLGVLANYLVPEKVFVWVTSIATFGAIWTWVMILLAQLKFRAGLTTAERKALKYRMWLWPLSSYLALAFLVLVVGLMAYFEDTRVALYIGPAFLVLLTVLYYAFRLAPKEVQGVASTAS

SEQ ID NO: 15088 - protein, 1123 aa, Solanum tuberosum
MSSSRPSQSSTTSSRSKHSARIIAQTSIDAKLHADFEESGDSFDYSSSVRVTNVAEGEQRPKSDKVTTAYLHQIQKGKFIQPFGCLLALDEKTLKVIAFSENAPEMLTMVSHAVPSVGEHPVLGIGIDIRTIFTGPSGAALQKALGFGEVSLLNPVLVHCKNSGKPFYAIVHRVTGSLIIDFEPVKPYEVPMTAAGALQSYKLAAKAITRLQSLPSGSMERLCDTMVQEVFELTGYDRVMGYKFHDDDHGEVVSEITKPGLEPYLGLHYPATDIPQAARFLFMKNKVRMICDCRAKHVKVVQDEKLPFDLTLCGSTLRAPHYCHLQYMENMNSIASLVMAVVVNDGDEEGESSDSSQSQKRKRLWGLVVSHNTTPRFAPFPLRYACEFLAQVFAILVNKELELENQFLEKNILRTQTLLCDMLMRDAPLGIVSQSPNIMDLIKCDGAALLYKNKIHRLGMNPSDFQLHDIVSWLCEYHTDSTGLSTDSLYDAQFPGALALGDAVCGMAAVRISDKDWLFWYRSHTAAEVRWGGAKHEPGEKDDGRKMHPRSSFKQFLEVVKTRSIPWKDYEMDRIHSLQLILRNAFKDADAVNSNTISIHTKLNDLKIDGMQELEAVTAEMVRLIETASVPIFAVDVDQGVNGWNTKVAELTGLPVDEAIGKHLLTLVEDSSVDTVNKMLELALQGQEERNVEFEIKTHGPSRDSSPISLIVNACASKDVRDSVVGVCFIAQDITGQKSIMDKFTRIEGDYRAIIQNPHPLIPPIFGTDQFGWCSEWNSAMTMLTGWRRDDVMDKMLLGEVFGTQAACCRLKNQEAFVNFGVILNNAITGQESEKIPFGFFARYGKYVECLLCVSKRLDKEGAVTGLFCFLQLASHELQQALHVQRLSEQTALKRLKVLAYIRRQIRNPLSGIIFSRKMLEGTSLGEEQKNILHTSAQCQRQLDKILDDTDLDSIIEGYLDLEMLEFKLHEVLVASISQVMMKSNGKNIMISNDMVEDLLNETLYGDSPRLQQVLANFLLVSVNSTPSGGKLSISQKLTKDRIGESVQLALLEFRIRHTGGGVPEELLSQMFGSEADASEEGISLLVSRKLVKLMNGEVQYLREAGRSTFIISVELAVATKSS

SEQ ID NO: 15089 - protein, 216 aa, Zea mays
MNQDDTDNLGSEDYVQVDPLVANMNSQTKPKGLSKNFTDDEDILLLSAYLNVSKDPIAGRDQKDGRFGERIEKYYHVNLPFESLFIASSRGYNPKESKSFQSSYEAIQRKNESGKTMNAKIADAKAMFQTLRKKAFTLFHAWNILRPEPKWSSIKDSPMAPQKLDPPNGNEDEGHDPPSPPGRKAEKDKLRARKREDNDNDALMEELKKLESQDWR

SEQ ID NO: 15090 - protein, 208 aa, Coprinopsis cinerea okayama7#130
MPPPHYDFLIKLLLIGDSGVGKSCLLLRFCDDAWTPSFITTIGIDFKIRTIELDGKRIKLQIWDTAGQERFRTITTAYYRGAMGILLVYDVTDERSFNNIRTWHANIEQHASEGVNKILIGNKSDWTDKRAVTEEQGRELANELGIKFMETSAKVNEGVEEAFFTLARDIKTRLIDSQADAAGTPGGPATDSVKVNQPTAQSQQGCCS

SEQ ID NO: 15091 - protein, 630 aa, Nostoc punctiforme PCC 73102
MTALSPDHSISSSSTHTLDIARQEYQYNYNHIPSIAMVDRLSITEEFTTNWYFLLAQQLRVLFINTLIVNRGNQDSKSIRDDVERFILEALLKGAVPARISILARILQIIPQLLLKEISKDFRELDDLFHSILKENGLAILRDALKRIITLLYEGQPTGHATSLKDYENLFPVISLPAIAKTYQEDEVFAYMRVAGYNPVTIKRVTTLSDRFPVTDEHYQAVMGTDDSLAAAGIEGRLYLADYKILDGAINGTFPHEQKYLYAPLALFALPKGSDPTRLLRPVAIQCGQTPGPDYPIVTPNSGKYAWLFAKTIVQIADANIHEAVTHLARTHLLVGVFAIATARQLPLTHPLRILLRPHFDSTLAINDAAQRILIAPGGGVDRLLSSSIDNSRVLAVLGLQSYSFNSTILPNQFQQRGVDDPNLLPIYPYRDDALLIWNAIHQWVWDYLNLYYTTDEDIQKDRALQAWAAEIPAYDGGRIPDFGEDGGIKTLNYLIDATTLIIFTASAQHAAVNFPQKDLMGYAAAIPLAGYLPASTLKREVTEQDYLNLLPPLDQAQRQYNLLSLLGSVYYNKLGEYEQGYFTDEKVKPLLQAFQSHLQQVENTIKQRNLHRPPYEYLLPSKIPQSINI

SEQ ID NO: 15092 - protein, 445 aa, Pseudomonas fluorescens PfO-1
MIESVESFLARLKKRDPDQPEFHQAVEEVLRSLWPFLEANPHYLTSGILERICEPERAVVFRVSWVDDQGRVQVNRGFRIQMNSAIGPYKGGLRFHPSVNLGVLKFLAFEQTFKNSLTSLPMGGGKGGSDFDPKGKSDAEVMRFCQAFMSELYRHIGADVDVPAGDIGVGAREIGFLFGQYKRLSNQFTSVLTGKGMTYGGSLIRPEATGFGCVYFAEEMLKRREQTVEGKRVAISGSGNVAQYAARKVMDLGGKVISLSDSEGTLYCEAGLSEEQWLALLELKNVKRGRISELASAFGLEFRAGQLPWSLPCDIALPCATQNELDAESARTLLRNGCVCVAEGANMPTTLEAVDIFIEAGILFAPGKASNAGGVAVSGLEMSQNAMRLLWTGGEVDSKLHGIMQSIHHACVHYGEENGRINYVKGANIAGFVKVADAMLAQGVV

SEQ ID NO: 15093 - protein, 289 aa, Listeria monocytogenes str. 1/2a F6854
MENRISGTTRLLGLIGTPVDHSKSPIMYNHSFQKAGLDYAYLAFDTPTEKVTDAIKAIKTFNLRGANVTMPCKSEVLKYMDDLSPAARMIGAVNTIVNEDGKLTGHITDGLGFIANLRDASVDVAGKKMTIIGAGGAATAIQVQCALDGAKEITIFNIKDAFYDKAKQTAASIKQEVPNCIVHIYDLNDTEKLNAEITTSDILVNATLVGMHPNEHETPISDTSVFRKELIVADIIYNPKKTQLLLDSEVAGCKTVGGLGMLLWQGAEAYKLFTGKDMPVSEVKDLYFN

SEQ ID NO: 15094 - protein, 459 aa, Prochlorococcus marinus str. MIT 9303
MRASWVAARKGQANVSQLHFARQGVVTQEMDYVARRENLPESLVMEEVARGRMIIPANINHANLEPMAIGIASSCKVNANIGASPNASDVAEELKKLELAVKYGADTVMDLSTGGVNLDEVRTAIINASPVPIGTVPVYQALESVHGSIEKLDEDDFLHIIEKHCQQGVDYQTIHAGLLIEHLPLVKGRLTGIVSRGGGILAQWMLYHHRQNPLFTRFDDICEIFKRYDCSFSLGDSLRPGCQHDASDAAQLAELKTLGELTKRAWAHDVQVMVEGPGHVPMDQIEFNVRKQMEECNEAPFYVLGPLVTDIAPGYDHITSAIGAAMAGWYGTAMLCYVTPKEHLGLPNPEDVREGLIAYKIAAHAADIARHRPGARDRDDELSRARYNFDWNKQFELSLDPERAKQYHDETLPADIYKQAEFCSMCGPKHCPMQTKITDEDLEGLEKSLKSKGKAELPA

SEQ ID NO: 15095 - protein, 376 aa, Vibrio vulnificus CMCP6
MTQDKFIKSRAAVAWGPKQPLSIEEVDVMLPRKGEVLVRIVATGVCHTDAFTLSGDDPEGVFPAILGHEGGGIVEMVGEGVTSVSVGDHVIPLYTAECGQCKFCLSGKTNLCQAVRETQGKGLMPDGTTRFYKDGKPIFHYMGCSTFSEYTVLPEISLAKVNKEAPLEEICLLGCGVTTGMGAVINTAKVKQGDTVAIFGLGGIGLSAIIGARMAGASRIIAVDINDRKFELAKQLGATDCINPKEHAQPIQEVIIEMTDGGVDFSFECIGNVNVMRQALECCHKGWGESVIIGVAGAGQEISTRPFQLVTGRVWRGSAFGGVKGRSQLPAIVEQYLAGEFGLQEFITHTMPLEGINDAFELMHSGESIRSVVHFE

SEQ ID NO: 15096 - protein, 247 aa, Gerbera hybrid cultivar
MGRGRVELKRIENKINRQVTFAKRRNGLLKKAYELSVLCDAEVALIIFSNRGKLFEFCSTSNMLKMLERYQNCTYGSMEVDRSTPNAEQSSYKEYMKLKAKYESLQQYQRQLFGEDLGPLSLKELEQLERQLDSTLRQIRSIRTQSMLDRLSELQVKERMWVEANKALQNKLEEVYAENQAGPSWAAGEHHSSYGQEHQHQHQSQGFFQPLDCNSNLQIGYNTVDSSHITASTNGQNLNGLIPGWML

SEQ ID NO: 15097 - protein, 191 aa, Oryza sativa
  misc_feature (119)..(119): Xaa can be any naturally occurring amino acid
FGMRSLPVLGSFAGYTPAIESTSVQPYMRCANSSDSNRQEQETVPARSSSSGSGAAATDRKKRKSEERQESTVKKSKQEASKASPPKQPVPKVKLGEKITALQQIVSPFGKLPMHCTTXQTDTASVLFETIKYIKFLHEQVQLLSEPYTNSSRSNKQGNSVPWGDQAEASKGETTEHDLRNRGLPVPVTSN

SEQ ID NO: 15098 - protein, 496 aa, Silicibacter sp. TM1040
MPRARKSCPIATDTNEAEMRNYPDLKLFIGGTWRDTPETLSVVNPATEEELGRLPCARISDLEDALAAAQKGLEIWRNTPPRSRADLILRAARLLRDRQEEIAQSITAEHGKPLAQARLEVIRGAEFFEWDAAEAMRTYGRVIPSAAGTKISVHHHPIGVVAAFSPWNFPMSQPARKIAGALASGCSLILKAAEETPAGAIHIVRAFQDAGLPDGVLNLVFGRPAEISAYLIPQPCVRLVALTGSTAVGRQLTALAAQSDTRVLMELGGHAPVIVCEDTDVQKAALSGAIRKMRNAGQVCTSPTRFFVHQDIFDEFATTFTQRAAATRVGNGMHDGIEMGPTANARRIPVLTDLVNDALAQGATLCTGGTRVGERGYFFAPTVLTHVPDSARIMREEPFGPIAVLNTVRNLDEAIAQANAVDYGLAGYAFTNRADYIARMIDEVEVGNFSINTLEASLPETPFGGVKSSGYGREGGTEGLESYLTTRNVWQSSDIT

SEQ ID NO: 15099 - protein, 253 aa, Triticum aestivum
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAAAVKSA

SEQ ID NO: 15100 - protein, 431 aa, Pseudomonas putida
MNANDNVVIVGTGLAGVEVAFGLRASGWEGNIRLVGDATVIPHHLPPLSKAYLAGKATAESLYLRTPDAYAAQNIQLLGGTQVTAINRDRQQVILSDGRALDYDRLVLATGGRPRPLPVASGAVGKANNFRYLRTLEDAECIRRQLIADNRLVVIGGGYIGLEVAATAIKANMHVTLLDTAARVLERVTAPPVSAFYEHLHREAGVDIRTGTQVCGFEMSTDQQKVTAVLCEDGTRLPADLVIAGIGLIPNCELASAAGLQVDNGIVINEHMQTSDPLIMAVGDCARFHSQLYDRWVRIESVPNALEQARKIAAILCGKVPRDEAAPWFWSDQYEIGLKMVGLSEGYDRIIVRGSLAQPDFSVFYLQGDRVLAVDTVNRPVEFNQSKQIITDRLPVEPNLLGDESVPLKEIIAAAKAELSSAPARHHHHHH

SEQ ID NO: 15101 - protein, 556 aa, Zea mays
MDRLGANPANSCPLTPLGFLERSATVFGDCHSVVYHDTVFTWSQTHRRCLRLASALVSLGINRGDIVSVLLPNVPAMYEMQFGVPMSGAVLNNINMRLDARTVAVLLRHSGSKLVFVDPASLTLIRDALKQLPQGHPAPRVIPVEDPHEKGLPAAPPGSLTYEGLLEKGDPEFAWVRPASEWDPMVLNYTSGTTSEPKGVVHCHRGIFLVTLDSLVEWAVPPRPTYLWTLPMFHANGWCFPWGMAAVGGTNVCLRRVDAAEVYDAIARRGVDHLCGAPVVLNMLANAPDAARRPLPGKVRILTAGAPPPAAVLHRTESIGFEVTHGYGLTETAGLVVCCAWKREWNKLPASERARLKARQGVRTPGMNEVDIVDGETGRSVPRDGSTMGEIVLRGGGVMLGYLNDDKATRAAIRDNGWFYTGDVGVMHPDGYMEIRDRSKDVIISGGENISSVEVESVLYNHPAVNEAAVVARPDEFWGETPCAFVSLKEGSGAVTAADVIAWCRDRMPHYMVPKTVVLRAELPKTSTGKIQKYVLRNLAKEMGPTRKGASSSSRM

SEQ ID NO: 15102 - protein, 77 aa, Zea mays
  misc_feature (24)..(24): Xaa can be any naturally occurring amino acid
GSWSYTALTWRSSDYSLQSKFLEXWAASFSKRGFLVKFLLLGGGSLLSSVSASLSMFLLPVKAGPQESPQLGPLGKI

SEQ ID NO: 15103 - protein, 219 aa, Vibrio angustum S14
MTQDEMKKAAGWAALEYVQKGTIVGVGTGSTVNHFIDALATRKEEIKGAVSSSVASTERLEQLGITVFDANEVASLDIYVDGADEINADYDMIKGGGAALTREKIVAAIAKKFICIVDDTKQVDVLGQFPLPVEVIPMGRSFIGRELVKLGGDPAYREGVVTDNGNMILDVYNMKITDPKAMEDKINALPGVVTVGLFAHRGADVLLVGSPDGVKKFEK

SEQ ID NO: 15104 - protein, 478 aa, Oenococcus oeni PSU-1
MDIFRKKDVGEILKHSTPLKRTLRTWDLTFLGIGAIIGTGIFVLTGKGALTAGPAISVSFLVAAICCGFAGLCYAEFASMAPVAGSAYTYSYIAFGEIIAFIIGWDLILEYTLGAATVSVGWSGYFANLLGNLGIHIPTVLTAAAGTTAGVTSYFNLPAFLIVLLITWIISIGITQTKRANDTMVIVKLAVILLFIVCTIWFIKPHNWQPFSPYGLYSFHNGTAAGIIPAASIVFFSFIGFDSVSSSAEETINPSKTLPRGILLSLFISTVLYIIMTLIMTGVVKFTVFAKYLNAPVLAVLHSTGQTWLSIIVSIGAILGITTVILVQLYGQSRISYSMSRDGLFPKFFGDVNMKYQTPFKGTWFFGIITAIAGGLINLNILAELVNIGTLTAFILVSAGVLWMRHSHPEVHRGFKAPGVPFTPIIAIIFCLVLIAGLNWETWIRFIVWFAIGMILYFGYAKKHSKLNSFKPQDKGAD

SEQ ID NO: 15105 - protein, 559 aa, Burkholderia vietnamiensis G4
MYQYDQYDQTIVDERVAQYRDQVRRRLSGELSEDEFRPLRLQNGLYMQRHAYMHRIAIPYGNLRSNQLRMLARIAREHDRGYGHFSTRSNIQFNWVELEDTPEILAKLASVQMHAIQTSGNCIRNITADQFAGVAQDEEIDPRPWAEILRQWSTFHPEFAWLPRKFKIAVSGSHDDRAAVQIHDLGVYLKKNAQGEVVASILAGGGLGRTPIVGAVIKEDLPWQHLLTYCEAVLRVYNRYGRRDNLYKARIKILVKALSPAKFAQQVEEEWQHLKDGPSTLTQAELDRVSQYFAPPVYEKLADTDASFEQHLLENKAFARWVERNVAPHKVAGYAAVTLSLKDHRVAPGDASAEQMDQVAEWADAYSFGEVRVSHEQNLILANVKKRDLFALWEKAKAAGFATPNIGLLTDIIACPGGDFCSLANAKSIPIALAIQQRFDDLDYVYDLGDLSLNISGCMNSCGHHHVGNIGILGVDKDGAEWYQVSLGGEQGTGQNGARLGRVIGPSFSADEVPDVIAKLIDTFVDARADGERFIDTYDRIGIAPFKERVYAARQAVNA

SEQ ID NO: 15106 - protein, 421 aa, Escherichia coli O157:H7 EDL933
MSNNEFHQRRLSATPRGVGVMCNFFAQSAENATLKDVEGNEYIDFAAGIAVLNTGHRHPDLVAAVEQQLQQFTHTAYQIVPYESYVTLAEKINALAPVSGQAKTAFFTTGAEAVENAVKIARAHTGRPGVIAFSGGFHGRTYMTMALTGKVAPYKIGFGPFPGSVYHVPYPSDLHGISTQDSLDAIERLFKSDIEAKQVAAIIFEPVQGEGGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERAMQLGQRLTKTLIDAKENVPAIAAVRGLGSMIAAEFNDPQTGEPSAAIAQKIQQRALAQGLLLLTCGAYGNVIRFLYPLTIPDAQFDAAMKILQDALRD

SEQ ID NO: 15107 - protein, 495 aa, Escherichia coli O157:H7 EDL933
MNFHHLAYWQDKALSLAIENRLFINGEYTAAAENETFETVDPVTQAPLANIARGKSVDIDRAVSAARGVFERGDWSLSSPAKRKAVLNKLADLIEANAEELALLETLDTGKPIRHSLRDDIPGAARAIRWYAEAIDKVYGEVATTSSHELAMIVREPVGVIAAIVPWNFPLLLTCWKLGPALAAGNSVVLKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIQEGESKGQLLLDGRNAGLAVAIGPTIIVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 15108 - protein, 443 aa, Dehalococcoides sp. CBDB1
MTRAESVEYVLKTAKDHNVRFIRLWFTDILGSLKSFSIAYNELERALEDGMGFDGSSIEGYARIDESDMVALPDPDTFKIIPWSNGDYQVGRMFCDIKKPSGEQFEGDPRYVLKRNLKKAAEMGFTFYIGPELEYFYFKNDHSTEFLDEGGYFDLTPRDLATDLRRETIVALQDMGIIVEYAHHEVAPSQHEIDIRYTDALTMADNVMTYRLLVKEVAMRHGLHASFMPKPVGSVNGSGMHTHQSLFKGDRNAFFDAKDSYYLSTMAKQYIAGILKYAPEFTSVTNQWINSYKRLVPGFEAPVYLSWARRNRADLVRVPEYKPGHEKSTRIELRSADPGCNPYLAFSVMLAAGLKGIEEKLTPPAPIEENVYEMNEAERAKRGIGTLPGSLLEALKLTEGSSVVREALGDHVFDAFVANKKIEWSQYSIAVTDWELKRYLPVL

SEQ ID NO: 15109 - protein, 582 aa, Debaryomyces hansenii CBS767
MSSNRQPKILTRTNIIDLIADGRAIIIYKNYVLDLTSWLSKHPGGDKAVHHMIGRDATDEMHAYHSLEAVRMFKYWKIGEINYYWENLLPPIQGAVYPYNKVNKESTLESKIDESSTDASDCELMSSASSSNSIDLSEAKSSLPKSKKETAGSYKGLGYPKGYVEPKVAQNISVIDLKNKDEIFPILTDQTIIDPKLLVTNYDNTLSQKDILSLPALDYKTQQMLRDKYNELHEIVIKNGFYQCHYFLYVRELIKIGSLFLYSFSFFKLGYLKLSAFFMGMAWQQMTFIAHDAGHVSITHNYQIDNIFGMLIADWFGGLSLGWWKRNHNVHHLITNDPVHDPDIQHLPFFAVSVRLFEDVYSTYYEKYLPLDVVAKKMIRIQEYLYYPILCFGRFNLYRLSWLHLIFGDGPRHGKAAWFRYFELVGLSFFFYWFFYLLVFKSIELNSDRFAYVMVSHITTMIVHVQITLSHFAMSTSDLGVSESFPLRQLRTTMDVDCPEWLDFLHGGLQFQAIHHLFPRLPRHNFRNVQPFVIDFCKDVGLRYSIYGFGEGNDLVLGKLAEIGNQCSVMLDATKQLKNSDH

SEQ ID NO: 15110 - protein, 242 aa, Triticum aestivum
  misc_feature (183)..(183): Xaa can be any naturally occurring amino acid
  misc_feature (222)..(222): Xaa can be any naturally occurring amino acid
MRALLHLRLINPCSPRAPRLPATPARALVASFSGAWQAPSGRARARAAPPAVRAMASQQVFRAQQQQQQQFPAQQQESQPGKEHAMDPRPEAIVQDYKAANKLKDKVALVTGGDSGIGRAVCLCFAKEGATVAFTFVRGQEEKDAEETLRALRDIGSETGAREPMALPADLGYEANCREVVEXVASAYGGRIDVVVNNAAEQYERESIGDVTEAGLERVFRXNIFSYFLVSNTRCRAWSPAA

SEQ ID NO: 15111 - protein, 391 aa, Triticum aestivum
MALLSPRVPRLPLAAHSAGAGAGSLRCCGRVAASAARCQVTASGSVAAGSSSSSELEAIRWGSAKLQGAREEMEDEVVLRPDSLLHGFSFAAVLDGHAGFSTVQFLRDELFKECAAALDGGAVLNTKNLEAITDSIRRAFATMDANLSTWLQQMDKEDDSGATATALFLRNDVLVVSHIGDSCLVISRGGRPQSLTNFHRPYGNNKTSLEEVKRIRAAGGWIRDGRVCGDISVSRAFGDIRFKTRKNEMLVKGVKEGRWTEKFVSRINFKGDLIISSPDVSLVELGPDVEFVLVATDGLWDYIKSTEAVAFVRDQLCQHGDVQRACEALGEKALDRRSQDNISIVIADLGRTNWQELPVPRPNVLLELSQAVATVGAVSVGIWISSLLTLQ

SEQ ID NO: 15112 - protein, 380 aa, Candida boidinii
MSTVGKTITCKAAVAWKPGEDLSIETIEVAPPKAHEVRIKIEYTGVCHTDAYTLSGADAEGEFPVVFGHEGAGIVESVGEGVTSVKVGDSVICLYTPECRECKFCKSGKTNLCGKIRATQGKGLMPDGTSRFTCKGQPLLHYMGCSTFSQYTVVADISVVAVNPEAPKDRTCLLGCGITTGYRAATNTVKMNEGDNIAVFGVGCIGLSVIQGAVAKKAGKIIAIDINDGKTEWAEKFGATDFVNPTKLAEGETIVSKLIDMTDGGCDFTFDCTGTVQVMRNALEACHKGWGESVIIGVAAAGKEISTRPFQLVTGRVWRGCAFGGVKGRTQMPGIVEDYLSGTLKVDEFITHRHKLDDINKAFHDMHAGDCIRAVITMEE

SEQ ID NO: 15113 - protein, 494 aa, Glycine max
MASKRKRKAWSPAEDMQLRAPVQSWAEGPPPCHSSRTRIENSQPSNLMQGTSFIFPVTVQRQTLPTISSTDGIETKGIVGGNMASKRKRKAWSEEEDMQLRAAVQRWGEGNWATMAKGDDFPIKRSATQLAQRWSILRKKDGCTNTVTVTSTQYTTAEQLATRHSLSLALDMPFKKLTAPGMTDVKPSTSVKNQVQIRNTTEKVASSFVPPQQALLGSSDLHAKSKLADEKPVLKGNLISDPVVKSATATLGTRIDPLSNTISQIKVAQVKNAIDTKPAVSSLTKPSISTNLPSDPKNKHVTPLADKGAQVKNAVDTTEPAVSSLTKPSISTNLPSDPKNKHATPLADKVPLKQDVNPTKELQVSNPSTTPKEKLQENEPPKVTTGSQVDSNPEKGRLEKGQETSIPLVKISGGEEVSKDKANQGVVCEEQGSVKKATEKNNIDKGSQSLDHDKKIDSINQSSNDQNANDKHVNLPVQDELSLSAKVVKSDGEC

SEQ ID NO: 15114 - protein, 397 aa, Rhodopirellula baltica SH 1
MLFFRRKRDVGHLLAASHDLFNAPRDQDRSLMSTVVEPKKNRGPGKSKGNADQPNTHVPESTTLELPQTGGKLRLDQPQAEDADGFSSLVAQKAAKKRDLAKPTKADRVRASNISWWAVGWLAMAHIVCLAAPFTFTWTALITALVLHWVAGSLGICLGYHRLLTHTGMKTYNWVRYAFAAIGCFAGEGSPLDWVADHRKHHAHSDLEGDPHSPHDGGIWSHIFWLAFHTHNGDRDAYLTRWVPDLYKDPAMRAFDMLFLPIHIVASFALLGIGYAFGGWELGVSMLVWGMFVRLVAVLHATWMVNSASHMWGYQNYETTDDSRNNWLVAIVAYGEGWHNNHHAYPRMAKHGHKWWEFDITWQAIKLLRAVGLVWDVVDYRTVAEKKARDAKQSAAA

SEQ ID NO: 15115 - protein, 1139 aa, Triticum aestivum
MSSSRSNNRPACSRGSSARSKHSERVVAQTPVDARLHAEFEGSHRHFDYSSSVSALNRSGASTSSAVSAYLQNMQRGRYIQPFGCLLAIHPESFALLAYSENAAEMLDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPGGNLSLLCDVLVREVSELTGYDRVMAYKFHEDEHGEVIAECRRSDLEPYLGLHYPATDIPQASRFLFMKNKVRMICDCAASPVKLIQDDNLSQPISLCGSTMRAPHGCHAQYMANMGSIASLVMSITINEDEDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSTPSEGEIKKIVAWLLECHDGSTGLSTDSLLEAGYPGASALGEVVCGMAAIKISSKGFIFWFRSHTAKEIKWGGAKHEPGDADDNGRRMHPRSSFRAFLEVVKWRSVPWEDVEMDAIHSLQLILRGSLQDEDANDNTARSIVEAPSDDIKKIQGLLELKIVTNEMVRLIETATAPILAVDIVGNINGWNNKVAEITGLPTTEAIGMLLVDLVEGDSVEVVKQMLNSALQGTEEQNLEIKLKTFHQQESKGPVVLMVNACCSRDLSDKVVGVCFVAQDLTGHKMVMDKYTRIQGDYVAIVKNPNELIPPIFMINDLGSCLEWNEAMQKITGIKREDAIDKLLIGEVFTLHDYGCRVKDQVTLTKLSILMNTVISGQEPEKLAFGFFNTNGKYMESLLTANKRTDAEGKITGALCFLHVASPELQHALQVQKMSEQAATHSFKELTYIRQELKNPLNGMQFTRKLLEPSDLTEEQRQLFASNVLCQEQLKKILHDNDLEGIEQCYMEMNTVEFNLEEALNTVLMQGMSLSKEKQISLDRDWPVEVSSMYLYGDNLRLQQVLADYLACTLQFTRPAEGPIVLQVIPKKEHIGSGMQIAHLEFRLVHPAPGVPEALIQEMFRHGPGVSREGLGLHISQKLVKTMSGTVQYLREAESSSFIVLVEFPVAQLNSKRSRPSTSKSNF

SEQ ID NO: 15116 - protein, 477 aa, Methanosarcina barkeri str. Fusaro
MKSNDAKKTVSSVQRIVILGASLAGLSAAEALRSEGFAGTLTVIGDEPYAPYDRPPLSKNVLTGWLPAEHTTLPQSVDLQAEWLLGVPATGLNLDNREVELADGRRFGFDRLLIATGARARPWPDSAQAALDGVCLLRTRDDAAQLRARLAARPKRVLVIGGGFIGSEVASVCRELGLAVTVTERSATPLIGALGAAAGTLAGQLQRVHGVDLRCNVTVMALEGDESGRLRRAYLSDGDILDIDVAVIALGAIRNVEWLHNSRLAFDSHGIACDAACRAFDTDGMVTDDIFVAGDVARWPHPLYEGELLAVEHWGNAIEQARTAAHNMVSAPTDLRAYKTLPAFWSRQFGVNLKTVGLLRFADEVVLTQGSISERRLVAAYGYKGRIVAALTVNMARWLPAYRAMIEDRAPFPPVLHAPDGPAELRPVPAGFPFRGQPTHSPNATQTGPGPSTPPPEESSTSTKVKDPRVPPGFRPK

SEQ ID NO: 15117 - protein, 289 aa, Oryza sativa
MALLSPRVPRLPLASASAAGAGLRCCVSGGRAGSAAWCHASAAGSVASSSSELEAIRDELYKECAAALDGGAVLSTKNLDAITDSIQRAFATVDANLSTWLEQMDKEDESGATATAMFLRNDVLVVSHIGDSCLVVSRGGRPQAVTNFHRPYGNKKASLEEVKRIRAAGDLIVSSPDVSLVELGPDVEFVLLATDGLWDYIKSSEAVALVRDQLRQHGDVQVACEALGQIALDRRSQDNISIVIADLGRTNWKELPAQRPNLFLELTQAVATVGAVSLGIYISSLLALQ

SEQ ID NO: 15118 - protein, 1139 aa, Triticum aestivum subsp. spelta
MSSSRSNNRPACSRGSSARSKHSERVVAQTPVDARLHAEFEGSQRHFDYSSSVSALNRSGASTSSAVSAYLQNMQRGRYIQPFGCLLAIHPESFALLAYNENAAEILDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDDNLSQPISLCGSTMRAPHGCHAQYMANMGSIASLVMSITINEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSTPSEGEIKKIVAWLLECHDGSTGLSTDSLLEAGYPGASALGEVVCGMAAIKISSKGFIFWFRSHTAKEIKWGGAKHEPGDADDNGRRMHPRSSFRAFLEVVKWRSVPWEDVEMDAIHSLQLILRGSLQDEDANDNNARSIVEAPSDDIKKIQGLLELKIVTNEMVRLIETATAPILAVDIVGNISGWNNKVAEITGLPTTEAIGMLLVDLVEGDSVEVVKQMLNSALQGTEEQNLEIKLKTMHQQESKGPVVLMVNACCSRDLSDKVVGVCFVAQDLTGHKMVMDKYTRIQGDYVAIVKNPNELIPPIFMINDLGSCLEWNEAMQKITGIKREDAIDKLLIGELFTLHDYGCRVKDQVTLTKLSILMNTVISGQEPEKLAFGFFNTDGKYMESLLTANKRTDAEGKITGALCFLHVASPELQHALQVQKMSEQAATHSFKELTYIRQELKNPLNGMQFTRKLLEPSDLTEEQRQLFASNVLCQEQLKKILHDNDLEGIEQCYMEMNTVEFNLEEALNTVLMQGMSVSKEKQISLDRDWPVEVSSMYLYGDNLRLQQVLADYLACTLQFTRPAEGPIVLQVIPKKEHIGSGMQIAHLEFRLVHPAPGVPEALIQEMFRHGPGVSREGLGLHISQKLVKTMSGTVQYLREAESSSFIVLVEFPVAQLNSKRSRPSTSKSNF

SEQ ID NO: 15119 - protein, 435 aa, Dehalococcoides sp. CBDB1
MKADYLIVGCSAGGIGAAEAIREVDRDGSIVIVGEEPYLAYSRPMIAKYLSGQKTVEKILFRRPEFYANNNITCLTDTKVEAVNTATHEVSLSNGEKISYGKLLLAPGGKPIVPPIDGSNKAGVFNFINMKDAVLIDGYVKAENVKKAVIIGGGLIGMSAADALTKLGIEVDIIELKGHILNTILDEAAGKIAAQTVTSYGVKLNTGRTVSKVLGLHKVAGVELDNGHQIESQMLVIAIGVIPRTELFKAAGLEVNRGVVVNDNMRTSNPDVYACGDACESFDFIYNSRRVTPIWPNAYIGGRIAGYNMAGMDTTYHGGTVMNSLNYFGMDIATAGMSVLPPDASGLEVLSTLTANGYKKLVLNAEGKIVGMLTLGETDTAGIIFGLMRDRSDVRPIKDNILNENFGLAYLSADSREEHLHGNTSGRVAPADFKH

SEQ ID NO: 15120 - protein, 98 aa, Dianthus caryophyllus
MATVGGIKDSGGSSAISLEIDELAKFAVDHYNSIENALLEFPRVVNTKEQVVAGTIYYITLEATDGGVKKLYEANVWVKPGVNFKEVQVFKYVGDAFG

SEQ ID NO: 15121 - protein, 1139 aa, Triticum aestivum
MSSSRSNNRPACSRGSSARSKHSERVVAQTPVDARLHAEFEGSQRHFDYSSSVSALNRSGASTSSAVSAYLQNMQRGRYIQPFGCLLAIHPESFALLAYSENAAEILDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDDNLSQPISLCGSTMRAPHGCHAQYMANMGSIASLVMSITINEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSTPSEGEIKKIVAWLLECHDGSTGLSTDSLLEAGYPGASALGEVVCGMAAIKISSKGFIFWFRSHTAKEIKWGGAKHEPGDADDNGRRMHPRSSFRAFLEVVKWRSVPWEDVEMDAIHSLQLILRGSLQDEDANDNNARSIVEAPSDDIKKIQGLLELKIVTNEMVRLIETATAPILAVDIVGNINGWNNKVAEITGLPTTEAIGMLLVDLVEGDSVEVVKQMLNSALQGTEEQNLEIKLKTMHQQESKGPVVLMVNACCSRDLSDKVVGVCFVAQDLTGHKMVMDKYTRIQGDYVAIVKNPNELIPPIFMINDLGSCLEWNEAMQKITGIKREDAIDKLLIGELFTLHDYGCRVKDQVTLTKLSILMNTVISGQEPEKLAFGFFNTDGKYMESLLTANKRTDAEGKITGALCFLHVASPELQHALQVQKMSEQAATHSFKELTYIRQELKNPLNGMQFTRKLLEPSDLTEEQRQLFASNVLCQEQLKKILHDNDLEGIEQCYMEMNTVEFNLEEALNTVLMQGMSVSKEKQISLDRDWPVEVSSMYLYGDNLRLQQVLADYLACTLQFTRPAEGPIVLQVIPKKEHIGSGMQIAHLEFRLVHPAPGVPEALIQEMFRHGPGVSREGLGLHISQKLVKTMSGTVQYLREAESSSFIVLVEFPVAQLNSKRSRPSTSKSNF

SEQ ID NO: 15122 - protein, 407 aa, Fusobacterium nucleatum subsp. nucleatum ATCC 25586
MKILGLKTKIILGMQHVLAMFGATVLVPFLTGLNPSIALICAGVGTLMFHSVTKGIVPVFLGSSFAFIGATALVLREQGIAILKGGVISAGLVYVMMSFIVLKFGVERIKSFFPPVVVGPIIMVIGLRLSPVALSMAGYSNNTFDRDSLIIALIVVISMIFISILKKSFFRLVPILISVAIGYIVAYFMGDVDLSKIHEASWIGLPEGAWDTITTVPKFTFSGVVALAPIALVVFIEHIGDITTNGAVVGKDFFKNPGVHRTLLGDGIATMAAGLLGGPANTTYGENTGVLAVTKVYNPAILRIAACFAIVLGLIGKFGVILQTIPQPVMGGVSIILFGMIAAVGVRTIVEAQLDFTHSRNLMIAALIFVLGIAIGDITIWGTISISGLALAALVGIVLNKILPEDK

SEQ ID NO: 15123 - protein, 188 aa, Zea mays
MRTCSSARQMLLTRLSSVSCSSTAQQLHAGVGKFAAAACWSWKKKREELPCFRARLAAKPPRASPAKGGIVPASDDDDGVSLGTVKLPGNIDTARLESLLFQISSPDAIDQVDKVEGGIRLGFVAVEDGATRTLVYIDCLVSPAPDGSGPVFRAIRNGPMKDKEPPGEPRIMRSLLQALEKSIQIARV

SEQ ID NO: 15124 - protein, 248 aa, Pseudomonas syringae pv. tomato str. DC3000
MLQAASALRHAKRILVITGAGLSADSGLPTYRGVGGLYNGETEDGLPIEMALSGPMLRRDPELCWKYIAELGKACLGGEPNVAHYAIAQLQRIKPECWVLTQNVDGYHRAAGSPPERLIEIHGQLSPLFCQSCAAQDPQLSEHLQRPLPPLCRLCGGILRPPVVLFQEMLPERALETLYEQLATGYDAVLSIGTTASFPYIHEPVIRTRVSGGFTAEINPQPTDHSAQMDVFLQCRAAHVMAELISHI

SEQ ID NO: 15125 - protein, 451 aa, Aspergillus nidulans FGSC A4
MLQVPVREYNSVASGVSTKAIILVGGPSRGTRFRPLSLDVPKPLFEVAGHPIIHHCLKALAKVPELHEVILIGYYDETVFRDFIKDSAKEFPQFRISYLREYTALGTAGGLYHFRDPILKGKPERIFVLNADVCCSFPLGEMLRLFEEKDAEAVILGTRVHNDAATNFGCIVSDSHTKRVLHYVEKPESHISNLINCGVYLFATECIFPSIRSTIKRRTTRPRLLSYPSSDNLEASFVADDDSERTEVLRLEQDILSDLADSNRFFVHETKDFWRQIKTAGSAVPANALYLQKAFQAQSEELAAPSATIVPPVYIHPTASVDPTAKLGPNVSIGPRAIVGAGARVKDSIVLEDAEIKHDACVMHSIIGWSSRVGAWARVEGTPIPMGSHSTSIIKNGVKVQSITILGKECGVGDEVRVQNCVCLPYKELKRDVANEVIMSSKQNASADGQS

SEQ ID NO: 15126 - protein, 401 aa, Cryptococcus neoformans var. neoformans JEC21
MSAILLRSGNVARSTILAGGPSIGGPMTLRSAYSSTRTFSIFTKAKIQSGNMNRASLSLRPSVREAEKSQGPVVGSEGKGVEGPHYQDQASHNVLSDASTTGAWTMFNPIYTEKELNTVQVVGRAPVTFGDKAAHKTVKFLRKCFDLLTGYTPYEVPASVLAQKPIPIAELRSKGKLLSDQKWLFRIILLESIAGVPGMVGGTLRHLRSMRLLKRDGGWIHSLLEEAENERMHLLTFMTIAQPGIFTRALVLAAQGVFYNAFFLTYLISPRIAHRFVGALEEEAVRTYTHCISDMEAGLIPEWKDMPAPAIAIDYWRLPASSSLLDVIRAVRADEATHRFVNHSLANLDQKRDFNPFALSEASPEERGSKWGYTREESARFALEQQQKLMTASEKSKGLVE

SEQ ID NO: 15127 - protein, 364 aa, Spirogyra sp. SVCK 253
  misc_feature (8)..(9): Xaa can be any naturally occurring amino acid
  misc_feature (136)..(136): Xaa can be any naturally occurring amino acid
  misc_feature (148)..(148): Xaa can be any naturally occurring amino acid
  misc_feature (219)..(219): Xaa can be any naturally occurring amino acid
  misc_feature (325)..(325): Xaa can be any naturally occurring amino acid
DNGSGMVXXGFAGDDAPRAVFPSIVGRPRHQGVMVGMGQKDSYVGDEAQSKRGILTLKYPIEHGIVTNWDDMEKIWHHTFYNELRVTPEEHPVLLTEAPLNPKANREKMTQIMFETFNVPAMYVAIQAVLSLYASXRTTGMVLDSGDXVTHTVPIYEGFALPHAILRLDLAGRDLTNHLVSILTERGYSFTTSAQREIVRDIKEKLAYVALDLNRRLPXAQSSSSIEKSYELPDGQVITVGAERFRCPEVLFNPGLLGMEAAGIHDTAYNCIMKCDVDIRKDLYGNIVLSGGTTMFPGIAERMTKEISALAPPTMRIKVVAPPEXKYSVWIGGSILASLSTFQQMWIVKSEYDESGPSIVHQQC

SEQ ID NO: 15128 - protein, 907 aa, Gibberella zeae PH-1
MANKQPLKTTFDIKHVIRPIFTGGSVSIDNDARILATVLGEDVVLTDPTNGKHLAQIEGDGELISTLTLTPSGSHLIICSRSLSMRIYSLKRSEDDETIEATATRSVKAHSTPVNVLTVDRTSTLLATGGTDGAVKVWDIVGGYVTHTFRGSSVLVSSLRFFEAASRSNETQSRKGKKSKRQEESDDEEESSTTINFRLACGQQDGKVRVWDLHKRNCVANLDSHVSDVQGLDYSPEQHALVTAGRDKTITWWDAKSWKIRKVVPCLELVEAAGFIDDGNLTYSAGANGSLRIWDTDTGKEVTPQQSAKSEEEGIVSVIYRPGLPFILLVQVDHTLALYRPPQKADAASLSAPEPFRRISGTHDDIIDLGYLLPDRSMVALATNSEDVRIVSVVETQDQDDGGNSGSSPYFGQDVALLKGHDEIVISLDIDWSGHWIATGAKDNTARLWRIDPANNSYTCWAVFSGHAESLGAVALPKSVPPESSAARTDPLSHPPAFLITGSQDQTVKKWEIPRTAQQGHKNSARAIFTRKAHEKDINAINVHHSNQLFASASQDKTVKIWSAEEGEVQGILRGHKRGVWSVQFSPAQLPAIQGEDGPVTGKGVILTGSGDKTIKLWNLASYTCVRTFEGHSNSILKVAWLNMPTSQEQSKKRVHFASAGGDGLVKVWDANSGETECTLDNHEDRVWVVAVHPENNTIVSGSGDSTVTFWKDTSSETQAAASQAALKVIEQEQELENHIHAGSFREAITLALQLNHPGRLLSLFNSVMTTEKPDKGSLSGLRAVDEVLGSLSDEQIFLLLLRLRDWNTNARTAPVAQRILWTLIRSYPASKFSNLSVKGAKGQKSLKDVLHAIRVYTERHYKRTEELVDESYLVEYTLQEMDDLAPMLEDENALLQDGSEDVVMAG

SEQ ID NO: 15129 - protein, 424 aa, Hordeum vulgare
MVVTVAATGPDTAETLHSTTFASRYVRDQLPRYRMPENSIPKEAAYQIISDELMLDGNPRLNLASFVTTWMEPECGKLIMDSVNKNYVDMDEYPVTTELQVCWEKFARYFEVELKEVKLTEGYYVMDPKKAVEMVDENTICVAAILGSTLTGEYEDVKLLNDLLVEKNKETGWNVPIHVDAASGGFIAPFLQPELEWDFRLPLVKSINVSGHKYGLVYPGVGWVIWRSKDDLPEELIFHINYLGADQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIIGELDAHAVHAIKLSTAAAGGDGASKSAVDAATEAFKDLAGKKKAGVC

SEQ ID NO: 15130 - protein, 398 aa, Burkholderia vietnamiensis G4
MLNSLLDFLSHGLLRFSWWQVALFALAVTHVTIIGVTVYLHRCQAHRALELHPIASHFFRVWLWMTTGMLTGQWAAIHRKHHAKCETEEDPHSPQTRGIWKVFLEGAELYRAEAKNEETMRKFSHGTPNDWIERNVYSKYPILGVSLMMVIDVALFGVLGLTVWAVQMVWIPFWAAGVVNGFGHFWGYRNFNSADASTNLFPWGIVIGGEELHNNHHTFATSAKLSNKWYEFDIGWMYIRIMSAFGLAKVKKIAPTPRLNKPKTVLDQETLQAVLSNRYEVMARYGKAVKRAYRQELAHLKELGSRDKYQLMRGARKWFHKDADGLDEPQKKLLPEIFANSQKLHTYYQLRQDLAAIWDRSTASREQLLAQLQDWCHRAEQSGIKSLQEFATRLRRYA

SEQ ID NO: 15131 - protein, 1139 aa, Triticum aestivum
MSSSRSNNRPACSRGSSARSKHSERVVAQTPVDARLHAEFEGSQRHFDYSSSVSALNRSGASTSSAVSAYLQNMQRGRYIQPFGCLLAIHPESFALLAYSENAAEILDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDDDLSQPISLCGSTMRAPHGCHAQYMANMGSIASLVMSITINEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSTPSEGEITKIVAWLLECHDGSTGLSTDSLLEAGYPGASALGEVVCGMAAIKISSKGFIFWFRSHTAKEIKWGGAKHEPGDADDNGRRMHPRSSFRAFLEVVKWRSVPWEDVEMDAIHSLQLILRGSLQDEDANDNNARSIVEAPSDDIKKIQGLLELKIVTNEMVRLIETATAPILAVDIVGNINGWNNKVAEITGLPTTEAIGMLLVDLVEGDSVEVVKQMLNSALQGTEEQNLEIKLKTMHQQESKGPVVLMVNACCSRDLSDKVVGVCFVAQDLTGHKMVMDKYTRIQGDYVAIVKNPNELIPPIFMINDLGSCLEWNEAMQKITGIKREDAIDKLLIGELFTLHDYGCRVKDQVTLTKLSILMNTVISGQEPEKLAFGFFNTDGKYMESLLTANKRTDAEGKITGALCFLHVASPELQHALQVQKMSEQAATHSFKELTYIRQELKNPLNGMQFTRKLLEPSDLTEEQRQLFASNVLCQEQLKKILHDNDLEGIEQCYMEMNTVEFNLEEALNTVLMQGMSVSKEKQISLDRDWPVEVSSMYLYGDNLRLQQVLADYLACTLQFTRPAEGPIVLQVIPKKEHIGSGMQIAHLEFRLVHPAPGVPEALIQEMFRHGPGVSREGLGLHISQKLVKTMSGTVQYLREAESSSFIVLVEFPVAQLNSKRSRPSTSKSNF

SEQ ID NO: 15132 - protein, 420 aa, Burkholderia vietnamiensis G4
MKLHGFLIGQTETLLAEVLKFAGPADATTSRFFRAHPKLGHAERGVIAEAVFAVLRRKMEFSHLAESGTGSPARRLTLLGLMQTLGRNALKPFVSDNEAAWLEHVSKIDPASLPVRVRTNLPDWIYQALSARFDADELAQLAAALNYPAPLDLRANVQKATRDQVIDALRANGIEAGATPFAPNGVRVVGKPALTRLKLFEEGQIEVQDEGSQLLCSLVAPRRGEMVVDFCAGAGGKTLALGAMMRSTGRLYAFDVSEKRLAKLKPRLARSGLSNVNPVLIDSEHDAKIKRLAGKIDRVLVDAPCSGLGTLRRNPDLKWRQTRTSIDELAPKQASILASAARLVKKGGRLVYATCSVLDAENEAIVEQFLADHPDFVLVPAQKVLADQRIELDTGDYLSLWPHRHATDGFFAAVLERRAQ

SEQ ID NO: 15133 - protein, 1139 aa, Triticum aestivum
MSSSRSNNRPACSRGSSARSKHSERVVAQTPVDARLHAEFEGSQRHFDYSSSVSALNRSGASTSSAVSAYIQNMQRGRYIQPFGCLLAIHPESFALLAYSENAAEILDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDDNLSQPISLCGSTMRAPHGCHAQYMANMGSIASLVMSITINEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSTPSEGEIKKIVAWLLECHDGSTGLSTDSLLEAGYPGASALGEVVCGMAAIKISSKGFIFWFRSHTAKEIKWGGAKHEPGDADDNGRRMHPRSSFRAFLEVVKWRSVPWEDVEMDAIHSLQLILRGSLQDEDANDNNARSIVEAPSDDIKKIQGLLELKIVTNEMVRLIETATAPILAVDIVGNINGWNNKVAEITGLPTTEAIGMLLVDLVEGDSVEVVKQMLNSALQGTEEQNLEIKLKTMHQQESKGPVVLMVNACCSRDLSDKVVGVCFVAQDLTGHKMVMDKYTRIQGDYVAIVKNPNELIPPIFMINDLGSCLEWNEAMQKITGIKREDAIDKLLIGELFTLHDYGCRVKDQVTLTKLSILMNTVISGQEPEKLAFGFFNTDGKYMESLLTANKRTDAEGKITGALCFLHVASPELQHALQVQKMSEQAATHSFKELTYIRQELKNPLNGMQFTRKLLEPSDLTEEQRQLFASNVLCQEQLKKILHDNDLEGIEQCYMEMNTVEFNLEEALNTVLMQGMSVSKEKQISLDRDWPVEVSSMYLYGDNLRLQQVLADYLACTLQFTRPAEGPIVLQVIPKKEHIGSGMQIAHLEFRLVHPAPGVPEALIQEMFRHGPGVSREGLGLHISQKLVKTMSGTVQYLREAESSSFIVLVEFPVAQLNSKRSRPSTSKSNF

SEQ ID NO: 15134 - protein, 712 aa, Rhodopirellula baltica SH 1
MDLNSQRRVSHVRERGISPSIPNLDSNMNAWEKAEGSPFPLGASWIAEESSFNFSLYSRHATAVHLLLYRKDDLVHPAREVELSYLFNKSGPVWHCRVRSEHPDEWAYYAYRVDGPAPQGGYDHHDFDFQKILLDPFARGVFFPESFSRNAARRPGSNSGQAPLGILPNQFCEFDWNEDRVLRHGSDLVIYEMHVRGFTKNPNSGVPETHQGTFLGVVDKIPYLVELGVTAVELMPVFQFDPGDGDYWGYMPLNFFAPHHAYATNTTACNQRDEFCTMVKALHAAGIEVILDVVYNHTCEGGHRGPTYCWKGIDSSTAYMMTGNPNAPYANHSGTGNTLHTANRAVRRMIVDSLRFWDSQMHVDGFRFDLASVFTRNSDGSINLDDPPIVSEIGTDSDLSDDRLIAEPWDADGQFQLGKKFPGQRWMQWNAHYRDTMQRFVRGDCGMVSDLMTRLYGSCDLFPDDLPHALQPQLSVNYITSHDGSTLYDLTAYNEKRNWANGNNNTDGALEYSWDCGWEGDDGTPSEILQLRKQQVRNFFCLLMLSNGTPMFRMGDEFLQTQRGNNNPYNQDNETSWLDWDRRSEHADIFNFVREVISFRKSHPSISRSRFWRGDVRWYGTGHLVDMSLESRQLAYCLHGESQDDADIYVMINAGRDSVEFGIQEWAFEKWRLAIDTSRTSLSELSDDPANQCVASPTWNVNARSICVLVER

SEQ ID NO: 15135 - protein, 451 aa, Glycine max
MGNLFGKNKKRDTESANNNKGRGGRIYTAVTTRGLPPHFPTQLPHSQPPPLLYPTLEPPPPPPPPPPPPALPQSMSKKPSFARVFAKQSSSVMNNNQSAAKKYALIRDNFSTLEQVTTALRKEGLESSNLILGIDFTKSNEWTGRISFNKRSLHAIGSTPNPYEKAISIIGKTLAPFDDDNLIPCFGFGDATTHDQEVFSFHSDHSPCHGFEEVLACYQKIVPNLKLSGPTSYAPVIEAAIDIVEKNRGQFHVLVIVADGQVTRSVDTSDGELSPQEEKTIKAVVDASAYPLAIVLVGVGDGPWEDMRKFDDKIPARDYDNFQFVNFTEIMSKNISPSEKEAAFALAALMEIPFQYKATMEFGILGRVTGRAKRIVPKPPPVPYSRPAPSINTAASSGDDQNQTACPVCLTNARDLAFGCGHMTCRECGHKLTNCPMCRERITSRLRVYSG

SEQ ID NO: 15136 - protein, 1139 aa, Triticum aestivum
MSSSRSNNRPACSRGSSARSKHSERVVAQTPVDARLHAEFEGSQRHFDYSSSVSALNRSGASTSSAVSAYLQNMQRGRYIQPFGCLLAIHSESFALLAYSENAAEMLDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDDNLSQPISLCGSTMRAPHGCHAQYMANMGSIASLVMSITINEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSTPSEGEIKKIVAWLLECHDGSTGLSTDSLLEAGYPGASALGEVVCGMAAIKISSKGFIFWFRSHTAKEIKWGGAKQEPGDADDNGRRMHPRSSFRAFLEVVKWRSVPWEDVEMDAIHSLQLILRGSLQDEDATDNNAGSIVEAPSDDIKKIQGLLELRIVTNEMVRLIETATAPILAVDIVGNINGWNNKVAEITGLPTTEAIGMLLVDLVEGDSVEVVKQMLNSALQGTEEQNLEIKLKTFHQQESKGPVVLMVNACCSRDLSEKVVGVCLVAQDLTGHKMIMDKYTRIQGDYVAIVKNPNELIPPIFMINDLGSCLEWNEAMQKITGIKREDAIDKLLIGEVFTLHDYGCRVKDQATLTKLSILMNTVISGQEPEKLAFGFFNTDGKYMESLLTANKRTDAEGKITGALCFLHVASPELQHALQVQKMSEQAATHSFKELTYIRQELKNPLNGMQFTRKLLEPSDLTEEQRQLFASNVLCQEQLKKILHDNDLEGIEQCYMEMNAVEFNLEEALNTVLMQGMSLSKEKQISLDRDWPVEVSSIYLYGDNLRLQQVLADYLACTLQFTRPAEGPIVLQVIPKKEHIGSGMQIAHLEFRLVHPAPGVPEALIQEMFRHGPGVSREGLGLHISQKLVKTMSGTVQYLREAESSSFIVLVEFPVAQLNSKRSRPSTSKSNF

SEQ ID NO: 15137 - protein, 201 aa, Oryza sativa (japonica cultivar-group)
MAVAIEAPFHVLAVDDSLPDRKLIERLLKTSSFQVTTVDSGSKALEFLGLHDHEDSPISTQSDQQEVGVNLIITDYCMPGMTGYDLLKKIKESSYLRDIPVVIMSSDNIPSRINRCLEEGADEFFLKPVRLSDMSKLKPHILKSRCKEHYQQEQHLQSNSESNNSSNPTSENSSSSTSTNSHKRKAVDEEILPHTIRPRHS

SEQ ID NO: 15138 - protein, 192 aa, Glycine max
QAYGDIQLMPFVDYYSLISLKTIAICIMGTKIIPSKYIMKTDDDAFVRIDEVLSSLKGKPSEGLLYGLISSKSSPQRDEGSKWYISEEEWPHDTYPPWAHGPGYVISRDIAKFIVHAHQERKLKLFKLEDVAMGIWIEQFKNDGKEVHYENDERFYNAGCESNYVIAHYQSPRMVLCLWEKLQKEHQPVCCE

SEQ ID NO: 15139 - protein, 323 aa, Fusobacterium nucleatum subsp. nucleatum ATCC 25586
MLDTEIIEIAKNIYDTEIKSLELRMNKLSENFVKVVRKIYDCKGKVVVTGIGKTGIIGKKISATFASTGTTSIFMNSTEGLHGDLGIINPEDIVLAISNSGESDEILAIMPAIKNIGACIIAMTGNINSRLAKASDLYINTHVEEEGCPINLAPMSSTTNALVMGDALAGCLMKLKNFSPQNFAMYHPGGSLGRKLLTRVGNLMKTGEALALCKADTSMEEIVILMSEKKLGVVCVMNDENNILIGIITEGDIRRALSHKEEFFKLKAKDIMTTKYTKVDKEEMATQALSIMEDRPHQINVLPVFDNDKFVGVIRIHDLLKVR

SEQ ID NO: 15140 - protein, 200 aa, Lactococcus lactis subsp. lactis Il1403
MTRISHITRNTKETQIELSINLDGTGQADISTGIGFLDHMLTLLTFHSDFDLKIIGHGDHETVGMDPHHLIEDVAIALGKCISEALGNKLGIRRYGSFTIPMDEALVTCDLDISGRPYLVFHADLSGNQKLGGYDTEMTEEFFRVLAFNAGITLHLNENYGQNTHHIIEGMFKSTARALKQAVSIDEAKVGEIPSSKGVL

SEQ ID NO: 15141 - protein, 121 aa, Oryza sativa (japonica cultivar-group)
MSSPHVLVVDDTLVDRHVVSMALMRHNVRVTAVESVMQALMFLDSEHDVNMIVSDYCMPDMTGYDLLMEVKKSPKLAHLPVVIASSDNIPERIRKCLDGGAKDYILKPVKIVDLPRILNYI

SEQ ID NO: 15142 - protein, 212 aa, Lactococcus lactis subsp. lactis Il1403
MRPDFHKQELIPVIVQDYQTNQVLMLAYTNEVAFEKMLETGETWFWSRSRQKLWHKGEESGHFQKIKGMRLDCDQDTLLVFVEQIGNACHTGTYSCFYDELIPFDDSDIFSELEKQIIDRKLHPVEKSYTNYLLGEGIDKVLKKVGEEASEVIIASKNSDKGELLGEIDDLLYHLFVLMNQQGISLEEVRQKAKERHQLEGNKKEFHTRTAD

SEQ ID NO: 15143 - protein, 181 aa, Oryza sativa (japonica cultivar-group)
MGGATSPAAPCLSVCLLPLLFLFLHGCWSCVAIERERTLAMIKPDGLSGNYTERIKEVILESGFDIVKEAVVQLDAERASLFYAEHSGRSFFDSLVKYMTSGPVLVMILERPDAISHWRVLIGPTDARKAKISNPNSIRAMCGVDSEKNCVHGSDSPQSAAREISFFFGDVRSDTVEHDEL

SEQ ID NO: 15144 - protein, 366 aa, Glycine max
MSLFLTSVHLVFILSSIIQRAYSFSGPNSTNSGADSLGNKNSSYVKGPVVEEFTFPERSTPFNSCHASTIVEVGKGHFLVAYFGGSSEGAPDVKIWLQTYKSGRWKSPIIADEEPNVPMWNPVLFKLPSNELLLFYKIGLDVQKWSGFMKRSYDKGITWTEREQLPSGILGPIKNKPLLLENGDLLCGSSVESWNSWGAWAEVTTDFGGAWRKYGPIYIENKPHGVIQPVPYQTAKGTLRVLLRSFTGLGRIYMSESFDGGKSWGYAKPTQLPNPNSGIDGVKLKDGRLLLAYNTISRGVLKLALSEDDGDSWHEALTLEDTLGMEFSYPAVIQASDGRVHVTYTYKRTQIKHVVVRPRRCKSTCF

SEQ ID NO: 15145 - protein, 199 aa, Colletotrichum trifolii
MAQPGVQSLKCVVTGDGAVGKTCLLISYTTNAFPGEYIPTVFDNYSASVMVDGKPISLGLWDTAGQEDYDRLRPLSYPQTDVFLICFSIVSPPSFDNVKAKWYPEIDHHAPNIPIILVGTKLDLREDPNTLESLRQKRMEPVSYDQALICAKEIKAHKYLECSALTQRNLKSVFDEAIRAVLNPRPVAQQKKKSKCTIL

SEQ ID NO: 15146 - protein, 131 aa, Brassica napus
DEDSPQQRAVHQQVPDFGYSPAPQASKHSNITKPERKPRPVAPPPRRETPSPAKPSRPSPSQQQPIQREKEHKEIDFDSARKRLQQNYRQAENAKKQRTIQVMDIHEIPKPKKGGFFPRKGGSSQGGGRHW

SEQ ID NO: 15147 - protein, 434 aa, Vibrio angustum S14
MSKIVKVLAREIIDSRGNPTIEAEVHLEGGFVGMAAAPSGASTGSREALELRDGDKSRFLGKGVLKAVAAANGPIAEALIGQDAKDQAAIDQVMIDLDGTENKSNFGANAILAVSLANAKAAAASKGMPLFEHIAELNGTAGQFSMPLPMMNIINGGEHADNTVDIQEFMIQPVGAKTLREAVRMGSEVFHSLAKVLKSKGMSTAVGDEGGFAPNLESNEAALKAIKEAVEAAGYELGTDITLAMDCAASEFYNKEQGIYDLKGEGKQFTSEEFNYFLKDLTEKFPAIVSIEDGLDESDWAGFKHQTELLGDKIQLVGDDLFVTNTKIFAEGIEKGITNSILIKLNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 15148 - protein, 348 aa, Rhodopseudomonas palustris CGA009
MTASPSQLPVLDLSRFRSDTAERAEFLRDVRDAAFGPGFFYLVGHGISDRLIRDVLFASRNFFALPEADKLDIEMINSPHFRGYTRAGREFTRGQPDWREQLDVGAEREAFPLSRSAPPWTRLQGPNQWPDALPELKPLLLRYQQEVTELAIKVLRVFAAALGQAEDVFEPIYVPSPNQLIKIIRYPGRAADESDQGVGTHKDSGFVTILLQDTVAGLQVETADGWIDAPPLPGSFVVNIGEILELASNGALRANVHRVVSPPPDTDRLSVAFFLGARLDATVPVLTLPPELADYARGVTQDPQNPLFRDVGRNYLKGRLRSHPDVAERHHADLLDEYAIKPGLAAAY

SEQ ID NO: 15149 - protein, 884 aa, Gibberella zeae PH-1
MLWAAPAMMEHSPKPPSRPRYAAMRDDQERDDQGERALDEQVERSPEEIEVLDRGQGIIAPSLLQGSTVDTPHGDDAKHRLAITYGLQNPQCDHASDPQQNQNQAPGVQIEKEGPGNSHRVGHLCQSIEHLRRGEFSRYLLRANVNQTMNNSPRGDSIRQGHLTLAKNGDLERDHLAGATLQGNDPYGQSPQNSYHNSPTRSPYGSSRGGRNGQQSHPQGSNYGPPSGPSSQYHPNPSRSPPHSAPTGPMQQYPQGGSYRGGYRGGGFRGGSFGNRGRGGFKNSHWNQGPPQRGHHDDLGNGRFSNVDEPSAMDIDRMDDGDESYQTHDRNAEDGADGLATPNRPPPTGPGSQSQSGGSGSKFSFAFKPSSKPALTAPKPEISQKLNAAPRRDAQKDSRDNDRDRSRDHDRERERDRDRDREREREREREREREKGRERDRDREPPRSAPTEPASSRSRHDRRQPPEGPRVTPRMRKVKKMMKRPKPRPTLPADLVDSESVFFRKPGNESVVGSGTYGKVFKGLNVYTKGMVALKKIRMEGERDGFPVTAVREIKLLQSLRHVNIVNLQEVMVEKNDCFMVFEYLSHDLTGLLNHPTFKLEAAQKKDLAKQMFEGLDYLHTRGVLHRDIKAANILVSNEGVLKIADFGLARFYAKRHQLDYTNRVITIWYRSPELLLGETKYTAAVDVWSAACVMVEIFDRNAIFPGDGTEFNQLEKVYNVMGTPNLKDWPGLVEMPWFELMRPTVKKKNIFEEKYREKMSPAAFELLSVMFHYDPVKRPSASEVLQHTYFTKEEPPARQATELSTHNDWHEFESKALRKENDRREREARKLAKEGASRDADKDKDKKRVNEGIDQPDAKRVQVDKNGGNKPTPAVTSSKPTEA

SEQ ID NO: 15150 - protein, 181 aa, Impatiens balsamina
MYMRKRSSSSSSTEPLAVGRVIGDVIDPFVLAVKMLVTYNNKQVYNGYELFPSQITSKPRVEVHGGDLRTFYTLVMTDPDVPGPSDPYLKEHLHWMVTDIPGTTDATFGKEMVKYEMPMPNIGIHRFVFVLFKQRCRQSVQPPSSREHFNTRRFAADNDLGQPVAAVFFNAQRETAARCRR

SEQ ID NO: 15151 - protein, 334 aa, Bradyrhizobium japonicum USDA 110
MSIADAEFAQAKTAQSAPTAAKPQLPPGVVTEGPLVKAKLRESYLLLGILYVGAVAGIIWAVTQGVGKVELFTFAWMFALTTFGIGAGMHRLFVHRSFRTGPIMRVFFCAIAQMAVQGSIAKWVANHRRHHLYADDVGDPHSPQFDGFGNRYVSALKGFLHAQGSWVFDQATTDNEYYAKDILADPIAMFFVRTRWVWYGMSAVFIPGFIGYVFGGVHTMIGCVLFSGLLRAYLLILVSQLTGSVCHAYGYRRFEVDDASTNEFVTTILTFGEGLHNNHHRFPRDAYISHAWWEIDLNGLIILGMEKIGLVHDVFHASHRQLERASEAQAASTR

SEQ ID NO: 15152 - protein, 418 aa, Methanosarcina barkeri str. Fusaro
MFLQDYELSEEEKVLLQKILDGDVALRKIEEFADPETSVKLRRLAIQEFAKLEFEHIQNFSLDVEAASKRNIENMIGAVQIPLGIAGLLKVNGEYANSEYYIPLATTEGALVAGVNRGCSVITKSGGANVRVFEDEMTRAPVFKLESLSRAKEFYEWVKCPEIFEKMKVVAEKTTRFGKLLSVRPFVTGTYVYLRFSYDTKDAMGMNMVTIATDAVMHLIQDEFGAHPVTLSGNMCIDKKPASISTILGRGKTVVAEVTIPKEIVKETLKCTPESMFEVNYSKNLLGSARAGALGFNAHAANIIAAIYLACGQDAAHVVEGSTAITSMELTKYEEIQCSVTLPSLPVGTVGGGSGLGTQRDCLNILGVAGAGDVPGINSKKFAEIVASAVLAGEVNLIGAQAAGHLARAHAQLGRGKF

SEQ ID NO: 15153 - protein, 314 aa, Aspergillus nidulans FGSC A4
MASTTKESAKPAVDFLHHPYTRAALPFINGGLAGMTATVVIQPIDMIKVRLQLAGEGVRTGPRPSALGVARNIIASGKVLDLYTGLSAGLLRQAVYTTARLGFFDTFMKALTKNADTANRKVTFAERAGAGLTAGGIAAMIGNPADLALVRMQSDGLKPPEARAHYRSVIDALFRISKAEGVTALWAGAFPTVVRAMALNLGQLAFFAESKAQLKTRTSLSAQNQTFAASAIAGFFASFLSLPFDFVKTRLQKQQKDPKTGQLPYKGMFDCARKVVRDEGWLRFYRGFGTYYVRIAPHAMVTLIVADYLNLITK

SEQ ID NO: 15154 - protein, 404 aa, Brucella melitensis 16M
MIRTERRNMMFRTLDDANVQSKRVLVRVDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAIVGWHFAADTPHQTYGVDSVPGDAMILDAGELSTDLIASAIDDAATLVWNGPLGAFELRPFDTATVKVARHVAKRTKEGKLVSVGGGGDTVAALNHAGVADDFTYISTAGGAFLEWMEGKPLPGVDVLKK

SEQ ID NO: 15155 - protein, 584 aa, Oryza sativa
MPRALQRSGSNSLAALLRADPPPNAAIADQDDAKRPGRRRRRRRRSCLRLPLGVGAGGCRVCACDEMDPATAAPRRRAPEEKDDDEEEEEAVPPAALQCFSWKKGAAAARTSGVGDGDRVMVEEVEAAAASLSVLPDDLMEMVLGRLPLASLLAARCACRRWRDLTVAPQFMRMRRVEARPHRTPWLFLFGVEGDGWGATAAATAVHALDVDAQRWRRVGADGLRGRFLFSVAGVGDELYVVGGRSGDAGSVKTKTHKGVLVYSPLAGAWRKAASMRSARSRSVLGVFEMGTISRSILLARADKHVHRHANTGGGKFRLGGTSAVYEDPHRLSLRRLRLRDVLNDDADSSEFAATDAKVAGQEEERRAQQRLALIAVGGRGRWDEPLVSGEIYDPVTDKWFEIAGFPADVGLACSGAVCGQMFYVYCESDTLVAYHLDKGFWSVIQTSRPPPRLRDYAPTLLCCSSRLLMLCVSWCDRAGNGSASRRERVMRNLFELDLGSRRWGEASSHPDAPMDLNAAFAAGADTVYAVEMFRVFGKVLDFVTACRVSDTDDHRWRRLARNNAAADADAMSSKLKSMAVLHL

SEQ ID NO: 15156 - protein, 335 aa, Brucella melitensis 16M
MAVRVAINGFGRIGRNILRAIVESGRTDIQVVAINDLGPVETNAHLLRYDSVHGRFPKEVEVAGDTIDVGYGPIKVHAVRNPAELPWKEENVDIALECTGIFTSRDKAALHLEAGAKRVIVSAPADGADLTVVYGVNNDKLTKDHLVISNASCTTNCLAPVAQVLNDTIGIEKGFMTTIHSYTGDQPTLDTMHKDLYRARAAALSMIPTSTGAAKAVGLVLPELKGKLYGVAIRVPTPNVSVVDLTFIAKRETTVEEVNNAIREAANGRLKGILGYTDEKLVSHDFNHDSHSSVFHTDQTKVMDGTMVRILSWYDNEWGFSSRMSDTAVALGKLI

SEQ ID NO: 15157 - protein, 707 aa, Brucella melitensis 16M
MLCVPLPSGASSRKAADGFRWRLCSGKRHRRNPVKPSQGKTAETMTNTDKQNQMANAIRFLSMDAVEKANSGHPGLPMGAADIATTLYTRFLSHDPKNPHWPDRDRFVLSAGHGSMLLYSLLYLSGYEDITIDEIKKFRQLGSRTAGHPEYGHAAGIETTTGPLGQGIANAVGMAISERILNAQFGDSLVNHYTYALVGDGCLMEGISQEAIALAGHLKLNKLIVLWDDNNISIDGPITLSDNTDQPARFAASGWNTMAVDGHDQDAIAKAIELARVSDRPTLIACKTTIGFGAPNKAGTNKVHGSPLGAEEIAATRKALGWSSEPFVVPAEVLDAWRVAGLNAAKKRLEWEKRLSAVEAETRAEFERRMRGELPSGFDAAIVEYKKKLSADKPKVATRKSSEMALEVINGVVPETVGGSADLTGSNNTKTSQTKAVTPENYDGRYIHYGIRELGMAAAMNGITLHGGLIPYSGTFLCFSDYARPAMRLSSLMGIRVVYVMTHDSIGLGEDGPTHQPVEHLAALRAIPNHNVFRPADAVETAECWQLALHSRKTPSTLALTRQNLPTVRTEHREENLCAFGAYELAAASSDAKVTIFATGSEVEIALKARDLLEGKGIATRVVSVPCFELFEQQSDTYKEATIGDAPVKLAIEAAISLGWERFIGENGIFIGMKGFGASGEINDLYKHFGITAEHAVEAAEKKLNAA

SEQ ID NO: 15158 - protein, 210 aa, Brassica napus
  misc_feature (201)..(201): Xaa can be any naturally occurring amino acid
RGRTRGVGVNAGLFSRELMSYSVSAIRELAKGSSIDPLMVLEKAHSQTRAQGSSTACIIALTDKGLHAINLGDSGFTVVRDGTTVFQSPVQQHGFNFTYQLGCGDSGGDMPRSGQVFMIDVEAGDVIVAGTDGVYDNLYNEDITGVVVSSVRAGLDPKGTAQKIADLARARALDKKRQSPFATAAQEAGYRYYGGKLDDIXALVSYVTPA

SEQ ID NO: 15159 - protein, 934 aa, Cryptococcus neoformans var. neoformans JEC21
MRTLPLTRSPFITRRCLTTLGLRREDPSRIWERRTPLTPHAVQSLLADAKDQLKVEVESCKRRCFPDSLYSDAGAKIVPSLSKDVDVILGIKEPRLSDIRNLVEASKNEGKKRTWMMFSHTHKGQEYNIPLLSAFLHPTQTLIDHELLTAPAPGKDGKPQLKRVAAFGWFAGAVGAGEALSLTGLALLRRGLATPLLSLSRPYSLGSLAAFKEALKKAGEEVKTSADLKGQEPIVIGVTGAGNVSSGATEMLNELGVVWVGPEDLADLRQSGSPNKIYACAITPASYLQRIEGGIFDKQEYYKSPDKYMSIFAAKIAPHLTTLINGVGWSKGFPRAITRPSLNKLIEKENGKQKLVAVQDITCDKEGGLEFVDQFTTVDNPYFEGPGDILISAIDILPTELAADASSYFSSALYPYIQGLLFPSGQGDKNDITETLSRAAIVKDGVLQSQHEWLGEKIEQWKTGGAVAPDSLKQEKLRKGGKKKVLLLGSGLVAGPAVDVFAARPDVHLIIASNNLAEGQSHIRGRPNVEAMALDVADDASMSEIVEEADIVVSLLPAPMHLRVAKHCLDHSRHLVTASYVSPELQALHSQAIEKDVIFLGECGLDPGIDSMAAMRILERAKREGKQVKSFVSWCGGLPELSASKVPLRYKFSWSPKAVLTAAQNDASYKLEGKHVKIPGNELLARRFPEVKLWDGLPLEGLANRDSMPYAKKYGLGPAEGLTDLFRGTLRYQGFSSLLESFRLLGLLRSDPLPGSPKSWTEFLSMTVERELGLSKGLKGEDVSSAVQDLVGEGSKDVIRALKLFSLFPGSDTSLLPLPNLPTPSPIDFFAHLLSRKLAYLPDERDTCLLHHSFTISTPSGDTQKVTASLRHMATPTQSSMSITVGKTLAFAALRIADGEVKVRGVTGPYEPEVWAGVLSSLEGAGVVIEEKWH

SEQ ID NO: 15160 - protein, 221 aa, Dendrobium grex Madame Thong-In
LTLTKCWVMGRGRVELDTSAPFESVKEAVDRFGGGAVWKSQLKLFSNSFQHHSVEDFELMNVQEQAARLEKELTLKERETLEVLKELERTKINVDTLKTKLQEKLSEVNKFPETHSDDLKLHPVIEPEGEIASVNSIHAVMQTTQSPVSILAGLSQAKMNLSRKTGDLEYIRASIGTLNQKLEEEKDLIKKTHEKPFFKKKPPFLLSKMICSKKKDITQHN

SEQ ID NO: 15161 - protein, 553 aa, Lactobacillus acidophilus NCFM
MPTDIEIADAAKMQPITEIAQKLGLSSDDIEQYGHYKAKINLPVKEVEGKKHKLILVTGINPTSAGEGKSTVLVGLGDALNQLGHQTTIAMREPSMGPVFGIKGGATGGGYSQVVPMEDINLHFTGDMHALTSANNTLAALIDNYIMRDNVLGLDPRRIIWKRVEDVNDRVLRNVVTGLGGIMQGVPRETGFDITAASEMMAILCLSESLHNLKKRIGRIVVGYTYEKKPVTVDQLGFTGAITLLLKDAIKPNLVQTLDHTPAIIHGGPFANIAHGCNSVLATQIALKTSDYTVTECGFGADLGAEKFLDIKRPVLGETPNAVVIVATARALKLNGGADKDELTKEDIPALEKGMANLRRHVENMQKYNLPIVVAINHFNSDTEAEIKTIQDACAEMGVKAIEVDAWAKGGQGTQDLAKEVVKLADEELEFHELYKNSDSIEDKLSAIATKIYGAKRVVLSKKAKRQIKTFNEQGWNDLPVCIAKTQYSFTDDQTKLGAPTDFDFHIRDLVPKLGAGFIVALSGTMMTMPGLAKHPAAENMDIDDNGQIAGLF

SEQ ID NO: 15162 - protein, 250 aa, Triticum aestivum
LIDRSSSSFLQQSAKMKSSSGGHVVGVPVTSKAYGIEEKAPSARDGQSFRKADGDHLAVSLTNPSPYTSFGYKHSSKGQVVHWVSKLSRRAQGFREHVTLGPKISETVKGKLSLGAKILQAGGIERVFRKAFTAEKGERLVKALQCYLYTTGGPIAGMLFVSTKRIAFRSDRPVTVTSPRGDVARVSYKVVVPLKRIDKVRPSENVDRPEEKYIHVATVDGFEFWFMGFVSYQRSCKYMQQVIGGVAELQ

SEQ ID NO: 15163 - protein, 506 aa, Oryza sativa (japonica cultivar-group)
MERDAWLLCAALAAATVVYYLACTTSRRAQRRRLPPGPTPLPVIGNVLSLRGNMHHALARLARERYGPVMALKLGLVTAVVVSSPDAAREAFTKHDRRLAARAVPDTSRVRGFADRSMIWLPSSDTRWKTLRGVVATHVFSPRSIAAARGVRERKVRDIVGYFAAHVGEVVDVGEAVYSGVVNLVSNAFFSGDVVDVGEESAHGLREAVEDIILAIAKPNVSDLFPFLRPLDLQGWRRWAEKRYDTVFDILDNITNSRLADASAGNHAGDFLDSLLGLMSYGKIARDDVTTIMFDVFGAGTDTIAITVQWAMAELLRNPSIMAKARTEMEDVLAGKKTIEENDTEKLPYLRAVIKEAMRLHPVAPILLPHQAAEDGVEIGGYAVPKGSTVIFNVWAIMRDPTAWERPDEFMPERFLQRAEVDFRGKDFEFMPFGAGRRLCPGLPMAERVVPFILASLLHAFEWRLPDGMSAEELDVSEKFTTANVLTVPLKAVPILASSASELQAS

SEQ ID NO: 15164 - protein, 419 aa, Geobacter sulfurreducens PCA
MKRVVIIGMGFGGIRAARTLAQKGLDVVLVDRNNYHLFQPLLYQVATAGLEQESIAYPVRAMARGWTGTRFQLAEVTGVDFEARQVVTDNGTIPYDYLVIGAGSVTNYFGLKSVEQHAFDLKELVDAERLRNHILTAFERAVVEPDPAKRRALMTFVIVGGGPTGVEFAGALIELVRYVLTKDYPELSVQAARVVLVEAFDRLLAAMPAELQGYTLEKLRGMGVEVLLNARVVDAGPERVTLHDGAVIPAHTLFWSAGVKAAPLAATLGVEQNPGGRIAVEPDLTLPGHPDVYVVGDMAWLEQDGAPLPMVAPVAMQMGIHAGKSILAREQGAPAPPFRYHDKGSMATIGRSAAVASAFGMNLRGYAAWIAWLLLHLYYLIGFRNRIVVMLNWIWYYWFHERQVRLITERETPGNGCTR

SEQ ID NO: 15165 - protein, 401 aa, Xanthomonas oryzae pv. oryzae KACC10331
MNEVVIPSVLQDVPVRTSEPRKQNLLDLDREGLERFFADTLGEARYRAHQVMKWIHHRYVTDFDHMTDLGKALRAKLHQHAEVLVPNVVFDKPSTDGTHKWLLAMGTDGKNAIETVYIPDKGRGTLCVSSQVGCGLNCSFCSTATQGFNRNLTTAEIIGQVWVAARHLGNVPHQQRRLTNVVMMGMGEPLMNFDNVVRAMSVMRDDLGYGLASKRVTLSTSGLVPMIDRLSTESDVSLAVSLHAANDALRETLVPLNKKYPIAELMESCARYLRGSKKRDSVTFEYTLMKGINDQPEHARQLARLMRQFDNAVQSKDAGKVNLIPFNPFPGTRYERSGETEIRAFQKILLDAQVLTIVRRTRGDDIDAACGQLKGQVMDRTRRQAEFRRTLEGQADRDAAA

SEQ ID NO: 15166 - protein, 181 aa, Impatiens balsamina
MYMRKRSSSSSSTEPLAVGRVIGDVIDPFVLSVKMLVTYNNKQVYNGYELFPSQITSKPRVEVHGGDLRTFYTLVMTDPDVPGPSDPYLKEHLHWMVTDIPGTTDATFGKEMVKYEMPMPNIGIHRFVFVLFKQRCRQSVQPPSSREHFNTRRFAADNDLGQPVAAVFFNAQRETAARCRR

SEQ ID NO: 15167 - protein, 95 aa, Triticum aestivum
TPYMPHVSLLYGDLTDEEKEAARKKVEEMDSELSGLQFEISELALYRTDTEDKSLESWELVEVCHLGRSDRFLPMICFCCPARGSKPALESSSSL

SEQ ID NO: 15168 - protein, 428 aa, Trichodesmium erythraeum IMS101
MKNVLSIILGGGAGTRLYPLTKLRAKPAVPLAGKYRLIDIPISNCINSEIQKIYVLTQFNSASLNRHITRTYNFSGFSDGFVEVLAAQQTKDNPEWFQGTADAVRKYIWLFKEWDIDYYLILSGDHLYRMDYRDFVQRHIDTKADITLSVLPIDEARASEFGVMKIDNSGRIVEFSEKPKGNALKAMAVDTSILGVSPEIATKQPYIASMGIYVFNKDAMIKLIEDSEDTDFGKEILPKSAQSYNLQAYPFQGYWEDIGTIKSFYEANLALTQQPQPPFSFYDEQAPIYTRSRYLPPSKLLDCEITESIVGEGCILKKCRIDHCVLGVRSRIEANCIIQDSLLMGSDFYESPTERRYGLKKGSVPLGIGAETKIRGAIIDKNARIGCNVQIINKDNVEEAQREEEGFIIRSGIVVVLKNATIPDGTVI

SEQ ID NO: 15169 - protein, 790 aa, Triticum aestivum
MTMMAMPEAPCLCARPSLAARARRPGSGPAPRLRRWRPNATAGKGVGEVCAAVVEAATKVEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLADLVTYNKKYNLPNGENNRDGENHNLSWNCGEEGEFARLSVKRLRKRQMRNFFVCLMVSQGVPMFYMGDEYGHTKGGNNNIYCHDSYVNYFRWDKKEQYSELHRFCCLMTKFRKECEGLGLEDFPTAKRLQWHGHQPGKPDWSENSRFVAFSMKDERQGEIYVAFNTSHLPAVVELPERAGRRWEPVVDTGKPAPYDFLTDDLPDRALTIHQFSHFLYSNLYPMLSYSSVILVLRPDV

SEQ ID NO: 15170 - protein, 454 aa, Glycine max
MASRIVQQQQARGEAVVGGGKQQKKNGVADGRNRKALGDIGNLANVRGVVDAKPNRPITRSFGAQLLANAQAAAAADNSKRQACANVAGPPAVANEGVAVAKRAAPKPVSKKVIVKPKPSEKVTDIDASPDKKEVLKDKKKEGDANPKKKSQHTLTSVLTARSKAACGITNKPKEQIIDIDASDVDNELAAVEYIDDIYKFYKLVENESRPHDYIGSQPEINERMRAILVDWLIDVHTKFELSLETLYLTINIIDRFLAVKTVPRRELQLVGISAMLMASKYEEIWPPEVNDFVCLSDRAYTHEHILTMEKTILNKLEWTLTVPTPLVFLVRFIKASVPDQELDNMAHFLSELGMMNYATLMYCPSMVAASAVLAARCTLNKAPFWNETLKLHTGYSQEQLMDCARLLVGFYSTLENGKLRVVYRKYSDPQKGAVAVLPPAKFLLPEGSASQHS

SEQ ID NO: 15171 - protein, 555 aa, Ehrlichia ruminantium str. Gardel
MKIDLNTIFPSSCKEYIPGKIYKNIKIGMRKVSFNNDTESILIYDTGGPHSDQDIQTNINNGIKKLRVNWITDRQDVEYYDRHTINTNSSTAFPLQNNKALKSKNDKPVTQMFYAKNNIITPEMEYVAIRENSLIQKLLSHTPNTIIPEITPELVRQEVAAGRAIIPANINHPESEPMIIGKNFLVKINANIGNSAVSSDINNEVYKMIYAIIYGADTVMDLSTGSHIHNTREWIIRNSPVPIGTVPIYQALNKVNGIVGELNFNIFKETLIEQAEQGVDYFTIHAGVLKKYIQYTTNRLTGIVSRGGAIIAQWCSIHNKENFLYTNFEEICDIMKSYDIAFSLGDGLRPGSIADANDKAQFLELKTLGELTDIAWKHDCQVMIEGPGHVPMHLIKENVEKQMYFCKEAPFYTLGPLTTDIAPGYDHITSAIGAAMIGWYGTSMLCYVTPKEHLGLPNLNDVKNGVITYKIAAHAADLAKGNPSAYIRDYALSYARFNFRWYDQFNLSLDPETAKSFHDESLPSEHAKSAHFCSMCGPKFCSMKLTHQLQLNSTE

SEQ ID NO: 15172 - protein, 295 aa, Triticum aestivum
  misc_feature (169)..(169): Xaa can be any naturally occurring amino acid
  misc_feature (177)..(177): Xaa can be any naturally occurring amino acid
  misc_feature (192)..(192): Xaa can be any naturally occurring amino acid
  misc_feature (213)..(213): Xaa can be any naturally occurring amino acid
MAGKEIYHKMKDKVKDAFSSSGPETGKGKTKLSGRRVKHGYHLVKGKSNHPMEDYLVAEYRQVGEHDLGLFAIFDGHLGHTVPDFLRAHLFDNILSEPEFLSDTKNAIRKAYLLTDEKILEKAAELGRGGSTAVTAILISSNDSVKLVVANIGDSRAVISKNGKADQLXSVDHEPSXERRNYWRKKRGFVSXNLPGNVAPNLMGQLAVARTFXGTGNLKKHLSSEPHVAEEVIDESSDFLILASDGLWKVMTNQEAVDEIKDIRDAQAAAKHLTEQAVNRKSKDDISCVVVNFHC

SEQ ID NO: 15173 - protein, 665 aa, Streptococcus pyogenes MGAS315
MKKPFYITTPIYYPSGKLHIGSAYTTIACDVLARYKRLMGHEVFYLTGLDEHGQKIQTKAKEAGITPQTYVDNMAKDVKALWQLLDISYDKFIRTTDDYHEEVVAAVFEKLLAQDDIYLGEYSGWYSVSDEEFFTESQLKEVFRDEDGQVIGGIAPSGHEVEWVSEESYFLRLSKYADRLVAFFKERPDFIQPDGRMNEMVKNFIEPGLEDLAVSRTTFTWGVPVPSDPKHVVYVWIDALLNYATALGYGQANHANFDKFWNGTVFHMVGKDILRFHSIYWPILLMMLDLPMPDRLIAHGWFVMKDGKMSKSKGNVVYPEMLVERFGLDPLRYYLMRSLPVGSDGTFTPEDYVGRINYELANDLGNLLNRTVAMINKYFDGTVPAYVDNGTAFDADLSQVIDAQLADYHKHMEAVDYPRALEAVWTIIARTNKYIDETAPWVLAKEDGDKAQLASVMAHLAASLRVVAHVIQPFMMETSAAIMAQLGLAPVSDLSTLALADFPANTKVVAKGTPIFPRLDMEAEIDYIKAQMGDSSAISQEKEWVPEEVALKSEKDVITFETFDAVEIRVAEVKEVSKVEGSEKLLRFRVDAGDGQDRQILSGIAKCYPNEQELVGKKLQIVANLKPRKMMKKYISQGMILSAEHGDQLTVLTVDSSVPNGSIIG

SEQ ID NO: 15174 - protein, 181 aa, Dendrobium grex Madame Thong-In
LCSVISFFLDGPWQGAAGVKQPYIRVVGMEQTREMNSNGPSSFTLDEELEYKEFAQRPDAYTKLCSMIAPSIYGHADVKKAIACLLFGGSKKRLPDGVRLRGDTHVLLLGDPSAAKSQFLKFVEKTAPIAVYTSGKGSSAAGLTASVIRDSSSREFYLEGGAMVLADSGVVCIDEFDKNEA

SEQ ID NO: 15175 - protein, 176 aa, Dendrobium grex Madame Thong-In
LPSLNAGGARLMKSTGTIGNRVASINVENAETNRRALRELLFCAPGALQYLSGVILFEETLYQKTAGGKPFVEVLNEGGVLPGIKVDKGTVELAGTNGETTTQGLDDLGKRCAKYYEAGARFAKWRAVLKIKSHSAFPAFYQSECLWTSSHAIICQENGLEAKHGHQKKRISLSII

SEQ ID NO: 15176 - protein, 844 aa, Geobacter sulfurreducens PCA
MVSLTIDGKDITVAKETTILDAAALLGITIPTLCWLKKVSPTGACRVCAVEIEGVDRPMTACNTPVKDGIKVTTQSEKLSRIRQKIMELMLVNHPLDCPVCDAGGECDLQNACYGLGAAKQEYGAVLERRKIRYDWPLIESDPNRCILCEKCVKVDHEIVGCNAIRVVNRGEATIIDTVDGNPLNCEFCGNCVAACPTGTLISKPFKFRGRPWAFTTTPSVCPFCATGCQIEYHSRNGRVERVTSDDSTYNSGNLCINGRFGYSYINSPDRLAEPMVKGQKADWNTAMGTAATALKQIVASHGADAVAGFGSPRVTNEDNYLFQKLMRSAIGTGNIDSEARLGFAATQKVLREMLGIAGASTTIDAIDRATAVLVVGCDLNAEATGMEYRVIKAATKNNAKLVLAAMRDIKLKKFANSHLKYRPGNETLLINALTKAVLEEGLENKEFCSANISNLSDLTAALAGVSIADAAAATGVTEADLRAAARLVGGKKGVAVIFGAELMRGGNTDAVKALINLALILGATAGDTGGLFPVYEKTNIRGLLDMGVAPDHFPGHQTDGTTFEKAWGKKLPAAAGKDLWQIIEGIEQGSVKALYLLGCDPVASFPEGERIRKALEKLELLIVQDPFPGEAAKMAHVVFPSSVAAEKNGTFTTIDGRVQPLAKAVAPSGDAREDWDILTELYNRLTGESRIHSPAAVLDEVAALVPAYASVGRTGGTITAQPRSGGLALAPVSARAVAGSPTTLLVGTILYHSGTTTTWSKNNLEIIPKGYIEIHPNDAAKLGIAEGGKVRLSAGSVKVEGTAKITPRVQPGLLFAPSHFRGMNVNALLSRDGGVVPVTVEKA

SEQ ID NO: 15177 - protein, 257 aa, Glycine max
DIYKFYKLVENESHPHDYIDSQPEINERMRAILVDWLIDVHTKFELSLETLYLTINIIDRFLAVKTVPRRELQLVGISAMLMASKYEEIWPPEVNDFVCLSDRAYTHEQILAMEKTILNKLEWTLTVPTPFVFLVRFIKAAVPDQELENMAHFMSELGMMNYATLMYCPSMVAASAVFAARCTLNKAPLWNETLKLHTGYSQEQLMDCARLLVGFHSTLGNGKLRVVYRKYSDPQKGAVAVLPPAKLLSEGSASQHS

SEQ ID NO: 15178 - protein, 1026 aa, Frankia sp. CcI3
MSSTPEILVEFAAGLPFGLDPFQFEAVAALAAGEGVLVAAPTGAGKTVVGEFAAHLALRTGTRCFYTTPIKALSNQKYADLVSRYGAVSVGLLTGDTSRNGDAPIVVMTTEVLRNMLYAGPVDNGRLDDLGYVVMDEVHYLADRQRGAVWEEVIIHLPAQVRLVSLSATVSNAEEFAEWLVTVRGHTRVIVSDHRPVPLWQHVLADRTLYDLFLEDTAGTPPPGGPEALRATLDGDLVRSRWNVGVEAGFEVAGTRRATIGDRDRGGDRDRGGDRDRGGDRDRGRGRGGNRNGERGRATQGGRGGDRGRNGGAGQAPVAAIPAARGGPTAVGGRVVNPDLLRLAREESRALSGGSPAVGRGRPAPGARRRTWVPGRPEVVERLDRDGLLPAIVFVFSRAGCDAAVTSCVRAGLRLVGPAEQQRIRTLVRERTAGIPETDLAVLGYWAWLEGLERGIASHHAGMLPTFKEIVEELFVQGLVRVVFATETLALGINMPARTVVLERLTKFNGESRVDITPGEYTQLTGRAGRRGIDVEGHAVVLWQPGLDPLALAGLASTRTYPLRSSFRPSYNMAVNLVGRLGRERARTVLESSFAQFQADRAVVGLARAVQRNTEAIDAKREALSCDKGDIGEYDRLRREIAEREAALSREGSARRRAESAAALARLRTGDIVRVPAGRRSGLAVVLDADAAANAADGPRPVVLTADRQVRRLSLTDFPIAVEPLGRVRVPRSFNPRSPQSRRDLASSLRAADVNPDAPPGRRARVRSAAADDAELARLRRALRAHPVHDCPRREEHLRSAEQVNRLVKETAAISRKVEGRTNTVAKTFDRVRAALEDLGYLDGDRVTAAGRVLARIYSEQDLLVAECLRAGIWDDLTPPALAAAVSTLVFEPRGDDAGVPALPGGAALRDCLAEMVRLSERLAEAEQAHRLAFLRPPELGFVAVAHDWAAGRTLERVLTDSSVELTAGDFVRWMRQLIDILDQIAQVAPMVQADPGTPDGARVRRTARAAMDAVRRGVVAYAMSV

SEQ ID NO: 15179 - protein, 439 aa, Methanosarcina mazei Go1
MVSDPDGGLNEKTEKNSEYNSQKASGQGTEKDIEPDDGTHASLYQESLAMHRRLGGVLEVASKVRLRTIHDLGVAYTPGVAEPCRKIRENRDLAYLYTLKKNTVAVVTDGSAVLGLGNIGPYAALPIMEGKAIIFKEFAGIDAFPICLGTQDTEEVIKAVKNMAPAFGGINLEDISAPRCFEIEARLREELEIPVLHDDQHGTAIVVFAGLLNALKIVKKDLAELKIVISGLGAAGVAILKFLVRAGANPAKILACDSQGIVYEGREKGMNTIKDEISRITNPERLKGELKEVFPGADLFIGVSVGGIVTGSMVRSMAKDAIVMAMANPVPEIMPEAAKRAGARIVATGRSDFPNQLNNCLSFPGIFKGALGTCARKITPEMEMAAAHALANVVTSGELSEDHIIPDPLDKHVVPAVAKAVASASLESCAARKRLEETF

SEQ ID NO: 15180 - protein, 254 aa, Bradyrhizobium japonicum USDA 110
MRLIASDLRSGVERLGDMIAEAKTIVPFTGAGISTECGIPDFRSPGGIWTRNRPIPFDGFVASQEARDESWRRRFAMEETFAAARPGRGHRALASLYRAGKVPAVITQNIDNLHQASGFAHEHVIELHGNTTYARCVGCGQTYQLDWVKRRFDQDGAPNCTVCDEPVKTATISFGQMMPEEEMQRATALSRACDLFIAIGSSLVVWPAAGFPMMAKRAGARLVIINREPTEQDDIADLVIRHDIGETLGPFVGN

SEQ ID NO: 15181 - protein, 341 aa, Daucus carota
APSMTTPEPASKRRVVLGEISNNSSAVSGNEDLLCREFEVPKCVAQKKRKRGVKEDVGVDFGEKFDDPQMCSAYVSDVYEYLKQMEMETKRRPMMNYIEQVQKDVTSNMRGVLVDWLVEVSLEYKLLPETLYLAISYVDRYLSVNVLNRQKLQLLGVSSFLIASKYEEIKPKNVADFVDITDNTYSQQEVVKMEADLLKTLKFEMGSPTVKTFLGFIRAVQENPDVPKLKFEFLANYLAELSLLDYGCLEFVPSLIAASVTFLARFTIRPNVNPWSIALQKCSGYKSKDLKECVLLLHDLQMGRRGGSLSAVRDKYKKHKFKCVSTLSPAPEIPESIFNDV

SEQ ID NO: 15182 - protein, 675 aa, Gibberella zeae PH-1
MADQINMGGLSLNEGGHQGPPQGRSYIPPHMRGRGGPPPAGPQAGGPPVMNGGPPAAAPGPNGIGNSAWANQNYGARQNNWSNDVPTYQGNNNRRGGWGGRGGGYSGGGNFDGHSGGGGAPTARGSGDGQWRDGKHIPGPANPRVERELFGVTAEDPSKQHTGINFEKYDDIPVEASGTDVPEPVHQFTTPPLDEHLCRNIELAHYKVPTPVQKYSIPIVSGGRDLMACAQTGSGKTGGFLFPILSQAFINGPSAVPANAAGQFGRQRKAYPTSLILAPTRELVSQIFDESRKFAYRSWVRPCVVYGGADIGSQLRQIERGCDLLVATPGRLVDLIERGRISLQNIKYLVLDEADRMLDMGFEPQIRRIVEGEDMPQVQDRQTLMFSATFPRDIQMLARDFLKDYIFLSVGRVGSTSENITQKVEYVEDVDKRSVLLDILHSHANGLTLIFVETKRMADSLSDFLINQNFPATSIHGDRTQRERERALEFFRNGRCPILVATAVAARGLDIPHVTHVINYDLPTDVDDYVHRIGRTGRAGNTGIATAFFNRGNRGIVRELMDLLKEANQEVPAFLETIARESSFGGGGRGGRSRGGGGRGGATRDFRKFGGGGFGGNNNGGGGGFNNAGSQGAGFSAGGGGGAGYGGGAGYGGGAGYGGGGYGNPSGPGAQSSWW

SEQ ID NO: 15183 - protein, 154 aa, Bradyrhizobium japonicum USDA 110
MQHNDYTVGKGDRGAGITDQFPIGVSILSLRFPPTATLTHRNRTKRRKGPDHPMTARIFKPAKNAMQSGRSKTREWQLDYEPEQPRAVEPLMGWTSSGDMKQQITLRFDSKEEAVAYCERKGIAYQVIEPQDSIRRPVAYADNFSFRRGEPWTH

SEQ ID NO: 15184 - protein, 428 aa, Methanosarcina acetivorans C2A
MTIVEDAKKGIITEEMKIVAKDEGLDPEFIRRGIAAGRIVIPTSPYRQVKICGLGEGLRTKVNASIGVSSDIVDVNMEVQKAIAAEKAGADTLMELGTGGDFLGIRKKVIDSISLSVGSVPLYQAFIEAARKYGSIVHMTEDELFNATEAQAKLGTNFMAIHTGINNITLDRLKAHGRYGGLCSRGGAFMSSWMLHNEKENPLYANFDYLVEILKEHEVVLSTGNGMRAGAVHDATDRAQIQELIINSEVAEKAHQQGLQVIVEGPGHVPLDQIATNVKLMKEMSGHKPFYMLGPLVTDIAPGYDHIVTAIGASVSASYGCDFLCYVTPAEHLALPNLEDVITGVKTSRIAAHVGDMIKYPERARQWDLDMGRARRELDWEKMYSLAIDPEHARAVRNSRAPEDTDACTMCGNFCALKIVNQNYNLAK

SEQ ID NO: 15185 - protein, 666 aa, Kineococcus radiotolerans SRS30216
MTRIDWGVNPARDRAAHPDTPVPRAVETPEERIENFMPLSTREDLRNVAIVAHVDHGKTTLVDAMLWQSGAFRANADVNERVMDSGDLEREKGITILAKNTSVHYTGPGSPEGGMTINIIDTPGHADFGGEVERGLSMVDGVVLLVDASEGPLPQTRFVLRKALAAGMPVVILVNKVDRPDARIAAVVEETYDLLLDLAADVEGIDADKLLEVPVVYASAKNGRASLNQPEDGGLPDHEDLVPLFQTILDTIPAPVYDPETPLQAHVTNLDASPFLGRLALLRIFSGELIKGQQVAWCKHDGTIERVKITELLVTEAVTRVPGEKAGPGDIVAVAGIEGITIGETLADPDDPRPLPLITVDEPAISMVIGTNTSPLAGRVKGSKVTARLVKDRLESELVGNVSIRVLPTERPDAWEVQGRGELALAILVEQMRREGYELTVGKPQVVLRKDENGKTLEPFENLTIDAPEEYLGAITQLLAARKGRMETMTNHGTGWVRMEFYVPSRGLIGFRTQFLTDTRGTGIAHALFAQYDHWAGEIRTRQSGSLVADRAGAATAFAMTNLQERGQMFIEPTSEVYEGMIVGENSRADDMDVNITKEKKLTNMRSSTSDEFERLIPPRHLSLEQCLEFCREDECVEVTPESVRIRKVVLEANARAKTASKAKKG

SEQ ID NO: 15186 - protein, 185 aa, Triticum aestivum
  misc_feature (2)..(2): Xaa can be any naturally occurring amino acid
  misc_feature (10)..(10): Xaa can be any naturally occurring amino acid
QXGSRLVAAXYVLYSSATIFCISFGAGTHGFTLDRSTGEFVLTHPSMQIPPRGQIYSVNDARYFDWPEGLKKYIDTIRQGKGQHPKKYSARYVCSLVADFHRTIIYGGVAMNPRDHLRLVYEANPLSFLAEQAGGRGSDGKTRILSIQPVKLHQRLPLFLGSMEDMLELESYGDVQQKVNPGYDV

SEQ ID NO: 15187 - protein, 585 aa, Magnetospirillum magnetotacticum MS-1
MCGIAGLMTPGGPPDETVLDKLADALAHRGPDGRGRHVQGNVGLVQNRLSIIDLEGGRQPILDGQGNAIVANGEVYNYLELKSDMAGQAFATGSDCEPPLHLYRHQGPAFARSLRGMYALAIHDGKAEKLILCRDPFGIKPLYLAEGSPGLAFASEPQALLAAGLVKPELDPVALAELLQLQFTTGTRTIFKGIRRLAPGETVVAEEGCVAESRRLPALPAGGPNEGGLDQLLDQLDDTLTESVELHQRSDVPYGMFLSGGIDSSVVLALMARLNPRGILAFTAGFPGTKVHDEREHARDLARAVGARHVEVEFTQSDFWALLPQVAAAMDDPAADYACLPTFKLAQEARKEVKVILSGEGGDELFGGYGRYRHAMRPWPLTKSMRRKGTFDGLDVLRDGILSHWRHGMKLAERVEAMPGRTRLQVAQAVDCADWLPNDLLAKADRCLMANGIEGRVPFLDPVVAAFAFRLPDHLKVRKGLGKWILRRWLETALPASRPFEKKRGFTVPVAEWIAARPEIGHLVAHQPGIEEICHPGKVKRLFKDCTKDTGFACWTLLFYALWHQRHVLGKIPDGDAFSALAERI

SEQ ID NO: 15188 - protein, 1441 aa, Coprinopsis cinerea okayama7#130
MPSRSTYEVGRDRNVAPGRSLREGDWGTSGSHDRYGYDLYPPEHDAYDDPLRRDAGAWGGGNDGYSSRGAHHYGSSSHYKPPVDPYMEPNPYLPRSPTHFTERSPLGYDDPQSYYYEQWRGRDPRPSPSDEKMDYNQIDKRGAQGWRRSSGGGKGGQPKFQSDSGWSGRKKSKEWGNSNQQRYDEKQPEPLYSSVEDRSWEPADSWKSSNRHEGGASTSKHQQHHTPGRPGTQQQSKSSRKEKKSGKQKKEWKNEDLNLNKFGFKEETSPVSLKVPVARLFALAPFILPLEVLLSRGKAKAERIQPNASHRSPSPYERPRAVHRLPTANSSALHTAPATGKSKKAGKQRNGHKNARGSTGKQPARYPEDDVAADSLSMPPPPPPSRPKQSRQQTPDWRDEHTPLLNPNPNGLPPKPISLPEKPTRIVPQRNAGFKPIGQSNSALKMFFPGDEDEADYISSSNLTKDARTEPTPTKGFTRQTLLDDTRNGREAENPHQYGNDPPPISRPPASWDPYASTYPVDPRVPTQSYTNGLTPHLPEPPPHIPHRTGQTQSYWKSPAVSPPPESDASRWSGVPVPPVHPNLPPTYTASVPPRPGYELPYRPPVPVDNAPVSHTTKSTPQPSPIPISDPSPAWQASASASGVATPVAPEQPESKDLYVILNQVGEGTFGKVYKARNTVAKVHVALKRIRMETERDGFPVTAMREIKLLQSLKHPNVVQLYEMMVSNGSVFMVFEYMDHDLTGILSQTQFKFSDSHLKSLCHQMLAGLAYLHHKGVIHRDIKGSNILLNNRGELKLADFGLARFYQKRRRTDYTNRVITLWYRPPELLFGATVYGPEVDMWSAGCIMLELFTKKPVFQGNDEINQLHVIFKILGTPTTERWTGLNNLPWFELIKPKESLPNRFRDLFQKWMSPAALDLAERLLTYDPELRVSAQEAMEAPYFTQERPFAERPAGALYDYLVTEAGIERTDKNNVVKGDLGLYRQTDSPAKHKKAKANLELANKYFKLRYEELFQLIREEELKFKTVVTELEDIRAGKWDDRIKAQLTGMSEPPPPQGEDSQRKEETLAQEASVASSSKPAPPTEATEAVDEDATEPDADLAQRVLPSTSPSLMAEKQEEEEEEEAEPDREEDEEGDKLDETPDKGDHIVQESEEKENEVEMEETEGLLDASSEKDDNVEAEAQAEAETEAEQPKEAEIEDDESSGEEPPQTVRRSTRRKGSISAAPPVSARTRTRRRQVQDHEASPPPESEAANETEGAAADTPRTEDNIPSSPFEPASSRTREGKRKASFVEAMENAGRESKRLREDSESRGSRSGARSEEQVALKRFQNVIGLVHSQISQHRNGTIFHNPIKHSEAPDYHDIVKKPMDLKTIKARVKDGLVSNSLEFQRDIYLMFANAMMYNRPGSDVHTMAEDMMFDAEKQIQSFRQTEGLVRGVHR

SEQ ID NO: 15189 - protein, 196 aa, Escherichia coli W3110
MSASALVCLAPGSEETEAVTTIDLLVRGGIKVTTASVASDGNLAITCSRGVKLLADAPLVEVADGEYDVIVLPGGIKGAECFRDSTLLVETVKQFHRSGRIVAAICAAPATVLVPHDIFPIGNMTGFPTLKDKIPAEQWLDKRVVWDARVKLLTSQGPGTAIDFGLKIIDLLVGREKAHEVASQLVMAAGIYNYYE

SEQ ID NO: 15190 - protein, 565 aa, Aspergillus nidulans FGSC A4
MSRRPNPAQAAQNQQTIKALLKLEPNKVCADCKRNKHPRWASWNLGIFICIRCSGIHRGMGTHISRVKSVDLDAWTDEQLQSVVRWGNARANKYWEAKLAPGHVPPEAKIENFIRTKYESKRWVMDGPMPDPSTLDAGDDDVPLAVVQEKAKIERSASQRVAPARQPAVQHRPQASIDLFDDDGVAPPVRPSTTEPSIRAPPKQPQAAPKPTRPGDSLLGLDFFGSAQPAANSRPASVASTPAGGMSRPDLKQSILSLYSKPQPTAHERTSSFGDLASPPPQSTSSSNLGGLTDAFSGLSFPTSPPAQRPAEKPSPFAGLTSFANSKSAPAAPKVTSPTASIGSTGGGLFDSLTSPTAPSAKPQSRTTSISSNSNDFGFSSFQSPPPPKANPPSASLSNDLFGLSSPPISAAPIPPPARSPPPVAAPQPDISSAFNLSQPAPKPVAPPQPLTTTTSIPTLSAAAIDPWGSNAWSTPEPAAPAAPQPSSMMKLPDTLTANDVGAGWGAPSAAASKPTPPTVAEDEDFGGWASAAPISSTSTTNVNAPPKPAGGFSGSDDLFSNVWE

SEQ ID NO: 15191 - protein, 801 aa, Staphylococcus carnosus
MSKQRLVMIGNGMAGVRTIEEIIDRDPDKFDITIIGKEPYPNYNRIMLSNILQKKMTVEETIMNPYSWYEENGIALITGEKATRVNREKHIVETEKGREIPYDICIFATGSKAFVLPIPGHELPSVIGWRTIEDTERMIEIAQDKKEATVIGGGLLGLECARGLLDQGMNVTVVHLAEWLMEMQLDRQAGDMLREDLEKQGMKFELGANTKEIIGNQDVEAIRLADGRDLPADLVVMAVGIKPFTQEAIDSGIDVERGIVVDDFMRTSDPEIYAVGECAQHNCKVYGLVAPLYEQGKVLADHLTGRPTEGYQGSTTFTSLKVSGCDLYSAGQIQEDDEVEGVEIYNSHDHVYKKIFLKEERVVGAVLYGDTDDGTRFFNMMKKREPIEDYTLVSLLQKVGEEAVSTVADMDDSETICGCNGVSKGKIVSAIVEDGLTSVAEVTKATKAGNSCGKCKPQIGELLEHTLGGAFVASKPAGICDCTELTRDQIVTQIRAKGLKTSKEVRHVLDWKNKGGCPKCRPAINYYLNMVYPHEHEDEKASRFANERYHANIQNDGTFSVIPQMRGGVTNPDQLIRLGEVAKKYDVPLVKVTGSQRIGLYGISKEDLPKVWKDLGMRSASAYAKKTRSVKSCVGKEFCRFGTQYTTRLGIRLEETFEYIDTPHKFKMGVSGCPRSCVESGVKDFGVIGVENGFQIYIGGNGGTEVTKGQFLTTVETEEDVIQLCGAYMQYYRETGIYAERTAPWLERMGFENVKEYVLDPERQKALYDRIMDAKRAVAEEPWSEIVNDQADQKIFKVEKV

SEQ ID NO: 15192 - protein, 71 aa, Glycine max
  misc_feature (52)..(52): Xaa can be any naturally occurring amino acid
TEEFNTEPLSVLMMSVNNNTQVLINCGNNTKLLCHVRAFDRHCNMVLENVRXMWTDVPNTVIGKKKAQPFN

SEQ ID NO: 15193 - protein, 473 aa, Bacillus anthracis str. Sterne
MRKKVVIIGGGITGLTTMYHLQKDIRDKNLPIDTLLIEASGKLGGKIQTVRKDGFTIERGPDSFLARKESAARLVKELGLGDELVNNQAGQSFILVNNRLHKMPSGSMMGIPTQITPFLFSGLFSPIGKLRAGFDLLMPRSKPVSDQSLGHFFRHRLGNEVVENLIEPLLSGIYAGDIDEMSLMSTFPQMYQIEQKHRSISLGMRTLAPKAEKAEPKKGIFQTVKTGLESIVESLELKMHEGTIIKGTRIEKVAKQGDGYAITLSNGKEIEADAVVVASSHKVLPSMFAQYKQFRFFRNIPSTSVANVAMAFPKSAIQRDIDGTGFVVSRNSDYTITACTWTHKKWPHTTPEGKTLLRCYVGRPGDEAVVEQTEEELVQLVLEDLRKTMDITEDPEFTVVSRWKEAMPQYTVGHNERMKKLTTFMEKELPGIYLAGSSYAGSGLPDCIDQGEKAAKRVLSHLEKVMNTELIAQ

SEQ ID NO: 15194 - protein, 462 aa, Pseudomonas aeruginosa UCBPP-PA14
MNQRPGTALPSSPVSSFQRWRLQIFAITWLAYAAFYFTRKAFSVAKLGIAEDPGFQLDKMAMADLDAIYLAAYAVGQFTWGVLADRFGPRIVVFGGLLISALAALVMGTFATLPIFATCMVVQGLAQSTGWSGLCKNIGSFFATHERGRVLGLWSTCYAFGGLVASPFAGWWAYSVFGTWHAAFYSSAAVVGGVALLFLLLQRNRPEDVGHPPVEPQVASEAVRYAGFRPEGGNGGNGGNGGNGGSLQVLAKVVRNRTVLCLGLAYFLLKPARYAILLWGPVIVYERMPALGKVGAAIVPTAFEVAGLLGPILIGFASDKLFGARRMPACVISLLALTVCLALFVPAMTTGSIPIVVGLLFMMGLTLYGPDSMICGSAAIDFGTGEAAGTASGFVNGCGSVGAILGGLLPGYFDTYTVFIGFTVAALIATAVLLPHWNSRPDGVVKGHRNIPSLGDFRPIRS

SEQ ID NO: 15195 - protein, 484 aa, Oryza sativa (japonica cultivar-group)
MADHQPAASSPKRKKKHSKKPEDSNATVDDSLAAAASPSPKKKEKHSKKKREAIDATMAAASPKKKEKKHSKKQEDTNVPEKKREVVHVTVDASLTGAAAAGAAPVVAYFPTGYDPLAAGGGRKGREAPRTRLFRHTKHPSRIELVVGAATGGGGGPDFVGRSYAGEAVLPQLTGYALGVLDKASGTLKVVPIAANKKLAHSQHSGAVGEAVSSAGDADLKVQDITKAFGTQKDKAKDIKWQSLNEQRNDPSAFMDLDLGNADTSVGANESQEPTVRNIPPYDPAADTSERAYLFDEIIPKSIRPHLVDIIGHFESGEISSKGYGSFVSNRVNKLQELQGEDKERLAWILSYITHLLSLLARNSSMSKRHRKENQATSGPVIPQYVYRKMVLMFTEPGSSALSTEKHELLINYILVLTLYADDFRSDPKDICEDLKMTRQMIKPYYDQLGCKSSSAGAFKSSVMTLPAPLKFPKEATRRKRRRF

SEQ ID NO: 15196 - protein, 517 aa, Vibrio vulnificus CMCP6
MTKNIHDQRILILDFGSQYTQLVARRVREIGVYCELWSWDVEEADIREFNPDGIILSGGPESVTEDNSPRAPQYVFDSGVPVLGVCYGMQTMAEQLGGKVSTSDEREFGYAAVKVSGESAIFKDLEATQDVWMSHGDKVVEIPAGFTKVGETDTCPYAAMANEEKKYYGVQFHPEVTHTKNGLQMLENFVLGICGCERLWTSESIIEDAVARIKEQVGDDEVILGLSGGVDSSVVAMLVHRAIGDKLTCVFVDNGLLRLNEGQQVMDMFGDKFGLNIIKVDAEERFLKALEGKSDPEEKRKTIGHVFVDVFDEESKKLKNAKWLAQGTIYPDVIESAASKTGKAHVIKSHHNVGGLPDDMEMGLVEPLRELFKDEVRKIGLELGLPYEMLYRHPFPGPGLGVRVLGEIKKEYCDLLRRADAIFIEELHAADLYNKVSQAFTVFLPVRSVGVMGDGRKYDWVVSLRAVETIDFMTAHWAHLPYDFLGKVSNRIINEVNGISRVVYDISGKPPATIEWE

SEQ ID NO: 15197 - protein, 442 aa, Arabidopsis thaliana
MSSSSRNLSQENPIPRPNLAKTRTSLRDVGNRRAPLGDITNQKNGSRNPSPSSTLVNCSNKIGQSKKAPKPALSRNWNLGILDSGLPPKPNAKSNIIVPYEDTELLQSDDSLLCSSPALSLDASPTQSDPSISTHDSLTNHVVDYMVESTTDDGNDDDDDEIVNIDSDLMDPQLCASFACDIYEHLRVSEVNKRPALDYMERTQSSINASMRSILIDWLVEVAEEYRLSPETLYLAVNYVDRYLTGNAINKQNLQLLGVTCMMIAAKYEEVCVPQVEDFCYITDNTYLRNELLEMESSVLNYLKFELTTPTAKCFLRRFLRAAQGRKEVPSLLSECLACYLTELSLLDYAMLRYAPSLVAASAVFLAQYTLHPSRKPWNATLEHYTSYRAKHMEACVKNLLQLCNEKLSSDVVAIRKKYSQHKYKFAAKKLCPTSLPQELFL

SEQ ID NO: 15198 - protein, 552 aa, Prochlorococcus marinus str. MIT 9303
MTSSAQTGPTQRQVHLNTPFNDQKPGTSGLRKSSKQFEQTNYLESFIEAIFQTLPGVEGGTLILGGDGRYGNQRAIDVILRMGAAHGLSRVITTTNGILSTPAASHLIRANKAIGGIILSASHNQGGPDGDFGVKVNGANGGPAAESLTNAIYACSQALERYSLVDADVIPLETPGHHAIGAMAVDVIDGVEDYVELMQKLFDFGRIKDLIKTDFPVVFDAMHAVTGPYAKRLLEGLLGAPTGSVRNGVPLEDFGGGHPDPNLTYAAELANLLLNGKAYSFGAACDGDGDRNMILGRGCFVNPSDSLAILAANANVAPAYADGLSGVARSMPTSAAVDVVAKELNIDCFETPTGWKFFGNLLDAGRITLCGEESFGTGSNHVREKDGLWAVLFWLQILAERRCNVADVMTQHWSRFGRHYYSRHDYEAIASENAHGLYDRLESMLPRLIGQPFAGRQVSQADNFRYSDPVDGSETQSQGLRILLEDGSRVVVRLSGTGTKGATLRVYLERYEPSHGNLNQDPQHALADLINGIDALAEIQKRTGMQRPTVIT

SEQ ID NO: 15199 - protein, 337 aa, Pseudomonas syringae pv. tomato str. DC3000
MTLQYVPIINLAPYFSGEPDGKAAVAQAVNQACKDIGFLVITEHQIPTELIERVSRLTRQFFDLPLAEKRKVDRPSPEMVRGYSAVAEESLSYSLEESAPGDLKESFSIGPSDVPNEDYYHNAEAGPHFAPNVWPADERVPGFQEAYRAYFDAMSQLAQSLMRLFALALELDEYFFDDRIDRHISMFRSLSYPDIKTEVEAGQLRASAHTDYGSLTIVRPDNALGGLQVRNQQGEWVDVPYVENGFVVNIGDLMMQWTNDQWISTLHRVVNPPMASEQDNRRQSLVFFHQPNYDTLIECLPGCLLPDATPRHAPVTSGDHLLAKFVKQTTFGGSKVA

SEQ ID NO: 15200 - protein, 441 aa, Kineococcus radiotolerans SRS30216
MLGTVDGGGYGRDMADSVTLKHAGGELDLPVTPATEGAAGFGIGSLLKETGLVTLDSGFTNTASCTSAVTYIDGDAGVLRYRGYPIEQLAEKSTFVETSYLLIYGHLPSAAELSAFTERIQRHTLLHEDLKRFFDGFPRDAHPMPVLSSAVSALSTFYPNSLNPFDEEQVELSTIRLLAKLPTIAAYAHRKSLGQPLLYPDNRLGLVENFTRLAFGNPAEDYEIDPVMVKALDQLLVLHADHEQNCSTSTVRLVGSGQANLFASVSAGIHALSGPLHGGANSAVLDMLEAIRNSDDDVDTFMTKVKNKEKGVRLMGFGHRVYKNYDPRAAIVKKTADQILSGLGKRDELLDIAMRLEEIALHDDYFVERKLYPNVDFYTGLIYKAMGFPTKMFTVLFALGRLPGWIAQWREMINDPATKIGRPRQVYIGEGARDYTEIGAR

SEQ ID NO: 15201 - protein, 379 aa, Rickettsia prowazekii str. Madrid E
MARKLIYKSFIDHCKGEKSADAIISEHKQNVEKHSTNTCNVSLPFLHFDNNPIAAASISQVHKAQLITGGYVALKILRPDIRKKYNRDIKLLYFFAKIISKFSKAKRLKPITVIDKFHETMRFELDLRLEAAAASELKDNMRHDINVIIPKIYWDLTSENILTTEWLDGTSIYDISLLKEMNLEPKKIAQDFAVMFFNQAYRDGFFHADLHAGNILVNNQGKIILLDFGIMGRLKEKDRLSVAEILFAFLKRDYKLVAKVHLRAGYIPANTDLDLFAGSCRAVTEPIVGTPTKNISIGKLLTHLFKITEDFGMEVQPDLLILQKTLIMVEGIGRQLDSNVNMWQLAEPWIKKWAVKNLSPEAKLLRLIKHYLNSVNDIT

SEQ ID NO: 15202 - protein, 384 aa, Oryza sativa (japonica cultivar-group)
MQSRHRVFAEDLLLPREAEGEDHFDRVPDSLVLLIFNRLADARSLGRCSAVSKRFNSLVPLVDDACLRIDRVITDAADADDALGLAGPRPAGRGVLSHLLKAMLLAVLKPFGHCDAGVRGGGGGERAGKHGGGGGGCGAQQHHSPAQVLKNFSSIRNLRMELPVSDVGTDDGVLLRWKAVFGSTLQSCVILGGTRVDRAAAPAAAAATATAAGDSEASQGDDTGSIPESFYTNGGLKLRVVWTISSLIAAATRHYLLREIVKEHPTLERVALTDAHGQGTLSMGRDQIREFRDKPLAAAAAANRTQVPACNMKLRYAPMLELSDGTRIQGATLVVIKPVGEAGGIGGGRKELDEFVADAFDGPYREAVSALSKRRTYLLEMNGF

SEQ ID NO: 15203 - protein, 340 aa, Methylococcus capsulatus str. Bath
MHKITLIPGDGIGPSIVDAAVKVIEATGVQVQWDTQSAGMAAVEKFGTPLPDATLDSIRANRICFKGPLTTPVGGGYRSVNVTLRQAFNLYANVRPAISFEGTDTAFSDVNLVTVRENTEGLYAGIEHFIKVDEEKIAAESIAVVTRKGSERIIRYAFDYARRARRKKVTLVHKANILKCTSGLFLEIGREIAKEYPDIEFDDRIVDACSMQMVMQPQRFDVLVTTNLFGDILSDLAAGLIGGLGLTAGANIGTDAALFEAVHGSAPDIADKGIANPTAMIMAGAMMLEHIGEPDAARRIERAVREVIEDGRSVTPDLAKDSPCGTAQMAEAIVERVRQA

SEQ ID NO: 15204 - protein, 1089 aa, Dehalococcoides sp. CBDB1
MRKQKGICEVMNKPKKVLIIGSGPIIIGQAAEFDYAGTQACKAMREEGVESILVNSNPATIMTDENVADRVYIEPLTVESITKIIEKERPDGLLPTLGGQTGLNLAVDLADAGVLAKYNVRSLGTPINTIRTAEDRELFKELLTKIGEPVPPSETVTTAEDALRVAHMIGLPVVIRPAYTLGGTGGGFAHNWDEVEEVAQTGLNASPIHQILVEKSVAGWKEIEYEVMRDGADNCITICNMENFDPMGVHTGDSIVVVPVQTLTNKESQMLRTASIKIIRALGIEGGCNVQLSLNPNGNEYYVIEVNPRVSRSSALASKATGYPIARVASKIAIGKRLDEIPNTVTGKTLACFEPAVDYIVAKIPRFPFDKFALGDRGLGTQMKATGEVMAIDRSFEAAIHKSIRSLEFGKKTVLWEDRSWIMGDDLSTYPLHAHDTRLWTILAALRRGHTPEAIHEKTMVDNWFLYKLKNITDMEKRLLKENLTPLLMLEAKQMGFSDEEIATLSGKLAEQVRQTRLEWNIKPVFKMVDTCAAEFDAATPYFYSTYEDENEAIPQNVKKAVVIGSGPIRIGQGIEFDYCSVHAAWALEKAGLQSIMINSNPETVSTDFDTSNRLYFEALDEESVRDILENENISAPESTPSIVQFGGQTAINLAAPLTRSSNPIIGSSAEAIDLAEDRRRFERLLSEMGIPQAPGAGITSLDEALSIADSIGYPVVVRPSYVLGGRAMEIVSDASDLVRYMSAAIELNTGHPILIDKYLVGKEVEVDAIADGETVFIPGVMEHIERAGVHSGDSMAVYPTQNLNEHDLATITDYTIRIGKALNVRGLMNIQFVVSKDPEGGDNIVYVLEVNPRGSRTVPFLSKVTGVPMVDIAVNVMLGKTINEQGYQNGIMPNTDLVAIKAPVFSMAKLVGVDTYLGPEMKSTGEVMGVDHTFNKALVKTLQAASIMLPETGTLLFSIADRDKAEALPLIRTLHGLGYNFYATEGTAAMITAAGITVKQISKKLDEGHPNIVDIIRNGTVCGVINTMTGGRVPLRDGFYIRRAAAERKVPCFTSMDTAKAAVEALANGNRQITVLPLNEYRQGKSGS

SEQ ID NO: 15205 - protein, 272 aa, Thermococcus kodakarensis KOD1
MADAETRLYGVIGFPARHSLSPVMHNAAFRALGINAVYLAFEVPPEELGEAIGGAKALGISGLNVTMPHKEAVIHFLDSLSEDSGEIGSVNTVVNRKGRLEGHTTDGLGARRALERAIELGGRRILIIGAGGAGKAIAYELSRDNEVVVLNRTPEKAKALERFGITGDALNRENLGEYLEWAEVLINATSVGMNSWETPVPAELLRRDLVVMDIVYKPLKTRLLTEAELRGCKTVDGLWMLVYQGIESFRLWTGFKPDEGLMRGAALEGISE

SEQ ID NO: 15206 - protein, 508 aa, Rickettsia prowazekii str. Madrid E
MKNTYYITTPIYYVNDVAHIGHAYTSVASDVIARFMRFCGKDVMFLTGTDEHGQKVEKAAINQNIDPQTFTDKTSQNFRDLMVAMNISNDDFIRTTENRHKKAVAVFWKKLLDNGAIYEGFYEGWYSVRDEAFYDESEINEDKLAPTGAPVEWVKEPSYFFNLAKWQDKLLEFYELNPDFVRPISRRNEVISFIKSGLKDLSISRTTFHWGIKVPNNRKHVIYVWLDALVNYISALGYPDKQSNYAKFWPANLQIVGKDILRFHAVYWPAFLMAAEIPLPKAIMVHGWWTNEGQKISKSLGNTIDPITLIDEFGVDQVRYFLMREVIFGADANFARNNLITRINSELSNKIGNLLHRIVSFVYKNNDAKVPLIKSGVIDKIYELPILKTAIKFAQENILLMDKTEINKILENIINLAEDANIYITNEAPWNLKTTDPDKMLEVLYSLLEVLRYIAIMLQPFVPNSANKMLDQLGVSKEERLFKHLVRDHALKAGSNILEPSIIFPKFN

SEQ ID NO: 15207 - protein, 570 aa, Debaryomyces hansenii CBS767
MSDRYRPPSGPRSTRGYEDRRNPNPTSSNNNNSNSNNRNYKSSYGQRDTYTPSGPKRYQERDNYRPNSSANERSESYQPSKFRPSGPSGYRGNDRDFHFRPGSKRPHPSESKGYRGGDDYRKRQDRTDFNGPAPGPSSYRDKSSTYRNPRYDNNSYKPKVNLKNLPKGPRSGNVNDSRAKPRPYLKDEEAAPPIKLSKSQIYLIRITRPSEIYKRVQQVGEGTYGKVYKATNSITDEYVALKKLRLESEREGFPITAMREIKLLQSFDHENVVGLLEMMVEHNQIYMIFDYMDHDLTGLLTHPDLKLTESHRKFIFKQLMEGLQYLHKKRVIHRDIKGSNILLDNIGRLKIADFGLARTMNVLNDGEIPDYTNRVITIWYRPPELLLGSTDYGREVDIWGVGCLLIELYSKIAAFQGFDEIGQLYKIFNVMGTPNIENWPDMENLPWFEMLKPKINKASTFKNEYESIMSEQSFDLAVKLLTLNPKKRLTAREALEHPYFTEDPKPEPLHFLKDVKGEWHEFETKKRRRKERKRLQDAKNASSQNIAQLNNGPSMDSVPDSVVPPDGPKD

SEQ ID NO: 15208 - protein, 416 aa, Cryptococcus neoformans var. neoformans JEC21
MPTSLPLESKQPPKPEVFEAKSNLGFMLHSPLKTSFEEQSVPEIGPDEVLVEIKKTGICGSDVHFYNTGKMGLAALTESMCLGHESSGIVVQLGSNIVQQAARSNVMATARGEAEESNKGTVSNRPLQVGDKVALEPGVTCRMCVDCKGGKYQICEHMIFAAYPPSTGGTLQRYYALPADLVYPLPDNVDLSFGAMMEPLSVATHAVANIGGMRTGWNVLITGAGPVGLLAMAVAKGLGAGKVIAVDINEERLHFAKQYAATDTYIPIPPNEGESRGDHAVRAAEDLLRSTGTPARGPGSIDLVVDATGAETCVLMGLNAIKPGGIYVQIGFGPPNVSVPMFRIVTNEITIRGAWRYGSGDYPLAIDMVARGLVNLKPLLTHTFKFEDALEAFEITKNGRDKNGKGVIKCVIDGPE

SEQ ID NO: 15209 - protein, 244 aa, Streptococcus pyogenes MGAS315
MEIKGKNIFITGSTRGIGLAMAHQFASLGANIVLNGRSAISEELVASFTDYGVTVVTISGDVSEASEAKRMVNEAIESLGSIDVLVNNAGITNDKLMLKMTEEDFERVLKINLTGAFNMTQSVLKPMIKARQGAIINVSSVVGLTGNIGQANYAASKAGMIGFTKSVAREVAARNICVNAIAPGFIESDMTGVLPEKMQEQILSQIPIKRIGKAQEVAHLASFLVEQDYITGQVIAIDGGMTMQ

SEQ ID NO: 15210 - protein, 284 aa, Mycobacterium abscessus
MRLLPFGGAPGRTHRADAVVTGAGSGIGRAFAVELARRGGRVVCADRDPVTAKESAELVRQAGGEGFDIACDVTDLEQIRNLADVSEDWFGKAASLVINNAGIGAGGNRIGATSIEDWKAAISVNLWGVIYGCETFVPRLRSSGHGGVINVASAASFGSAPRMAAYNVSKAGVLALSETLAAELSGTDVKVTVLCPTFVKTNIVKNPQIDEAAARLAANLMKWTGISPQHVARTTLNAHDRGQIYVVPQLDAKVLWQLKRALPGPFTRTLGLVERMASWNDSAE

SEQ ID NO: 15211 - protein, 288 aa, Bacillus cereus G9241
MTRVAINGFGRIGRMVFRQAIKESAFEIVAINASYPSETLAHLIKYDTVHGKFDGTVEAFEDHLLVDGKMIRLLNNRDPKELPWTDLGVEVVIEATGKFNSKEKAILHVEAGAKKVILTAPGKNEDVTIVVGVNEDQLDITKHTVISNASCTTNCLAPVVKVLDEQFGIENGLMTTVHAYTNDQKNIDNPHKDLRRARACGQSIIPTTTGAAKALAKVLPHLNGKLHGMALRVPTPNVSLVDLVVDVKRDVTVEAINEAFKTVANGTLKGIVEFSEEPLVSIDFNTNT

SEQ ID NO: 15212 - protein, 389 aa, Methanosarcina mazei Go1
MTFPMYSDRINALPPYLFAAIDEARDELIAKGVDVIDLGVGDPDLPTHPHIVEAMQKAVCDPGTHQYPSYAGMPEFRKAAAEWCRKYKGIEIDPATEVLSLIGSKEAVAHIPLAFVNPGDVVLYTEPGYPVYKIGTLFAGGEPYPLPLKAENSFLPDLDSIPEDVLKKSRLFFFNYPNNPTAATADMAFFEKVVKFCKKHDIIAVHDNAYCQMAYDGYEAPSFLAAEGAMDIGMELYSHSKTYNMTGWRLGFAVGNKDLIKGLGKVKSNVDSGVFDAIQIAGIAALSSPQDCVNETNKIYEERRNALIEGLTAMGLEVKPPKATFYIWAPVPKGFTSISFAKLLLEEAGIVATPGVGFGDAGEGYIRFALTKPVERIKEAVERMKKLQL

SEQ ID NO: 15213 - protein, 374 aa, Vibrio vulnificus CMCP6
MSTEKINLLVFDRKGMRDLFAQELGEKAFRADQVMKWIYHFGVDDFDNMTNINKQLREKLKQKCEIVAPVVSEAQHSSDGTIKWAMRVGDQDVETVYIPEEDRATLCVSSQVGCALECKFCSTAQQGFNRNLKVSEIIGQVWRAAREVGLEKETGRRPITNVVMMGMGEPLLNMKNLIPALEIMLDDLGFGLSKRRVTVSTSGVVSGLDQMTGKIDVALAISLHAPNDKLRSEIMPINDRWDIQDFLASVRRYIASSNANRGKVTVEYVLLDHVNDGTEHAHELAQLMKDTPCKINLIPFNPYPGSPYKKPSNSRIDRFQKTLMQYEHTVTIRKTRGDDIDAACGQLVGDVIDRTKRTAMLKAAKGETIEVKAL

SEQ ID NO: 15214 - protein, 141 aa, Vibrio vulnificus CMCP6
MALERTFSIIKPDAVERNLIGEIYHRIEKAGLRIIAAKMVHLNDEQASGFYAEHEGKEFFPALKEFMTSGPIMVQVLEGENAIARYRELMGKTNPEEAACGTIRADYALSMRHNSVHGSDSPASAAREIAFFFPESEICPR

SEQ ID NO: 15215 - protein, 469 aa, Enterobacter gergoviae
MSAEHVLTMLNEHEVKFVDLRFTDTKGKEQHVTIPSHQVNAEFFEEGKMFDGSSIGGWKGINESDMVLMPDASTAVIDPFYEEPTLIIRCDILEPGTLQGYDRDPRSIAKRAEEYLRATGIADTVLFGPETEFFLFDDIRFGASISGSHVAIDDIEGAWNSSTKYEGGNKGHRPGVKGGYFPVPPVDSSQDIRSTMCMIMEEMGLVVEAHHHEVATAGQNEVATRFNTMTKKADEIQIYKYVVHNVAHRFGKTATFMPKPMFGDNGSGMHCHMSLAKNGTNLFSGDKYAGLSEQALFYIGGVIKHAKAINALANPTTNSYKRLVPGYEAPVMLAYSARNRSASIRIPVVTSPKARRIEVRFPDPAANPYLCFAALLMAGLDGIKNKIHPGEAMDKNLYDLPPEEAKEIPQVAGSLEEALQALDADREFLTAGGVFTNDAIDAYIALRLEENDRVRMTPHPVEFELYYSV

SEQ ID NO: 15216 - protein, 116 aa, Enterobacter gergoviae
MIENLRNIAIIAHVDHGKTTLVDKLLQQSGTFDARTEAQERVMDSNDLEKERGITILAKNTAIKWNDYRINIVDTPGHADFGGEVERVMSMVDSVLLVVDAFDGPMPQTRFVTKKA

SEQ ID NO: 15217 - protein, 341 aa, Yersinia pestis CO92
MKALSKLKAEEGIWMTDVPQPELGHNDIMIKIRKTAICGTDVHIYNWDEWSQKTIPVPMVVGHEYVGEVVAIGQEVKGFNIGDRVSGEGHITCGHCRNCRGGRTHLCRNTVGVGVNRPGSFAEYLVIPAFNAFKIPDNISDELAAIFDPFGNAVHTALSFDLVGEDVLVSGAGPIGIMAAAVCKHVGARHVVIADVNEYRLDLARKMGVTRAVNVSKENLNDVMTELGMTEGFDVGLEMSGAPPAFRSLLNSMNHGGRIAMLGIPPSDMSIDWNQVIFKGLFIKGIYGREMFETWYKMAALIQSGLDLTPIITHRFPIDEFQQGFDAMRSGKSGKVVLSWD

SEQ ID NO: 15218 - protein, 546 aa, Colwellia psychrerythraea 34H
MTKSWFTNYPENVAHTVDLSRYSSLTDLLQQTSAKYQKNTAYSNFGAELTFEQVDELSRDFAAYLQNKLSVVKNDRVALMCPNTLCFPIAMWGIIRVGGVQVNVNPMYTPRELEHQLNDAQVDTIIIFSPSTQMLAEILDNTGIKNIITVDLDDLVNKGLPCAGVDERLTNTISFTDALAQGKTLGLNEPALCQDDLLFLQYTGGTTGLSKGAMLSHGNLIANILQYKEFAKAHIDYGNDIVITAIPMYHIFALMANTLSYFSFGAKNVLVTNPRDMPSFVEVWKNTPATMFTGVNTLYNGLLHTPGFENVDFSSLKLCIGGGAAVQQAVADKWRQVTGVKLQEGYGLSETSPILTLNFGSVDHTDDVPGIGVPVPNTDISIRDVMGNSVEQGQSGELCAKGPQVMSGYWNNVAATTECMTPDGYFKTGDVAMLDEHGFFHIVDRIKDMINVSGFNVYPNEIEAEVAKMPGILESACIGVDDEKTGEAVKLFVVTDKDSEDAKITEKDVISFCRQGLTAYKAPKHVVFIDEIPKSSVGKLLRRELR

SEQ ID NO: 15219 - protein, 515 aa, Yersinia pestis CO92
MSSTKKPLVLTILDGYGHREEQQDNAILNAKTPVMDVLWQQQPHTLIAASGLDVGLPDGQMGNSEVGHVNLGAGRIVYQDLTRLDKEIKEGDFFTNPTLTAAVDNAVKTGKAVHIMGLLSAGGVHSHEDHIMAMVELAAKRGATAIYLHAFLDGRDTPPRSAESSLKRFTAKFAELGNGRIASIIGRYYAMDRDNRWDRVQLAYDLLTQAKGEFTADNAVAGLQAAYARGENDEFVKPTVIQATGEADAAMNEGDTLIFMNFRADRARQITRTFVNAEFDGFKRDKVVNFGDFIMLTEYAADIKVACAYPPASLTNTFGEWLMKHDKTQLRISETEKYAHVTFFYNGGVEEPFKGEDRILINSPKVATYDLQPEMSSAELTEKLVSAIGSGKYDVIICNYPNGDMVGHTGDYDAAVKAVETLDNCIEQVVAAVKAADGQLLITADHGNAEQMRDPATGQAHTAHTSLPVPLIYVGNKAVKAVEGGKLSDIAPTMLSLMEMEIPQEMTGKPLFIVE

SEQ ID NO: 15220 - protein, 318 aa, Corynebacterium glutamicum ATCC 13032
MTNLTSTHEVLAIGRLGVDIYPLQSGVGLADVQSFGKYLGGSAANVSVAAARHGHNSALLSRVGNDPFGEYLLAELERLGVDNQYVATDQTFKTPVTFCEIFPPDDFPLYFYREPKAPDLNIESADVSLDDVREADILWFTLTGFSEEPSRGTHREILTTRANRRHTIFDLDYRPMFWESPEEATKQAEWALQHSTVAVGNKEECEIAVGETEPERAGRALLERGVELAIVKQGPKGVMAMTKDETVEVPPFFVDVINGLGAGDAFGGALCHGLLSEWPLEKVLRFANTAGALVASRLECSTAMPTTDEVEASLNQKV

SEQ ID NO: 15221 - protein, 362 aa, Thermococcus kodakarensis KOD1
MPLYRKRLRLVRGEGVYVWDEKGRRYLDLIAGIGVNVLGHAHPEWVLDMSRQLEKIVVAGPMFEHDEREEMLEELSHWVDYEYVYMGNSGTEAVEAAIKFARLATGRSEIVAMTNAFHGRTLGSLSATWKKKYREGFGPLVPGFKHIPFNNVEAAKEAITKETAAVIFEPIQGEGGIVPADEEFVKTLRDLTEDVGALLIADEVQSGLRTGKFLAIEHYGVRPDIVTMGKGIGNGFPVSLTLTDLEIPRGKHGSTFGGNPLACRAVATTLRILRRDRLVEKAGEKFMEFSGERVVKTRGRGLMIGIVLRRPAGNYVKALQERGILVNTAGNRVIRLLPPLIIEGDTLEEARKEIEGVLNDIL

SEQ ID NO: 15222 - protein, 103 aa, Zea mays
  misc_feature (48)..(48): Xaa can be any naturally occurring amino acid
MSGRGKGGKGLGKGGAKRHRKVLRDNIQGITKPAIRRLARRGGVKRIXGLIYEETRGVLKIFLENVIRDAVTYTEHAHRKTVTAMDVVYALKRQGRTLYGFGG

SEQ ID NO: 15223 - protein, 771 aa, Coprinopsis cinerea okayama7#130
MNIFRSIIGKVWHDPNAAEVVKIENGQFYLTRAGILRSNRECIYNEAMITIRRIPSVEHNFELVVTRVYEDEDQELLEDEDETDEERVYLISQELEFRAGETDGEPTFIWRDLHGDVDEAFEFVATGTNAPTRAFFETCMYRAMYERKYRRSADATSDADLEEFIYKPPAPKSASRPRKKVPKEEPVAAQPLEAVEDVPPSPPPSQQDIVEALPEVDRLGPPREVPNLEPVITSEAELYLWDFEEAEFKNNGIVLARLCRKYDDPFSYWIVAATDEGTLLAHTLTADTNPKWSHHMLSLTWNNVSDSGRPNSWLFRWKDEDDYSNYMTTFIRAQWESAHRMPWDKIKVEEQNYVMSAIDEDVEMRDVQDESEEEEEIAAALDPDEEPSEDEEEEEPLSEDEDSPAPAKGDRNSQLTVGYKGDRSFVVRGNNIGVFSHKGKNSVKYYATISKLATPKGKEFRPDHVMLHDQDSKMVMMNSGHPNTLFNLDIERGKIVEEWKVHDEIGVNSIAPESKFAPTTREQTLVGTSHNALFRIDPRMSGSKLVDSQYKQYASKNKFSGVVTTAAGKLAVASEKGDIRLFDTIGKNAKTALPPLGDPILGIDVTANGRYIVATTKTYLLLIDTLIGDGRYAGSLGFDKSFPATSKPKPKRLQLKPEHVAYMGNNITFTPARFNQGQDQEENAIVTSTGQYVVAWDFAKVKKGFYDKYEIKKYEDHVVQDNFKFGDDKEIIVALDNNVLAINKKNLKKPTRQSLAPNFGYSRSAIVNSPY

SEQ ID NO: 15224 - protein, 347 aa, Thermococcus kodakarensis KOD1
MYRVAVIPGDGIGPEVIDGAVRVLKAVTGRVRFEYYEGGVDVFQECGSPIREEDLEEIRRSDAVLFGATTTPFDLPGYRSLILTLRKELGLYANLRIIPDLRTGREIVIVRENSEGLYFGIGAVVNGRAVDVRLITREGAERIARFAVEQAKARGSFITFVHKANVLTGDKFFRRIVREVAGEEGVEVRDAIIDSFTIKLVRNPWEHGVILSENLFGDILSDLATVHAGSIGIVPSGNYGDGIALFEPVHGSAPDIAGKGIANPIGAILSGAMLLDYLGLDGSLIRAAVRGYVVNGELTPDMGGRARTEDVVRGIIGEIEDLLSMDEVWRDEIRLSRLESDISRMAG

SEQ ID NO: 15225 - protein, 464 aa, Listeria innocua Clip11262
MLYSKENKESYLEPVFGSSAEDRDIPKYTLAKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAQKPNLVISSGYQVCWEKFCVYWDIDMRVVPMDKDHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIYNDGSHLPIVCYKLKDDANVKWTLYDLADRLQMRGWQVPAYPLPKNLENIIIQRYVCRADLGFNMAEEFIQDFQASIQELNNAHILFHDTQQSGVHGFTH

SEQ ID NO: 15226 - protein, 339 aa, Pseudomonas syringae pv. tomato str. DC3000
MKTFSKVMTGTLLALSIGSAFAAGDPAIEHNTQAFLDALNSGTGKPIEQLSPKDARAVLVGAQAGVKLTLPQADVSEKTITVDGKPISLNIVRPAGVKGTLPVFMFFHGGGWVLGDFQTHERLVRDLVAGSGAVAVFVNYTPSPEAHYPTAINQAYAATQWVAEHGKEINVDGKRLAVAGNSVGGNMATVVALMAKDKGTPALRYQVLLWPVTDASFDNGSYNQYAEGHFLTRNMMKWFWDNYTTDAAQRNEIYASPLRATTEQLKGLPPALIQTASADVLRDEGEAYARKLDQAGVPVTAVRYNGMIHDYGLLNVVSQVPAVRSAILQASQELKEHLK

SEQ ID NO: 15227 - protein, 282 aa, Lactobacillus acidophilus NCFM
MTELTEDILKKVIKKRSSNTHKGNYGRILLIGGSENYGGAIIMSTEAAVNSGAGLTAVATHHLNLSALHSRIPEAMFIDWHDAKLADLIKNMDVVVCGSGLGMSDFAKQILVILRRCTSEKQTVILDASALDLISEDKSLLPVNAGHLILTPHQMEWQRLSQIRIPFQTDSANIDALKQLIPDSNAVLVLKSNHTHIYDGTGRTFVNPIGNPGMATGGMGDTLAGIIGGFVAQFGPSVDTISAAVYIHSLAGDLINKDNYVVKPTEVSKVLPKLMKKYSELE

SEQ ID NO: 15228 - protein, 495 aa, Mycobacterium abscessus
MTGTTTTLIVGAGFAGIGTAIRLLQEGTDDFVILERSNRVGGTWRDNTYPGAACDIPSLLYSYSFEPNPGWTHTYSGSAEILEYIDTIVTKYDLARFIQFDTDVTALEFDEGAGIWVADTADGKRYQARSVVMASGPLADASFPDIRGIDSYEGKKIHSARWDQGYDLGDKRVAVIGTGASAVQILPELVKSAASVKVFQRTPGWVLPRVNLKHPAWARSTFKQLPVSEQALRDAWFWAHEVMAVGMVWNTAATSAIQLAAKAHLRRQVKDPWLRRQLTPHFRPGCKRMLMTSDYYPALQSDNCKLISWPIATLSPNGVRTADGVEHEVDCIVFATGFDVCKRGTPFPISGLGGRKLGDEWSQGRYAFKSVSVAGYPNLFFTFGPNSGPGHNSALVYMEAVIDYVVKAIKLLQQNDIGTLDVREDRQGRYHSEIQRRLRRTTWNSGCSSWYLTEDGYNGTMYPGFATQFMRELSRLDPRDYVITRRDDAHLRLTQ

SEQ ID NO: 15229 - protein, 409 aa, Pseudomonas aeruginosa UCBPP-PA14
MAIEIKAPTFPESVADGTVATWHKKPGEAVKRDELIVDIETDKVVIEVLAEADGVLAEIIKNEGDTVLSNELLGKLNEGGAAAPAAPAAAAPAAAPAAQAAAPAAAGGDDAILSPAARKLAEEAGIDPNSIAGTGKGGRVTKEDVVAAVEAKKNAPAALAKPAAPAAEAPIFAAGDRVEKRVPMTRLRAKVAERLVEAQSAMAMLTTFNEVNMKPIMDLRSKYKDLFEKKHNGVRLGFMSFFVKAATEALKRFPGVNASIDGNDIVYHGYQDIGVAVSSDRGLVVPVLRNAEFMSLAEIEGGIANFGKKAKEGKLTIEDMTGGTFTISNGGVFGSLLSTPIVNPPQTAILGMHKIQERPMAVNGQVVILPMMYLALSYDHRLIDGKEAVSFLVAIKDLLEDPARLLLDV

SEQ ID NO: 15230 - protein, 477 aa, Zymomonas mobilis subsp. mobilis ZM4
MLKKYFGSRKKFRSLSSQQSHPHKKDQALSRNLSWPHLIALGVGAIVGTGIYTLVGVGADRAGPAVVIAFIIAGLICATAALGYAELSTLIPEAGGAYTYAYMAIGRHMAWIVGWSLILEYSLASSTVAVGWSAYLVGWLHSFGINLPAALLAGPHDGGIINLPAVIVALSIALLLTAGAKESATLTLALVILKLSALVLFVVLTMPAFHFEYYHPFMPYGFVSHISPDGKVRGVMAAAAILFFAFYGFDTVATAAEETKNPKRDLTIGIIGSMTISVLIYIGVAACLLGAAPFSEFIKSGEPLALILRNLHHETAAKWIAAAALVALPSVIMAMIYGQSRVFFVMARDHLLPPFLAKVNKHGTPSQVTLFTGIVIALIAGFFRLDELAELANAGTLVAFIAVGLSLIILRVREGERTRRFSCPFPFVIGSVTVIGCLYLFTSLPLHTTIRFLLWNAIGLVFYGSYNLYKRKKQKSL

SEQ ID NO: 15231 - protein, 396 aa, Streptococcus pyogenes MGAS315
MSDFLFFIESFYGLVSYIMNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYNLDISFTQAALGDTVEIPTVHGDVEMAIPAGTQTGKTFRLKGKGAPKLRGGGQGDQHVTVNIVTPTKLNDAQREALQAFAEASGEKMLHPKKKGFFDKVKDALEDI

SEQ ID NO: 15232 - protein, 498 aa, Mycobacterium abscessus
MDAVEAAQRPGGTMTNHLLAPAHHVKERLSSVIMVPAPHAVDDRWRRWSRDWPVRELAPAPAGSGLKAVRGDAGLPFVGHTLDYIRFGSDFSRERYDRLGSVSWMGAFGTKMVVIAGPDATREAFTSEAKAFSQDGWSFLIDAFFHRGLMLMSFDEHLMHRRIMQEAFTRPRLTGYVEQVTPCVRSAVPAWPVGPSVRIYPLLKELTLDIATDVFMGGRGKDESDAVNKAFVATVRAASSLVRAPLPGTRFRAGVQGRRVLEDYFFRHLPAARAGETEDLFAALCQATTEDGERFSDEDVVNHMIFLMMAAHDTSTITTTAVTYFLAKYPQWQEAAAAEAAAIGDGLPDIEALEKMTVIDRVIKEALRLLAPVPLVMRKTVRDVAIDGYHIPSNTLCAITPAVNHFDRTIWNDPERFDPSRFDEPRREDQHHRFAWVPFGGGAHKCIGMQFGTLEVKAILHRMLRSFTWKVPENYHVRWDNTSLPIPVDGLPLEMKRR

SEQ ID NO: 15233 - protein, 388 aa, Triticum aestivum
CRFGTGHGEHLFLGEGGGGGGRTRSAGSMEIDADLAVTRAEITDAAAATFADSTVIPDRYARPDEVGDGVVVGDEESHELPLVDMARLLDSESSEAEAAKLGSACRDWGFFQLTNHGLDESAVQDMKNNAVQFFRLPLEKKNAVAIEAGRLEGFGHHFAVASCDKLDWAESLILATQENEQTNMELWPADPPTFRDALEKYSLEMSSLARRLLRFMASDIGVEREALDGAFRGKRQTVAMHHYPPCRHPDKVIGITPHHDGLGLALLLHVDDTPGLQVRRGGRWFPLDPLPGALVVNVGDILQVLTNGKYRSAEHRVLVDAERGRTTVVMFQGASVAGTVRPLPGLGEARYRAIEYGEYVKGNFRALVEGTRFVDSLQTDVAQDEKEI

SEQ ID NO: 15234 - protein, 543 aa, Mycobacterium abscessus
MQSTMQNVPLTVSAIVQHAAAIHGDSEVVTPTGNGYRRTPYRIVLARVARLANALRSLGVTADQRVATFQWSNQEHLEAYCAIPSMGAVLHTLNIRLAPEQLAYIANHASDQIVLVDASVAPLLARALPAMASVHTVIVTGEGDLAPLQGCGKTVLRYEEVLAGQEESFDWPRLDELSAAAMCYTSGTTGDPKGVVYSHRSTYLHSLTACTANALSVSEADRVLAIVPMFHANAWGLIYAALMSGADLVLPDRYLQAEPLVSIIEDTRPTVAGAVPTIWNDVDRYLDSHPERDISSLRLVACGGSAVPLSLMRAFEEKYNVPIVQAWGMTETSPLATVARPAHRADATRRWEMRASQGRPICGVEIRLRDDDGKDVPWDGQSVGEIQARGPWITGSYFGDNDTEKFDEGWLRTGDVGKIDAEGYLTLTDRSKDVIKSGGEWISSVELENTLIGHPAVYEAAVVGVADDKWQERPLALVVVHPGTDVDIDQLRSFLADKVAKWWIPERWSFVSDIPRTSVGKYDKKAIRARHSAGEYLIEIETS

SEQ ID NO: 15235 - protein, 358 aa, Glycine max
MSHFKGKYHDELIANAAYIGTPGKGILAADESTGTIGKRLASISVENIESNRRALRELLFTAPGVLQYLSGVILFEETLYQSTAAGKPFVNVLKEAGVLPGIKVDKGTVELAGTNGETTTQGLDGLGQRCAKYYEAGARFAKWRAVLKIGPNEPSELSIHENAYGLARYAVICQENGLVPIVEPEILVDGPHDIHKCAAVTERVLAACYKALNDHHVLLEGTLLKPNMVTPGSQSAKVSPQVVAEHTVRALQRTVPAAVPAVVFLSGGQSEEEASVNLNAINQVNGKKPWSLSFSFGRALQQSTLKAWGGKEENVKKAQEALLVRAKANSEATLGTYKGNSQLADGASESLHVSNYSY

SEQ ID NO: 15236 - protein, 464 aa, Hyphomonas neptunium ATCC 15444
MTKVIMSDFQSLGLTGRILTSLTKAGYTAPTPIQEQAIPLVIQGRDIVGLAQTGTGKTLAFAAPILDRLSRNASPAPVRGTRVLVLAPTRELAGQIATSFGTYGAGLNLRVVMVCGGAKIGGQIRQLERGAHILVATPGRLIDLMEQRAVSLDKVETLILDEADQMLDLGFIHALRAIAKNVPSKRQTLFFSATMPKAVESLAATFLRNPAEVSVAPPATTAGRIEQRVCFVEQPEKASLLIEKIRDPELRSAIVFTRTKHGADGVVKRLAKADIDSVAIHGNKSQSQREKALEAFKAGRVPILVATDIAARGIHVDALTHVINYDLPDVPEQFVHRIGRTARAGNSGVAISFCSRDERPTLRAIEKLTGLKLAPNGVSLPDEPLRKPGKPQGNRSGNGGGRGGARSGGGYQGQSSGSQSGGSHSGRPHRKGPPGGGANASGQNSQRSSNGAARPRRFKERADA

SEQ ID NO: 15237 - protein, 217 aa, Arabidopsis thaliana
MGGRFGVLLVLFLLSWSCHATNPILLEPFESAHDDNQVCELCDKYVTLVIDYLQDYDNQNELVEALHISCSQIPPLKKQCLSMVDHYTQLFFTQVSTIKSDQICKRLNLCQAVTPAFASQVHQGNCEACRETVSEVVTKLKDPETKLKIIRLLLKECKSLNNYQDKCKKMVFEYGPLMLTDLQKFLEKKDVCTILHVCPGPATHRDYVPAVESLADS

SEQ ID NO: 15238 - protein, 353 aa, Burkholderia mallei ATCC 23344
MTAIVCHAPEDYRVERVAKPRANARELVIRIGACGICASDCKCHAGAKMFWGGPSPWVKAPVIPGHEFFGYVEALGEGAAEHFGVALGDRVIAEQIVPCGTCRYCKSGQYWMCEVHHIFGFQREVADGGMAEYMRIPSGAIVHPIPLGISLEDAAIIEPLACAIHTVNRGDIQLDDVVVIAGAGPLGLMMTQVAKLKTPRRLVVVDPVEARRALARAYGADVTIDPAREDAPAIVRALTGGYGCDVYIETTGVPAGVTQGMALIRKLGRFVEFSVFGKDTALDWSIIGDRKELDVRGAHLGPYCYPVAIDLLARGLVTSKGIVTHGFSLDEWDEAIRVANSLDSIKVLMKPRG

SEQ ID NO: 15239 - protein, 255 aa, Corynebacterium glutamicum ATCC 13032
MTTFITSGGLEISPAGAHIVHAESPEGELLFVSSASQYGEGNAIRGGVPIIAPWFGGLLGLDPAHGWAKRSAWDVTEHDGQIHAEYGRDGLLLDIRANSTKNGFEITLRAYNDTDEARTVQLAFHPYFKVDDVEKIEVRGLDGVDILNRLNNEVETQDGPVTFDGEFDRIALGTPVVRIFDTDRIITIEGDGHDSTVVWNPGESRASTVADIGEGEWRDFVCVEPALLGADQKGVRVAPGQSVTVGMQVSVEKRA

SEQ ID NO: 15240 - protein, 330 aa, Escherichia coli
TIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 15241 - protein, 330 aa, Triticum aestivum
  misc_feature (99)..(99): Xaa can be any naturally occurring amino acid
  misc_feature (217)..(217): Xaa can be any naturally occurring amino acid
  misc_feature (226)..(226): Xaa can be any naturally occurring amino acid
CRFQIPGTSDLQVSLCKEMVEWTRAEKRTFLRQRVEARLAALLLESQEYTEALTLLSGLIKEVRRLDDKLLLVDIDLLESKLHFSLRNLPKAKASLTAXARTAANAIYVPPAQQGTIDLQSGILHAEEKDYKTAYSYFFEAFEGFNALDDPKAIFCLKYMLLCKIMVNQADDVAGVISSKAGLKYVGPDVDAMKAVADAYSKRSLKYFETALGDYKXQLEEDPIVXHRHLSSLYDTLLEQNLCRLIEAYSRVDIAHVAEMIELPIEHVEKKLSQMILDKKFAGTLDQGAGCLIIFEDAKTEAIFPATLETISNVGKVVESLYMRSAKIMA

SEQ ID NO: 15242 - protein, 568 aa, Corynebacterium diphtheriae NCTC 13129
MGAFDDKAWLQHYGDWTPASLDYGDTTLVDIYDNNLAVNADKPATYFFGRTQTYAELDAQVRAAAAGLKAFGIRPGDRVAIVLPNCPQHIAAFYAIQLLGATVVEHNPLYTAHELEGLFQDHGARVAIAWDKAASTLEKLRDTTSLETIISVNMTEAMPRIQQLALRIPIPPIAAKREQLTAFADNTVPWSTLIGNAIGGNGKRTEFPKVTKDDIALILYTSGTTGTPKGALLSHGNLVSNCFMGKAWVPGLGDQPERFLAALPMFHAYGMTMVGTLGVFVGAEMVLLPAPQIPLIMKIMKNHTPTWLPGVPTLYEKIVAEATAKGVEIKGIRNSFSGASTLPVRTVEDWENLTGGLLVEGYGLTETSPVLCGNPMNGNRRPGYIGVPFPDTEIRIANPDNLDETMPDGEAGEVLARGPQIFQGYLNKPEATAATFHGDWFRTGDMGVMEEDGFIRLVSRIKEIIITGGFNVYPAEVEEALIAHPDVDDAAVVGRPRKDGSEDVVACIVLKDGAALDPEGLKTHCRKLLTRYKVPRTFYHFEALNKDQLGKVRRREVQQTLLERLGEK

SEQ ID NO: 15243 - protein, 330 aa, Escherichia coli
TIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDTETGYSNKVLDLIAHISK

SEQ ID NO: 15244 - protein, 566 aa, Corynebacterium diphtheriae NCTC 13129
MSAYETKKWLHYYPDWTPHSLDYGDTTLLDVYSNNLALNKDKPATYFFGRQTSYGDLDKQVRTAAAGLRALGVRSGDRVAIALPNCPQHIVAYWAVLMLGATVVEHNPLYTAHELESPFQDHGARVAIVWDKAADTLEKLRRNTPLETIVSVNMMTAMPAVQQALLRLPIPMIRKKRDALTASAPNTIPWEILVGSALGGNGDDIVPCPEVTKKSIALILYTSGTTGTPKGAQLSHGNLFANIMQGKAWVKGIGDQDERLLAALPMFHAYGVTIVLNLAFYVGGELVLLPAPQIPLIMKIMKKHTPTWVPGVPTLYQKIVEAAERDGISISGVRNSFSGASSLPVETVARWEALTGGLLVEGYGLTETSPIIVGNPMTTDRRPGYVGVPFPDTEIRIANPDNLDETMPDGQEGEVLVRGPQVFSGYLNNPEATAKSFHGQWYRTGDVGIMEEDGFIRLVARIKEVIITGGFNVYPAEVEEVLRNHPDITDATVVGLPRGDGSESVVAAITLAAGAALDPEGLKAYCRENLTRYKVPRTFYHFEELPKDQLGKVRRKDVQEALASKK

SEQ ID NO: 15245 - protein, 475 aa, Gibberella zeae PH-1
MGDATQVKVVFTTTEQDLVLPESKQQLLVPADIKRYGLSRILNSESMLDTSSPVPLDFLANGTFLRTSIEEYLATHGLSSESTLTLQYVRSLLPPVYEASFEHDDWVSGVDVLSATSRAGLLAGGANVPERVASSSYDGLVRIWNPSGDAIAVSPAGRAGGHTQRANVVKWISQKQLASAGLDRKVIVWDYSESDDGFSGSLKPSMELWGHEKDINSIDVNGATKRILTASSDGKVGLWTSSKRTAPQADSESLPSAHSTKRAKLASAANTAQRGPLALISVHDEPVTAAIFHPNDATVAYSASKDHTVRTIDLTTQREVSRLTTMHPLLCATALPGSSLIAAGSSARHITLLDPRESASSTSAMTLRGHVNMVVSLSASPENDYSLVSGSHDSTCRVWDLRSTRMGNSEEGGGSVSEPVYTIGREWLKGKKLPPAGDGAKVLGVSWDKTWGIVSGGEDKKVQINRGRDLFGSGS

SEQ ID NO: 15246 - protein, 467 aa, Ehrlichia ruminantium str. Gardel
MAMIVLSAAQVLACENRCSIPIASLIQKAGKAVSDVIISSFQRQGVTILAGPGNNGKDGIVVARTLKSFGWPVTLMLYCCDTDIYEDWIVSLTYDSIVNCTNSIIVDALFGIGLSRDVCDDLSKIFNYINSSNKIVVAVDIPSGVNCDTGQVMGCALRADLTITFSVLKMAHVLFPGCYYSGRVHVVDIGIDIDDSVVKIHKNTPILWKDEIPKLTYTSNKYNRGYTLVCSIGNKSVGASKLAAMSALKVGSGIVSIACDSVALDLYAVCLTSIMYKLYDDVIDDDRITSVLIGPGCGTSDITKQRVINVLQKKKCVLDADAISVFSGSSDVLFSHIKNDVIMTPHEGEFRRIFPFLTGSKVDMVREAANISGAVIVLKGADTVIGDPDGNIVITNPPFTLATAGSGDVLSGIIAGLLSSGMSSFSAACCGVWIHAECARSYGIGLIADDIILQIPTILKNLLYRNY

SEQ ID NO: 15247 - protein, 261 aa, Corynebacterium diphtheriae NCTC 13129
MLALLRFVANLTSMTTGKLILLRHGQSEWNASNQFTGWVDVNLTEKGEAEAKRGGELLKAQGVLPSVVYTSLLRRAIRTANIALNAADRHWIPVVRDWRLNERHYGALQGLNKAETKEKYGDEQFMAWRRSYGTPPPELEDSSEFSQANDPRYANLDVVPRTECLKDVVERFVPYFKEEILPRVKNGETVLIAAHGNSLRALVKHLDNISDADIAELNIPTGIPLVYELDEAGTVLNPGGTYLDPEAAAAGAAAVAAQGAK

SEQ ID NO: 15248 - protein, 327 aa, Yersinia pestis CO92
MVKKIGVLTSGGDAPGMNAAIRGVVRAALSAGLDVFGIEDGYLGLYENRMKKLDRYSVSDMINRGGTFLGSARFPEFRDPEVRKVALKNMHERGIDGLVVIGGDGSYAGADLLTKEGGIHCVGLPGTIDNDVAGTDYTIGFFTALETVVEAIDRLRDTSSSHQRISIVEVMGRYCGDLTLAAAIAGGCEFIAIPEVEFKRDDLVAEIKAGIAKGKKHAIVAITEKLDDIDSLAKYIEKETGRETRGTVLGHIQRGGAPVAYDRILASRMGAYAVDLLLQDHDYKKGGFCVGVQNEKMVHELISVCIAPENKKSKFKEDWYDTAKKLF

SEQ ID NO: 15249 - protein, 329 aa, Deinococcus radiodurans
MAYPNPAGIKRVAVLTSGGDAPGMNAAIRAVVRTGAQQGIEVVGVRRGFSGLHRGEVQLLGPRDVANTIQRGGTILLTARSHTWRSPEGRAKGAAVLREWGVDGLVVIGGDGSFHGGYFLQEEHGIPVIGVPGTIDNDLYGTDHTIGYFTAVETALEAVDKLRDTGASHERIFVIEVMGRHAGHIALDVAVAGGAEEVFIPEDKKPIGDVVNIVKDSIAKGKRGSIIIVAEGYDGGAEAVAQAIHAGTGLETRVSILGHIQRGGTPVSSDRILASRLGEAAVYALMDGKKGVMVGRIGGGIAYTPLHETWEKRKDVSRDLYRCAKMLSI

SEQ ID NO: 15250 - protein, 170 aa, Triticum turgidum subsp. durum
MASSATSVAPFQGLKSTDGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 15251 - protein, 169 aa, Triticum aestivum
  misc_feature (9)..(9): Xaa can be any naturally occurring amino acid
MAPTVMASXDTSVAPFQGFKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGC

SEQ ID NO: 15252 - protein, 848 aa, Coprinopsis cinerea okayama7#130
MSFSFLPLITQGDEQLFKALNRIGPVILSAQSSVPLPSTADHPYILFESSTDPVDLDQLIKWLDEGVEKLILPLSWTKEVIGTIPRERLVLLLDVANVSAVSDKVRSAVSGVLLKTPSLDLDFVTSVSKFFAGSAIYVLSTSTDLPSPSNVRQLKGIGATPVLPESQLTLEATSAANLNIADAYVAPITSDRKDGLFPTIVSTETGHSLGLVYSSVESVKESIVTGKGVYQSRKHGLWRKGETSGATQEVVSIRLDCDSDSLEFRVVQHGAGFCHLNRQSCFGEASGLPALENILRSRLESAPEGSYTRRLFNDAELLRSKIMEEADELCRAETKEEIQFEAADLIYFALTKCTAAGVSIADIERSLDRKAKRVTRRAGNAKPQWSKKEAESAPAPAKATPVSTETIRMNTYDLATASSEQRAQLLRRPVLNSNEMIDKVKPIVEEVRKRGDKALLEFTAKFDRAQLSSTVIFPPFAPESMQLEDFIRDAIDVAYSNIKKFHEAQNSDAILRVETMPGVVCSRFARPIARVGLYIPGGTAILPSTALMLGIPAQVAGCKEIVFATPPRSDGSISPEVMYVAHLVGATAILKAGGAQAVSALAYGTETVPKVDKIFGPGNQWVTAAKMLVQNDTDALVSIDMPAGPSEVLVIADHTANPAFVAADLLSQAEHGVDSQVVLVAVNLTEEHLAEIEAEVNKQALALERVDIVRQSIPKSNIVKVATVDEGIAFSNDYAPEHLILHLQDASDRVAQIDNAGSIFVGAFTPESCGDYASGTNHTLPTNGYARQFSGVNTLSFQKHITSQEITADGLGGLGPVVATLADCEGLQAHANAVRIRLQSIGNREGAL

SEQ ID NO: 15253 - protein, 369 aa, Coprinopsis cinerea okayama7#130
MLSRRLLSRVAPTLNRAPRLPQRLPALALRRYATGAEQHTMTVREALNLAMEEEMTRDENVFILGEEVARYNGAYKVTKGLMDKFGERRVVDTPITEMGFAGIAVGAALQGLRPICEFMTFNFAMQAIDQIVNSAGKTYYMSGGNVPCPVVFRGPNGAALGVAAQHSQDYAAWYGSIPGLKVVSPWSAEDCKGLLKSAIRDPNPVVFLENEMMYGVSFPVSQEALSTEFLLPIGKAKVEREGSDVTIVAHSRSVTHSMEAAEVLAKEGIKAEVINLRSIRPLDIDAIIKSVKKTNRLVIVEGGFPQFGVGSEICAQIVESEAFDYLDAPVERVTGADVPTPYAANLEALSFPDTPLVVKVAKRALYRTN

SEQ ID NO: 15254 - protein, 330 aa, Exiguobacterium sibiricum 255-15
MSEQQIVLASRPEGRPTRDTFRYETIELDALKADQVLVETLYISVDPYMRGRMNDARSYSQPFDLDAPIQGGVVARVVESTSDLLTVGDTVVGMLDWATKSVVDAKQVRKIDATLAPVSTALGVLGMTGMTAYFGLLDIGNPQSGETVVVSAAAGAVGSIVGQIAKIKGARVVGIAGSAEKIQYLKEELGFDEVINYKTEQIGEALDRTCPDGIDVYFENVGGAIGDAVLDRLNPFARIPVCGAISGYNEQADLGPRVQSKLIIARARMQGFLVGDYGKRFKEAAEQLGKWVSNGELKYEETIFEGFEQVPDAFLGLFDGSNTGKLLVKL

SEQ ID NO: 15255 - protein, 267 aa, Salmonella enterica subsp. enterica serovar Paratyphi A str.
MAEPLTVSPELTANYAYFFDLDGTLAEIKPHPDQVVVPHKILQLLDRLAAHNAGALALISGRSMTELDALAKPFRFPLAGVHGAERRDINGKTHIVRLPEAVVREVEALLRSTLVALPGTELETKGMAFALHYRQAPEHEAALLALAQHVTQHWPQLALQPGKCVVEIKPKGTNKGEAIAAFMQEAPFAGRIPVFVGDDLTDEAGFGVVNHAGGISVKVGVGATQAAWRLESVPDVWRWLEQINYPQQEQQVMNNRRDGYESFSRSI

SEQ ID NO: 15256 - protein, 97 aa, Streptococcus pyogenes MGAS315
MEEYVDRGIFDKEPFQTFDQKGIGRLFSTAVSLARSVKPDLKLGICGEHGGDPTSIAFCHSQGLTYVSCSPFRVPLTRLAAAQAAIKASGHSLTQDK

SEQ ID NO: 15257 - protein, 259 aa, Triticum aestivum
  misc_feature (186)..(186): Xaa can be any naturally occurring amino acid
HCRTSLYKKAGWYRSGIPGISSTHASDQKADSKLNIPLKSGNSLTLFLTKEADVEFASSLISLLKTIERGIQVHEDFSGGMVSPAELLVCHFTGIKALEDEYGSAEIVKQGAEVVQTALTKAFDQLQGAYNGKIVGLVISAKEASTSLASIIDAPSSLHISRRLAEASKTNATASIAAYILYLVRXSLAWITGIILLVSTLIGIGLLMNMPLTRDTLLFFKCPRLISLCYIRISTRLTGKFSTGMLGFSLGIPGVPVGT

SEQ ID NO: 15258 - protein, 640 aa, Corynebacterium glutamicum ATCC 13032
MPPVTHPEFRNVAIVAHVDHGKTTLVNAMLEQSGVFSDHGEVADRVMDSGDLEKEKGITILAKNTAIRRKGAGKDGNDLIINVIDTPGHADFGGEVERALSMVDGVVLLVDASEGPLPQTRFVLGKALAAKMPVIIAVNKTDRPDARIDEVVEEAQDLLLELASALDDEEAAQAAEQLLDLPVLYTSGREGKASTENPGNGNVPNSPDLMPLFETLYEVLPEPTADIDGPLQAHVTNLDSSSFLGRIGLVRVHAGTLRKGQQVAWIHYDEEGNQHTKTAKIAELLATVGVARVPATEVVAGDIAAISGIEDIMIGDTLADPENPVALPRITVDEPALSMTIGVNTSPMAGRGGGDKLTARVVKARLENELIGNVSLKVNPTERPDTWEVQGRGEMALSILVETMRREGFELTVGKPQVVTQTIDGKLHEPYEIIVIDVPSEYQGNVTQLLATRKGLMQSMSTTPGSDWIRMEFRIPARGLIGFRTQFMTETRGTGIANSYSDGMDVWAGEIKGRAHGSLVADRSGQITAYALTQLADRGSFFVEPGTETYEGVVVGLNNREEDMDINPTKEKKLTNMRAASADTTVTLAKARSLSLDEALEFCGVDECVEVTPDVLRIRKVILNATERGRARSRAKSLNK

SEQ ID NO: 15259 - protein, 206 aa, Thermoanaerobacter tengcongensis MB4
MATIAMYLGQLLEFIHHYVGNYGVAIIVFTVFIRILLLPFYIQQMAMMKKMKEIQPLVEELKKKYGKDPQKLNMETMKLYQEKKINPFGGCLPMLLPLIILWPLFTMLRTYPAFSTASFLWMHSLAERDPYYIIPILATVTTYISSAMVATDKSQNSMNIMMSLFMGWITVTLPAGVGIYWVTSNIFQIVQQYIFMRETKTLKGES

SEQ ID NO: 15260 - protein, 312 aa, Pseudoalteromonas tunicata D2
MSVICFGEVLIDFLSDGKIPESFTKYAGGAPANVAVAISKLQGESFFCGMVGNDMFGHFLLEQLQCYGVNTQWVKVTSVAKTALAFVSLDEQGERTFSFYRPPAADLLFRNTDFSPELFKQAKVFHLCSNSLTEKSIYHASLAGVKMAKNAGLTISFDINLRLNLWPSTRYTAERIWHIIGNADIVKFAQEELEFLCNNSNKPSTLEQTIARCFEQGVKLVIVTNGAKPISVYTDNQMSEVAIKPMPASDTTAAGDSFIAGVLFDLVKRQIAIDGAQLNDYLPSIAFGAQCAAITVTRFGSFTALPTAQDLN

SEQ ID NO: 15261 - protein, 670 aa, Methylococcus capsulatus str. Bath
MPSRRELANAIRALSMDAVQKANSGHPGAPMGMADIAEVLWNDYLCHNPANPKWPNRDRFVLSNGHGSMLIYSLLHLTGYDLPIEELQNFRQLHSKTPGHPEYGYTPGVETTTGPLGQGITNAVGMALAERTLAGQFNRPGHTIVDHYTYVFLGDGCLMEGISHEACSLAGSMKLGKLIAFYDDNNISIDGEVRGHGGVPGWFMDDTPRRFEAYGWHVIPKVDGHDPDAVKAAIEEARAVTDKPSLICCQTIIGWGSPNKQGKEDCHGAALGTDEVALTRENIGWSHPPFEIPADIYEAWSARETGAKAEGEWNDRFENYRREFPELAAEFERRMAGELPRDWAEKSAAFVAQVNEKAETIASRKASQNALNGFGPLLPEILGGSADLAGSNLTLWSGCKDVNAPGHDGNYVYYGVREFGMSAIMNGIALHGGFKPYGATFLMFSEYARNALRMSALMKIPVIYVYTHDSIGLGEDGPTHQPVEQTATLRLIPNMQVWRPCDAVESAVAWKCAIERRDGPSALIFSRQNLPHMPRTPEQIAAIAKGGYVLVDCTGTPDLILMATGSEVELAVKAAEALTAKGRQVRVVSMASTNVFDAQEPAYRDSVLPPAVTRRLAIEAGVSDGWWKYVGSHGKVIGLDRFGESAPAGVLFKTFGFTVDNVVGQAEALF

SEQ ID NO: 15262 - protein, 329 aa, Methylococcus capsulatus str. Bath
MSKNLLDQLREVTVVVADTGDIEAIEKFKPRDATTNPSLITAAAQMPQYQDIVDDTLKGARQTLGPGASAAQVANRAFDRLAVSFGLKILQIIEGRVSTEVDARLSYDTEGTIEKAREIIKQYEAAGVSKERVLIKIAATWEGIEAAAVLEKEGIHCNLTLLFGLHQAIACAENGITLISPFVGRILDWYKKDTGRESYAPHEDPGVLSVTQIYNYYKKFGYKTEVMGASFRNIGEITELAGCDLLTIAPSLLAELQATEGELPRKLDPAKAKDYPIEKIHVNKYTFDKMHAENRMATEKLEEGIQGFTKALEQLEKLLADRLAHLEAA

SEQ ID NO: 15263 - protein, 493 aa, Maclura pomifera
MIGQTAELVFVPAPGMGHLVATVEIAKLLVARDSRLFISVLIIKFPFDPKNTSYAEKFLSSSANSTSTERIQFIDLPESQIDPDFNAFSLFLHSFFENQKPLVRDAVTKIVESKSGRPDSAPRLAGFVLDIFCTTMMDVADEFGVPSYMFYTSGAGSLSLMSHFQALTDKHKIDTTEFTDKPDTEFLIPGFVNSVPAKVLPGVLFDKVAVPLLLNHYRKMRKTKGILVNTFIELESNVIHSLCNSELPPIYPVGPILNLNPGGMDKRTTEIVTWLDNQPPSSVVFLCFGSMGSFGEDQVREIALALEKSGVRFLWSLRQPPENGKVPLPKDYADLNEVLPEGFLDRTTEIGQVIGWAPQVTVLAHPSIGGFVSHCGWNSTLESLWFGVPVATWPLYAEQQLNAFQLTRELGLAVEVKMDYRKGFNRGTGNDAEVVVLQAEEIVRAIRCVMEHDSDARNKVKEMSEKSRKGMLDGGPAYTSLGRFISNVMQNVP

SEQ ID NO: 15264 - protein, 255 aa, Yersinia pestis CO92
MRHPLVMGNWKLNGSTHMVNELIAGLRKELSTVDGCGVAIAPPAIYLNQAKHELAGSRIALGAQNVDVNLSGAFTGETSAEMLKDIGAQYIIIGHSERRTYHQESDELIAKKFGVLKEIGLIPVLCIGESEAENEAGQTEAVCAKQLDAVLNTLGVKAFEGAVIAYEPIWAIGTGKSATPAQAQAVHKFIRDHIAKQDAAVAAQVIIQYGGSVNDKNAAELFTQPDIDGALVGGASLKADAFAVIVKAAAKAKKA

SEQ ID NO: 15265 - protein, 399 aa, Ehrlichia ruminantium str. Gardel
MSFLSKRMECIKPSPTLEIASQAQKLKMLGRDIISLSAGEPDFDTPEHIKQAAINALNLGKTKYTAVDGIIELKKAIISRLKQDHNLIYDVSQISVGNGAKQCIYNLFMSTLNDGDEVIIPAPYWVSYPDIVKIAGGNPVIIDCSNTSKLSAELLENAITDKTKWLILNSPNNPSGLVYTYDELKDIAQVLLKYSNVHIMTDDIYSKIVYDDLKFFTIAQVEEDLYSRVFLVNGVSKAYAMTGWRIGYIAGASEVIKAISVIQSQSTTNPNSVAQFAAVEALTGDQKFLEERNKVFIERRDIMLDMINNTPLLSAEKPQGAFYVFISCKELIGRTTKSGFCITSAMDFTKYLLEDYNIAVVPGEAFGVQGFFRVSYATSTQCVSEACDRILTACNELIY

SEQ ID NO: 15266 - protein, 157 aa, Listeria innocua Clip11262
MSIFTNTPLIASIIAIVFAQVVKVPIHILVYRKFNLGLMFSTGGMPSSHSAAVTALMTTLAIEYGLDSPYFAIAVVFGIIVMFDATGVRRQAGEQAVILNKLVTDFQDFVEHAKGLAAPEQEEKTKHLKELLGHKPMEVFFGALTGIAIGFILEIFM

SEQ ID NO: 15267 - protein, 439 aa, Thermococcus kodakarensis KOD1
MKIVVVGSGTAGSNFALFMRKLDRKAEITVIGKEPTMQYSPCALPHVVSGTIEKPEDIIVFPNEFYEKQKINLMLNTEAKAIDRERKVVVTDKGEVPYDKLVLAVGSKAFIPPIKGVENEGVFTLKSLDDVRRIKAYIAERKPKKAVVIGAGLIGLEGAEAFAKLGMEVLIVELMDRLMPTMLDKDTAKLVQAEMEKYGVSFRFGVGVSEIIGSPVRAVKIGDEEVPADLVLVATGVRANTDLAKQAGLEVNRGIVVNEHLQTSDPEVYAIGDCAEVIDAVTGKRTLSQLGTSAVRMAKVAAEHIAGKDVSFRPVFNTAITELFGLEIGTFGITEERAKKEDIEVAVGKFKGSTKPEYYPGGKPITVKLIFRKSDRKLIGGQIVGGERVWGRIMTLSALAQKGATVEDVAYLETAYAPPISPTIDPITVAAEMAQRKLR

SEQ ID NO: 15268 - protein, 163 aa, Oryza sativa
MAGRSERVVSFGEMLIDFVPTVAGVSLAEAPAFVKAPGGAPANVAIAVARLGGGAAFVGKLGDDEFGRMLAAILRDNGVDDGGVVFDAGARTVLAFVTLRADGEREFMFYRNPSADMLLTHAELNVELIKRGALLLNLPWESKDSWAKEAHFVLVLVGSCCAF

SEQ ID NO: 15269 - protein, 314 aa, Rhodopseudomonas palustris CGA009
MPAKLDPDAAAVYKAFQDAGRPAYETLTAAEARAYYSAARLVSNPDPADMASVRSIAIPGPAGDIPARLYTPNKLRQDEGLAPALVFFHGGGWVIGDLDTHDVVCRGIAHDGELLVISVDYRLAPEHKFPAAIDDAIAATRWIADNARKLGIDPEQLSVGGDSAGGNVSAVVALHARDHGGPLLAGQVLIYPATDFSMRHPSHSEPETSVLLTHSVIRWFRDHYLSRAQDADDWRASPARAETLAGLPPAFVITAGADPLRDEGDEYARRLADAGVPVVHRTYPGQFHGFFTMGKLLPQANVAMREIGDWLKAL

SEQ ID NO: 15270 - protein, 491 aa, Corynebacterium glutamicum ATCC 13032
MASTFIQADSPEKSKKLPPLTEGPYRKRLFYVALVATFGGLLFGYDTGVINGALNPMTRELGLTAFTEGVVTSSLLFGAAAGAMFFGRISDNWGRRKTIISLAVAFFVGTMICVFAPSFAVMVVGRVLLGLAVGGASTVVPVYLAELAPFEIRGSLAGRNELMIVVGQLAAFVINAIIGNVFGHHDGVWRYMLAIAAIPAIALFFGMLRVPESPRWLVERGRIDEARAVLETIRPLERAHAEVADVEHLAREEHAVSEKSMGLREILSSKWLVRILLVGIGLGVAQQLTGINSIMYYGQVVLIEAGFSENAALIANVAPGVIAVVGAFIALWMMDRINRRTTLITGYSLTTISHVLIGIASVAFPVGDPLRPYVILTLVVVFVGSMQTFLNVATWVMLSELFPLAMRGFAIGISVFFLWIANAFLGLFFPTIMEAVGLTGTFFMFAGIGVVALIFIYTQVPETRGRTLEEIDEDVTSGVIFNKDIRKGKVH

SEQ ID NO: 15271 - protein, 465 aa, Azoarcus sp. BH72
MKPDLTSQLVQSPPGDLVAPPRFTSVEQAQEYLRARGVSYVLAQFVDIHGVAKAKSVPVSHLPSVVSSGAGFAGFAIWGVGIEPHGPDFMAVGDLSTLSVVPWQPGLARIVCEGHVDGKAWDYDSRVTLRKQVARLAERGWTLFTGLEPEFSLLRRGEDGSLLPADPSDTLDKPCYDYKSLSRTREFLERLSNDMRASGIDVYQIDHEDANGQFELNFTYADCLTSADHFVFFKMAASEIANELGYICSFMPKPFANRPGNGMHMHVSIGDGQRNLFEDKSDPRGLNLSQLAYHFLGGLLAHAPALTALCAPSVNSYKRLVVGRSLTGATWAPAYVSYGDNNRSSMIRVPKGRLELRLPDGSANPYLATAAVIAAGLDGIERRLDPGDPHNVNLYEWSPQQLADAGIGLLPQSLILALDSLEADSVICDALGPVAKEFLKLKRMEWVEYQRHVSEWEIKQYLEFY

SEQ ID NO: 15272 - protein, 290 aa, Brassica napus
  misc_feature (234)..(234): Xaa can be any naturally occurring amino acid
  misc_feature (243)..(243): Xaa can be any naturally occurring amino acid
  misc_feature (275)..(275): Xaa can be any naturally occurring amino acid
MAARIHGGAGAGAATALSTFNPKKLVAPSRTNLPAARSSKRCIVAAAGSDASKSLRVGHSQKLIANAAVATKAETSATTGTGHELLLFEALQEGLEEEMDRDPHVCVMGEDVGHYGGSYKVTKGLADKFGDLRVLDTPICENAFTGMGIGAAMTGLRPVIEGMNMGFLLLAFNQISNNCGMLHYTSGGQFTIPVVIRGPGGVGRQLGAEHSQRLESYFQSIPGIQMVACSTPYXGKGLMKAGXSDDPPVIQFEHVLLYKLKENIPDEAYICSLEXAEMVMPGEHISILTY

SEQ ID NO: 15273 - protein, 670 aa, Methylococcus capsulatus str. Bath
MRTRRELANAIRALSMDAVQKANSGHPGAPMGMADIAEVLWNDYLCHNPANPKWPNRDRFVLSNGHGSMLIYSLLHLTGYDLPIEELQNFRQLHSKTPGHPEYGYTPGVETTTGPLGQGITNAVGMALAERTLAGQFNRPGHTIVDHYTYVFLGDGCLMEGISHEACSLAGSMKLGKLIAFYDDNNISIDGEVRGHGGVPGWFMDDTPRRFEAYGWHVIPKVDGHDPDAVKAAIEEARAVTDKPSLICCQTIIGWGSPNKQGKEDCHGAALGTDEVALTRENIGWSHPPFEIPADIYEAWSARETGAKAEGEWNDRFENYRREFPELAAEFERRMAGELPRDWAEKSAAFVAQVNEKAETIASRKASQNALNGFGPLLPEILGGSADLAGSNLTLWSGCKDVNAPGHDGNYVYYGVREFGMSAIMNGIALHGGFKPYGATFLMFSEYARNALRMSALMKIPVIYVYTHDSIGLGEDGPTHQPVEQTATLRLIPNMQVWRPCDAVESAVAWKCAIERRDGPSALIFSRQNLPHMPRTPEQIAAIAKGGYVLVDCTGTPDLILMATGSEVELAVKAAEALTAKGRQVRVVSMASTNVFDAQEPAYRDSVLPPAVTRRLAIEAGVSDGWWKYVGSHGKVIGLDRFGESAPAGVLFKTFGFTVDNVVGQAEALF

SEQ ID NO: 15274 - protein, 430 aa, Corynebacterium diphtheriae NCTC 13129
MTSTQRSQELFARAQQFTPGGVNSPVRAFGSVGGHARFIQSAKGSKLYDVDGNEYVDLVCSWGPMLLGNAHPEIVEAVQKAATNGLSFGAPTEAEVKIAEMIVDRTSVEEVRMVNSGTEATMSAVRLARGFTGRPKVIKFDGCYHGHVDALLASAGSGVATFALPDSPGVTGASAADTIVVPYNDSEAVRAAFEAHPDQIACVIAEAAAGNMGTVAPQDNFNAKLKEVAHEHGALLILDEVMTGFRTSYNGWYGVDGVAGDLTTFGKVISGGLPAAAFGGRADIMRYLAPEGPVYQAGTLSGNPVAMAAGMKSLELATPEVYDMVRANADRLAGLLHEALDREGVAHHIQRAATMLSVRFAEGEGHNFDDMKAADTFRFPAFFHALLDNGIYASPSVFETWFVSAALTDDDFDKIEKALRPAAQAAGKAK

SEQ ID NO: 15275 - protein, 403 aa, Listeria innocua Clip11262
MSKPKIVILGAGYGGLKTLRKLQQRNLDAEIVLVNKNDYHHETTWLHEAAAGTIEPEKLMYPLDKVVNNTKTTFIQDTVVKINKDEKTVTLDANGDISYDYLLIGLGSEAETFGISGLKEYAFTITSVESVKKIRAHIEAQFAKWKTDPRDELLTIIVGGAGFTGIEFLGELTNRIPELVKEYDVPREKVRIYCMEAAPKVLPQFDAKLVDYGVGVLEDRGVEFHVGKPVKEATADGVKYAESETEVREIKAATIIWAAGVRGNSVIEASGFEAGRGRVKVNNNLTVPGNEEILIVGDCSLIINPANDRPFPPTAQIAMQQADVAAVNLAKLVKGETDLQDFVYHEKGTVCSLGDNDAIGVVFGKNLKGYPASVMKKVIDDRALLLIGGSGVLASKGKFKFYK

SEQ ID NO: 15276 - protein, 597 aa, Coccidioides immitis RS
MKTRIPLRRFAGVTSAPARPFFLQPQTIPWTCRRCLRQKQKLIHSTDARGNYSTAVFRTKASSSGGSHKKRPRRALKYAAAGGTLGATALAFSDDIKHGYNAAERTGRVITALAVCINDYRVTLNQNPGSDEEKATILKACHKRCAERTLRVLEKNGSIFIKLGQHLSSMGYLLPLEWTTTFIPLQDKCPVSSYESVEEMFVKDTGHRIDELFSSFEREPIGAASLAQVHIAVLKENGQKVAVKVQHPALAEWVPLDLALTRFTFSMLKKFFPEYDLEWLSNEMDMSLPQELDFRMEAENARRAREYFETRTKARLVIPEVMWAKERILVMDFISGHRPDDLEYLDSNKIDRDEVSAALAHIFNEMIFGEDAPLHCDPHGGNIAIRKNNLRRKPNFDIILYDHGLYRDIPRETRRAYAKLWLSIVEADEKGMRKYAHEVAGITNDEFPLFASAITGRDYSVVASKAIASSRSVDEKKVISDAMGDGMLQDLVTLLGKVPRIILLILKTNDLTRSLDENLHTRHGPLRAFLILARYATCTVFEEQMESIRQHGSIFWPRNFLQFIRAWASYLRVEMKLGIYERWLSVRGRLGLANQLL

SEQ ID NO: 15277 - protein, 329 aa, Mycobacterium smegmatis str. MC2 155
MLSIPPVDLIEAAADPASRRRQFELLDAAFSEVGYVHVVGHRIPSSVFTELYAVTRRFFGLPAEEKSKVAQPTPEQVRGWSGAGSEGMAYSLGEETHADLKEKMDIGPVTGPTIGQPGAGPMAYPNLWPELPEFRTAWECYYQHMQRVGAELLALAAEGFGLSRQHFVPLFDAELSMLRALHFPPQPEPPLPHQFRAGIHTDYGAFTVVSAESTPGGLQVLEADGEWLEVNTTPATLVVLVGDLLAEWTGNHWPATLHRTANPPRSVAFENSRLAFAFYQHPNWDVEVAELSPFAGGAAHATDDALVSGKHLAEKYVRQTTFGTSDPTV

SEQ ID NO: 15278 - protein, 215 aa, Triticum aestivum
MESSSSSLLLSSYTGGNKRAREADLDAASSAEAEAAKRMRPEDLLDLLDDDADAAAAGDLASVMRSLEEEICAGDLAPPQPELGFLLEASDDELGLPPAAAAASSSSDDAGGWEPEEPAGVFGEQIWGFEDEIDGAYAFGGVASSPEAAAAAAAAAAEWGDDGFDAGLFGFGDESFGPSGSRRAPPGDHAGRLISSGSVDGRMDGWINIFFLTFG

SEQ ID NO: 15279 - protein, 446 aa, Kluyveromyces lactis NRRL Y-1140
MASNGTGGLPPIDFEKVRNDSDGSVTGMAKGLFNQFIEGNPYFAAGGGLMVLGTSLALLRRGVISTSRLAYHQLIVDLEIPSKDKSYLWFLQWMSRYPHRSSRHLSVETNYLQHNNGSVSTEVNFVPGVGNHLIRYKGAFMLIKRERSGQIANITNGTPFETVKLTTLYRDRHLFQELLMEAKDLAVKAQTGKTVIYTSWANEWRPFGQPKAKRNLKSVILDNGLKESILNDVNDFLQNGKWYYDRGIPYRRGYLLYGPPGSGKTSFIQALAGELDYNICIMNLADPNLTDDRLNYLMNNLPERSLMLLEDIDAAFVKRSKNDEGFVNGVTFSGLLNALDGVASSEEIITFMTTNHPEKLDPAVMRPGRIDYKTYVGNATEYQIKQMFLRFYPEEKELCEQFVQKAVELDTPISTAQLQGLFVFNKQNPKNAVLMVESLRYPNHVF

SEQ ID NO: 15280 - protein, 370 aa, Exiguobacterium sibiricum 255-15
MHVEKRDYYEVLGVARDASAAEIKRAYRKLARTYHPDVNKEADADQKFKELSEAYEVLSDDNQRARYDQFGHQDPSQGGGGFGGAEGFGDIFDMFFGGGRRQDPNAPRKGQDLQYVEEIDFMEAFSGVEKVITIPVEEDCGTCHGSGAKPGTHPETCKRCGGSGHINVEQNTMFGRVVNQTTCSTCHGRGQIVKEPCETCRGAGRVRKNKDVRVKIPAGIDNGQQIRLAGKGEAGVNGGPFGDLYVVVRVREHELFERVDDHIVMDMPLTFAQATLGDEIEVPTVHGKVSLKIPAGTQTGSRFRLRGKGMPNVRSGHHGDQYVNVVIITPKNLTDRQKELLREFNEISDEKGVEEQHEGVFSRIKTFFTG

SEQ ID NO: 15281 - protein, 208 aa, Hyphomonas neptunium ATCC 15444
MRLRQFIWLSMTQTRTADVSRSTKETEISVSVNLDGTGKADIETGIGFFDHMLDSLARHSLIDLKVRCKGDTHIDFHHSVEDTGIVIGQAIAKALGDFGGITRFGHAYIPMDETLTRASVDLCKRPYLIWKVEFRRDKIGEMDTELFKEFFHALAGNGGMCLHVENIYGENNHHIAESCFKATARALRTAITVDPRLGGKPASTKGSL

SEQ ID NO: 15282 - protein, 424 aa, Hyphomonas neptunium ATCC 15444
MHHFNYAGGRLQCEGVDLGRVADEVGTPVYVYSTATLERHARVIAEAFSSQKVLIAYSVKANGNLAVLATLAAEGCGADVVSGGEMQRAMKAGIPAARIVFSGVGKTAAEMKLALEAGIHQFNVESAGELRLLSRVASGLGLKAPIALRVNPDVAAGGHPNISTGKSGDKFGVPWGEAEALYAEAGKLPGIQVVGVDVHIGSQIGELGPMRAAFEKVVALALRLRGQGHDIRRIDVGGGLGIPYRETDAPAPPSAYAAMIAEVTAGHGFEVILEPGRVIAGNAGVLLTTALYEKEAPDRTFLIIDAGMNDLIRPALYGAHHDIRPLDEPAQDAAEKVYDVVGPICESTDKFATARTLPKVTPGDRLAFMSAGAYGAVLSSAYNARPLVPEVLVSGDRYSIVRRRPDFEEMTMLEEVPDWITAKA

SEQ ID NO: 15283 - protein, 353 aa, Pseudoalteromonas tunicata D2
MSFPYLFIDRDGTLIYEPIEDKQVDSVAKVKLEPGVIPALLQLQAAGYRLVIVSNQDGLGTDSFPEANYHVAQNHMMDIFTSQGVKFEDVLICPHFSEDNCACRKPKTGLMTGYLRSGKVDLSRSFVIGDRQTDIGLAENIGCEGILYQGDWQSITTRLLTPNRCALIERNTKETQIALRLNLDSPAKGSIETGLGFFDHMLDQIRTHANIELDIKASGDLYIDEHHLVEDIGIALGQAIKTALGTKSQIARYGFALPMDECKAEAQIDLSGRASLVLNANFSREKVGDMDVQMVEHFFKSLTDNSALSLILSISDGNCHHQVEGLFKAFSRALRMAIAKDATQVLASSKGML

SEQ ID NO: 15284 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 15285 - protein, 486 aa, Azoarcus sp. BH72
MSAPTSYPSRNFIAGEWRAAISGATFAKLAPTSGAVLAEVANSSAADVDAAVAAARVQFDGGEWSRLPGAERGRLLNKLADLLARDAERFAHILAMEQGRPLMEMRMLDLPMSIDTLRYFAGWADKLEGRQIPTAGFMGRPTLNYTIREAIGVAALIVPWNAPLMIGIWKLAPALAAGCTVVLKPSEDAPLALTALAGLAAEAGFPAGVFNLVNGMGPEAGATLVKHPGVDKISFTGSTEVGRIIAREAAPLFKRLTLELGGKAPQIICADANLDAAIMGVAMGLFVNQGQTCAAGTRILVHRSRYDDVVGALAGAAKSVTLGDPLDANTRMGALINARHRDRVAALIQSGIAEGAALVAGGEALPENGFFVRPTVFAGGTPQMRIMREEIFGPVGVVVPFDSDEEAVQLANDTPFGLSASLWTQDIARAHTLAPKLRVGAVAINGWSPLDARLPWGGYKDSGVGRDLSRTALDAYTEEKVVSVVM

SEQ ID NO: 15286 - protein, 299 aa, Mycobacterium smegmatis str. MC2 155
MTATTPTRFHPDLERVARYIPRHMVNRATLPVFQRLTRLMGRRVPPGCEVLTLPSGVGIRLFRPPASTTLPGPALVWIHGGGYVLGSAAQDDAQCLQFARQAGVTVASVEYRLAPQNPYPAGLEDCFAALRWLTALPSVDPARVAIGGASAGGGLAASLALLARDRGIDVAAQLLVYPMLDDRSSFVPSLDHPGQRLWNQGSNRFGWKAYLGDADPDVAVPARREDLSGLPPAWVGVGTLDLFHDEDLAYAGRLHAAGVPCEIDVVHGAFHGFDGVAPKAAVSRAFRNAQCAFLKRALT

SEQ ID NO: 15287 - protein, 107 aa, Rickettsia prowazekii str. Madrid E
MTKNKNLEFIQNAIKKNKVVLFMKGTKEMPACGFSGTVVAILNKLGVEFSDINVLFDTALREDLKKFSDWPTFPQLYINGVLVGGCDIAKELYQNGELEKMLKDVVV

SEQ ID NO: 15288 - protein, 347 aa, Coccidioides immitis
AEKIAKFPGTKGPDGKYTVTLIEGDGIGPEISQSVKDIFSAAKVPIKWEPVDVTPILKDGKTAIPDEAINSVKKNYVALKGPLATPVGKGHVSLNLTLRRTFNLFANVRPCRSIAGYKTPYDNVNAVLIRENTEGEYSGIEHVVVDGVVQSIKLITREASERVLRFAFQYAQEVGKPKVRAVHKATIMKMSDGLFLRTAKEISKEFPDIEFDAELLDNTCLRMVTDPAPYNDKVLVMPNLYGDILSDMCAGLIGGLGLTPSGNIGNECSIFEAVHGSAPDIAGRALANPTALLLSSIMMLRHMGLNDHAKKIETAIFETLAEGKTLTGDLGGKAKTHEYAGAIIKRL

SEQ ID NO: 15289 - protein, 375 aa, Coprinopsis cinerea okayama7#130
MSDNPSFVLKGINDVVFEQRPIPEVTGDEVLVAVKKTGICGSDVHYLLEGRIGDFVVKSPMVLGHESSGVVAKVGPKVKHLKVGDRVAMEPGATCRACEACKLGKYELCPDIIFAATPPYDGTLARYYKLPADLAYPLPDNVTLEDGAMMEPLSVGVHSVANLGNFRAGQSIAVFGCGPVGLLCMAVAKALGASRVIAIDIVPARLDFAKQYAATDSFLPPKPLEGESKVDYSRRNAAALKEALGIAERGASAIDLVIDASGAEVSIQTALHVVKSGGTFVQVGMGNPNVTIDIGVLITKELNYKGSFRYGPGDYPLAINLVAAGKVDLKPLVTHRYKFEDAITAFNATKNGKSEDGKGVIKVVISGPDVDINSN

SEQ ID NO: 15290 - protein, 448 aa, Coprinopsis cinerea okayama7#130
MDASTSNQAVVFSTQTPYPLPSQKYMIPTTWRRYHLSQLVNKALGLAKPVPFDFLVKGEILRTTIAEWCAENGVGEEETLEIEYIESVLPPQRLSEFPHESWVSAVSCSLPTHFLTTAYDGHLRAFDLSKNVTLDAALHSAPITSFSVISSTVDTYKLATSSLDLTAQISEITLGEPQSSSSNKVLASLHLHTAPVSSIAANPSGTQLLTSSWDSLIGVWDTTIPPKHEVPEPTITAADQRTKKRRKVDPSSGDSSSPTAIRKAPLTVLKSHIGRVSKVAWLSPTQGVSCGFDSTLRTWDVERGLCTRTISASEKPFLDLAVNVENQTALTVSTDRTMTLYDLRTEEALSAAAGSFLHPATPSCVATTPESSYQVVTGAYDGVVRVWDTRSTKAAISSFKAWDGTKKVLAVDWKRGVIGIGGEGGLDVWKVGLENETQGLSKESQRSA

SEQ ID NO: 15291 - protein, 261 aa, Exiguobacterium sibiricum 255-15
MQFAVIGHPIAHSLSPMLHETWLKAAGLFGCYTTLDVEGDGLEAFVQKVRKRQFDGINVTIPHKSAIIPFLDRLEPAAARAGAVNTVYWDGEELVGANTDGTGFARALATWTNAKNSLVIGAGGAARGIIPMLPGHVTVMNRTNQTAEQVAAEFGQSAVPWSRTLDLTPYDVIINTTSVGMAPAIDQTPIELTATTALICDIIYRPTPTRLLREATANGLDTLDGVLMFVLQAAEAFERFTGHKPDIALGEQVIRKQLEES

SEQ ID NO: 15292 - protein, 203 aa, Pseudoalteromonas tunicata D2
MKLDLSNYQNLDFAKSELIPAIVQDIATGTILMQGFMNKAALEQTLTTEKVTFYSRSKERLWTKGESSKNYLHVIDIHTDCDHDSILILATPDGPTCHLGTQSCFPGATPDWAFLGQLNRVIESRKTASPESSYTASLFAKDISRSAQKVGEEGVEVALAAVKQDREELINESADLLFHLLVLLQKADVPVTEVIANLEKRHK

SEQ ID NO: 15293 - protein, 308 aa, Hordeum vulgare subsp. spontaneum
MATAGKVIKCKAAVAWEAGKPLSMEEEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCSISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 15294 - protein, 118 aa, Brassica napus
MPKERKHRSVSHERLRGSSLYCESSRALKPSEKQVKEWEEARCPVCMEHPHNGILLVCSSYDNGCRPYMCDTSHRHSNCFDQYRKASKQTPTETEGVVAEAASVVTVVNPREGEGIVE

SEQ ID NO: 15295 - protein, 306 aa, Hordeum vulgare subsp. spontaneum
MATAGKVIKCKAAVAWEAGKPLSMEEVEVAPPQAMEVRDKILYTALCHTDVYFWEAKGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 15296 - protein, 874 aa, Clostridium symbiosum
MAKWVYKFEEGNASMRNLLGGKGCNLAEMTILGMPIPQGFTVTTEACTEYYNSGKQITQEIQDQIFEAITWLEELNGKKFGDTEDPLLVSVRSAARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 15297 - protein, 888 aa, Geobacter sulfurreducens PCA
MAGKYVYFFGNGQAEGKAEMKNLLGGKGANLAEMTAIGLPVPPGFTITTEVCTYYYANNRSYPPTLAAEVADNLKKVEALMGRTFGDRNNPLLVSVRSGARASMPGMMDTILNLGLNDETVQGIIAQSGDERFAYDAYRRFVQMYSDVVMGMDKDLLEHLLEQKKEEKGVHLDTDLTAADWKELVGKFKAKIRETLGKEFPEDPQEQLWGAVGAVFGSWMNQRAITYRRLNNIPADWGTAVNVQSMVYGNMGNDCATGVAFTRDPSTGENYFYGEYLVNAQGEDVVAGIRTPQPINRANSKDTTLPAMEDVLPECYQQLVQIRGILEKHYRDMQDIEFTIEKGKLFMLQTRNGKRTAKAAIKIAVDMVREGLIDEKTAVLRVSPSQLDQLLHPSLDPKAQKRVIAKGLPASPGAASGEVVFTADEAEAAARLGLKVILVRVETSPEDIHGMHAAQGILTARGGMTSHAAVVARGMGKCCVAGCGDIKVDYAGSQFATAKGQVVKKGDVITLDGSTGEVMLGEVPTVPPQLTGDFGTLMEWVDRFRKLKVRTNADTPNDSRVAREFGAEGIGLCRTEHMFFEADRIAAVREMILAEDVEGRKKALAKILPMQKGDFVGIFREMKGLPVTIRLLDPPLHEFLPHEDKDIDALAKTMGVTPQSLRAKVDYLHEFNPMLGHRGCRLGLTFPEIYDMQVQAIMEAACELTKNEGFSIVPEIMIPLVGVVTELARLRENTVRVCEEVVAAYGVKVEYLIGTMIELPRAALTADEIAREAEFFSFGTNDLTQTTFGLSRDDAGKFLPFYVETGLLEDDPFVSLDQNGVGLLVKMAVEKGRATRPGIKLGICGEHGGDPSSVIFCHQIGLDYVSCSPFRVPIARLAAAHAALEEGK

SEQ ID NO: 15298 - protein, 332 aa, Oryza sativa (japonica cultivar-group)
MGKLLCDSSSAAVAVAEAPSPAPAPPLLTWPTPDPDPPTSWTAVAALEDQQRRRLHRIWERGVAWKPPATLPLPPLVFRLDHAGEVDADGNCLFTAARKAASAKPDARDLRHRIVRRFSHLYAAAQAPDRDAIDAAVRHLYAPDLKAGWGVHVVQELKLLAPKTLRHHLDAAINDLVDLGIQREMAAETIYRERCIAVNNGDSWAKYMSVSGSAEDEHNIITLQYTEEGLLTIDENRDGHAAAFGDDIAIECLATEFKREVYVVQAHGADAMVDEDNCVFFLPHRPRGEICEPPIFLFMKGTAWCGAGADHYEPLIATVLQNVTPDKAAVVL

SEQ ID NO: 15299 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEDVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTLAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 15300 - protein, 235 aa, Burkholderia mallei ATCC 23344
MTLPMTQDELKRLVGEAAARYVTENVPQGAVIGVGTGSTANCFIDALAAVKDRYRGAVSSSVATTERLKSHGIKVFDLNEIESLQVYVDGADEIDGSGAMIKGGGGALTREKIVASVAETFVCIADASKRVAVLGQFPLPVEVVPMARTAIGRRLAALGGVPVLRVKQDGAPYVTDNGNEILDVKGLRIDDPRALEAAINGWPGVVTVGLFAQRGADLCLLGTERGVETLRYAAH

SEQ ID NO: 15301 - protein, 330 aa, Corynebacterium diphtheriae NCTC 13129
MGNGTRVDLGEQNLNEEIAAGMIRVEDLLREELSKGEDFLVEKVMHLAEAGGKRFRPMFALLASQYGSQPMSENVIKAAVVVEMTHLATLYHDDVMDEADKRRGVDSANFRWNNSVAILAGDILLAHVARLMADLGVETVAHFSETFAELVTGQMRETIGARDGDPIEHYLNVINEKTGVLIASAGFLGSMHAGASAEHVEALRAYGRAIGMVFQIVDDIIDIFSDTTDSGKTPGTDLREGVFTLPVLYALSEDTAVGEELRSILTGPLTDDATVAHALDLLARSTGRERALADVHRYLEEAERQLALLPQNSTTDALRSLAHYTVKRVG

SEQ ID NO: 15302 - protein, 961 aa, Azoarcus sp. BH72
MNAPDTITFELDGRAVDAAPGESILLAARRAGVDIPHLCYTDGLRADGNCRACVVEIDGERVLAPSCCRAPKPGMKVQSASSRARASQRMVLELLRADVPVEAEKADSELAYWCEQLGVGDSRFAPREQPVADTSHPGIAVNLAACIQCNRCLRACREIQVNDVIGYAHRGAESKIVFDLDVGMGTSSCVGCGECVQACPTGALAPALSLSLFDAVDGGDASAPNPIPTPTLPLKGRENIGPSLQSLPSRSHLKEREQATYTPTRQIHSLCPYCGVGCQVTYHVAGEGAAQKIVFAEGRDGPANAGRLCVKGRYGFSYSRNRERLTVPLIRKPGIPKGVNLDPANPLAAFREASWEEALDFAAGGLARIKREHGPQALAGFGSAKGSNEEAYLFQKLVRTGFGTHNVDHCTRLCHASSVAALLEGIGSGAVSNPVRDVEIADLAIVIGANPAANHPVAASFIKNAAERGMKLVMMDPRQTPLARHAWRVLQFRPDADVALLLSMACVIIEEGLIDADFIARRTEGFDAFREAALQYPPERMATITGIAADTVREVARAYARGPNSIIFWGMGVSQHTHGTDNVRCLIALALMTGQIGRAGTGLHPLRGQNNVQGASDAGLIPMMLPDYQKVADPAVRARFEALWGQPLPTEPGLTVVEIMDAACAGRIRGMYIEGENPAMSDPDLGHAREGLANLEHLVVQDIFLTETAMLADVVLPASSLYEKTGSFTNTDRLVQLARPVLPLPGEARQDWWIIQQMAQRLGLAWDYAGPDEVFAELTRAMPSYAGITWAVLEDAGAVVAPKAAVDQPSQPVLFQADFPTASGRGRFVPATPLPAAELPDSEFPMVLITGRVLEHWHTGSMTRRADVLDALDPVPWCGMHPADLARLGVASGGRVVLETRRGHIELEARADEGVQPGSVFMAFCYVEAAANLLTQPALDPFGKIPEFKYCALRVGVPVGA

SEQ ID NO: 15303 - protein, 400 aa, Campylobacter jejuni RM1221
MFDEIRFNTIERLPNYVFAEVNAIKMAARRAGEDIIDFSMGNPDGKTPQHIIDKLCESANKDKTSGYSTSMGIYKLRLAICNWYKRKYNVNLDPENEVVATMGSKEGFVNLARAIINPGDVAIVPTPAYPIHTQAFIIAGGNVAKMPLAYNEKFELDENQFFENLHKTLNESIPRPKYVVVNFPHNPTTVTCEKSFYERLIATAKKERFYIISDIAYADLTYDDYKTPSILEIEGAKDIAVETYTLSKSYNMAGWRVGFVVGNKRLVSALKKIKSWFDYGMYTPIQVGATIALDGDQTCVDEIRATYDKRMHILLEAFENAGWKLQKPRASMFVWAKLPESKRHLKSLEFSKQLLQRASVAVSPGVGFGEAGDEYVRIALIENENRIRQAARNIKKYLKE

SEQ ID NO: 15304 - protein, 518 aa, Pichia angusta
MLRTSLRSLAKPASRVSLRYYSSYPLSTTVTLPNGKSYEQPTGLFINNEFVPSKQHKTFEVINPATEEEICHVYEARKEDVDVAVDAAEKAFKGSWSTADPAIRGKALWNLAELLEAHKDTLAAIESLDNGKALQLAQGDVALVINYIRSCAGWADKLTGQYIDTGDTHHTYTKREPIGVCGQIIPWNFPLLMWSWKVGPALAAGNTVVLKTAESTPLSALYASQLVKEAGIPAGVVNIVSGFGKITGDAIASHPKIKKLAFTGSTATGRHIMKVAADSNLKKVTLELGGKSANIVFDDADVKTAISALVAGIFYNSGEVCSAGSRVFVQEGIYEEILREFKAAAETLKVGDPFDLSTFQGAQTSQMQLNKILGYVDIAHQEGGRLITGGERLGNKGFFVKPTIFADVTPDMRAYKEEIFGPFAVITPFKTADEVIELANDSEYGLAAGVHTKSLDTATYVSNKLEAGSVWINTYNDFHQMVPFGGYKQSGIGREMGAQALDNYTQWKAVRIGLQKPT

SEQ ID NO: 15305 - protein, 445 aa, Glycine max
MATIKAVKARQIFDSRGNPTVEVDVILSDGSFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENQEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 15306 - protein, 507 aa, Zea mays
  misc_feature (179)..(179): Xaa can be any naturally occurring amino acid
  misc_feature (187)..(187): Xaa can be any naturally occurring amino acid
  misc_feature (331)..(331): Xaa can be any naturally occurring amino acid
MPPAPPPQQPKNRSRVPTPTGENRRPQRRMESRNASERAAFFARREAAAVLRRVLRGDATRRAAGSIKSLVYSPTVRNKRATFALVCQTLKYLPILKEVLASSEILSSKWKKQEELVYVTTYDILFGQGIAVSGSVEQLIMLQKDSLRTTLDKVCARKRVRCVEDLLSNKSAVKPKPRXLRVNTLKXTTESVIEELNKMHMVDKDEMVPDMLVLPPGTDLHNHPLVTDGKVFLPWRASCMVAVALCPLPGWKVIDACAAPGNKTVHLAALMNGEGSIIACELNKERAKTLQHTVRRSGANNIRIVNGDFLEVDRNDPSYAEVCRYLHFYWXHAILLDPSCSGSGISTERLDYLLPSHSRDSQDDAGTSSRVMKLSAFQKKALSHALSFPSVERVVYSTCSIHQAENEDVINSVLPLATSLGFELATPFPQWHRRGLPVFQGSEHLLRTDPEDGLEGFFIALFVRKAGPTSEEPSEDATVEVRTKQVRGRRNGVRAFSSLRLSRMILW

SEQ ID NO: 15307 - protein, 1312 aa, Arabidopsis thaliana
  misc_feature (48)..(48): Xaa can be any naturally occurring amino acid
MDPTNSRHGASFEFSTRRFTLSTFGQNAPSLYVTTVYNSAIIYPVKHXPRVYLPSNPTPLIPLLRIALKTTFSFSHLQTSLSLLWSAILLSSSSQILSPSKKILKMPSTPTTPTTTTPITASYWCYSCTRFVSVWADQGTTTVGSVACPHCDGGFIEQINDSSSAATELTIPASTEVRSINNNRRSVIRRRRSGRRPSFNPVIVLQGGAGEREEGEEGDAARDRRAFEFYYDDGSGSGLRPLPDSVSEILMGSGFERLLEQLSQIEASATGIGRSGNPPASKSAIESLPRVEISDCHIGSEANCAVCTEIFETETEAREMPCKHLFHDDCIVPWLSIRNSCPVCRFELPSEPNRRSNNNEEDNAVGMTIWRLPGGGFAVGRFNAAMRDGERVLPVVLTEMDGGGIGNSQDGPRRISWVRSHGTLESDSNGTGSGSGSGGRLRRMVRGMVSLMRRVRPNRSSSSSSAAISTSSDNLDLNIEVESRVLDRENKKKRRKVARIDGEVAKFEFEFNSKFFLFQKPLGIRQEEHIMMTKNSIEFDPYIERKAFDETKQGVKGLVDAKITEVPRIFHHRQDILTNKKPSASVSDLEIPIIDFASVHADTASREAIVEKVKYAVENWGFFQVINHSIPLNVLEEIKDGVRRFHEEDPEVKKSFFSRDAGNKKFVYNSNFDLYSSSPSVNWRDSFSCYIAPDPPAPEEIPETCRDAMFEYSKHVLSFGGLLFELLSEALGLKSQTLESMDCVKTLLMICHYYPPCPQPDLTLGITKHSDNSFLTLLLQDNIGGLQILHQDSWVDVSPIHGALVVNIGDFLQLITNDKFVSVEHRVLANRQGPRISVASFFSSSMRPNSRVYGPMKELVSEENPPKYRDITIKEYSKIFFEKVILTAKPPHQSPILFLNTPPAEADPGFPREAPSVFSLNQPPKGAVQQICFSTVITIYRKEVRNSKMAKNSVEFDRYIERKAFDNTKEGVKGLIDAKITEIPRIFHVPQDTLPDKKRSVSDLEIPTIDFASVNVDTPSREAIVEKVKYAVENWGFFQVINHGVPLNVLEEIKDGVRRFHEEEDPEVKKSYYSLDFTKNKFAYSSNFDLYSSSPSLTWRDSISCYMAPDPPTPEELPETCRDAMIEYSKHVLSLGDLLFELLSEALGLKSEILKSMDCLKSLLMICHYYPPCPQPDLTLGISKHSDNSFLTVLLQDNIGGLQILHQDSWVDVSPLPGALVVNVGDFLQLITNDKFISVEHRVLANTRGPRISVASFFSSSIRENSTVYGPMKELVSEENPPKYRDTTLREYSEGYFKKGLDGTSHLSNFRI

SEQ ID NO: 15308 - protein, 547 aa, Ralstonia solanacearum GMI1000
MPILSLHNMHDKVLILDFGSQVTQLIARRVREAHVYCEIHPNDVSDAFVREFAPKAIILSGSHASTYEDQDLRAPQAVWDLGVPVLGICYGMFAMTVQQGGKVEASAHREFGYAEVRAHGHTRLLDSIEDFRTPEGHGMLKVWMSHGDKVTEMPPGFKLMASTPSCPIAGMADEARGYYAVQFHPEVTHTVQGRALLERFVLEIAGAKPDWIMRDHIEEAVKSIREQVGDEEVILGLSGGVDSSVAAALIHRAIGDQLTCVFVDHGLLRLNEGQMVLDMFEGRLHAKVVHVDASEQFLGHLTGVTDPEAKRKIIGREFVEVFQAEAKTLTNAKWLAQGTIYPDVIESGGAKTKKATTIKSHHNVGGLPETLGLKLLEPLRDLFKDEVRELGVALGLPPEMVYRHPFPGPGLGVRILGEVKREYADLLRRADAIFIEELRGTKATAQDAVAGLCTEDQVGKSWYDLTSQAFAVFLPVKSVGVMGDGRTYDYVVALRAVQTTDFMTAHWAHLPYALLGRVSNRIINEVRGINRVVYDVSGKPPATIEWE

SEQ ID NO: 15309 - protein, 646 aa, Coprinopsis cinerea okayama7#130
MPTVAVDKADLWERLGKEYTTEEFDKLCFEYGLELDEDTTEEVEEAIKKGLSAERPVSIPYLSDLDQELTPVQQLKIEIPANRYDLLCIEGISRALNVFLGRAEAPKYRLVYPKGGESELLTTTIDPATAQIRPLFACAVLRNVKFTPRSYASFMDLQDKLHQNICRRRQFVAIGTHDLDTLTPPFRYEARPPKDIKFAPLGKTQEYTAEELMTLYESEKHLARYLHIIRDSPVYPIIYDSKDTVLSMPPIINSEHSKITLNTRNVFIDVTATDQTKLDIVVNMVATMFSEYCEEPFTIEPVKVVLPNGQTKITPDLSGRDMVAHASYVNSCTGLNLSTKEVAKLLTQMSLETSLSSENADVINVHIPATRPDILHECDIMEDAAIAYGFNNLPDKFPATSTVAQPLAISKLSDVIRLEWALAGWIEVLPLILCSHEENFEWLNHKDDGNTAVKIANPKTLEFQVVRTTLIPGLLKTIRENKTHALPIKVFETSDVVFKDTTRERQARNERHAAAVWCNKTAGFEIVHGMLDRAMKMLEIPRIGSQEDDKPTGYYIKETSDEMYFPGRAATIYYRPPPNHPQRLASQIKDKVESALGAKHDIAIGSLGILHPSVLEKFEINFPCSALEFSLEPFKKQMQKIWTNEE

SEQ ID NO: 15310 - protein, 335 aa, Pseudoalteromonas tunicata D2
MAKQIITVIKGDGIGPSIIDSALEILNAAGCDFEYEFVDAGLTALENTGELLPQATIDAIAKNKITLKGPLTTPVGEGFTSINVTLRKKFNLYANVRPVVSFEGTKARYEDIDIITVRENTQGMYSGLGQVVSEDGSEAEAMSKITREGAQKIAVFAYELARRENRKKVTIVHKANILKSTSGLFLKVAREVAALYPDIETAEMIVDAACMKLVMTPEEFDVIVTTNLFGDILSDLCAGLVGGLGMAPGANIGEDAAIFEAVHGSAPDIAGKNLANPTSVILASIQMLEHLGMGDTAERIRNAVADVIKTGDRTTRDLGGNHGTTDFTQAVIERL

SEQ ID NO: 15311 - protein, 595 aa, Solanum tuberosum
MDVRRRSEKPVYPSKVFGADEKPLKPHNNQQQEDNNTLLIDASDALPLPLYLTNGLFFTMFFSVMYFLLSRWREKIRNSTPLHVVTLSELGAIVSLIASVIYLLGFFGIGFVQTFVSRGNNDSWDENDEEFLLKEDSRCGPATTLGCAIPAPPARQISPMAPPQPAMSMVEKPSPLITPASSEEDEEIINSVVQGKFPSYSLVIQLGDVSAAASLRKEVMQRITGKSLEGLPLEGFTYESILGQCCEMPIGYVQIPVGIAGPLLLNGKEFSVPMATTEGCLVASTNRGCKAIYASGGATCIVLRDGMTRAPCVRFGTAKRAAELKFFVEDPIKFETLANVFNQSSRFGRLQRIQCAIAGKNLYMRFVCSTGDAMGMNMVSKGVQNVLDYLQNEYPDMDVIGISGNFCSDKKPAAVNWIEGRGKSVVCEAIITEEVVKKVLKTEVAALVELNMLKNLTGSAMAGALGGFNAHASNIVSAVFIATGQDPAQNIESSHCITMMEAVNDGKDLHISVTMPSIEVGTVGGGTQLASQSACLNLLGVKGANREAPGSNARLLATVVAGSVLAGELSLMSAISAGQLVNSHMKYNRSTKASS

SEQ ID NO: 15312 - protein, 208 aa, Zea mays
MRTAHGPATGVTPPSKASAPDGAAPPIAVRRTRPRNLFSSSKVTALYSIEMAMGLINANPIIHEKKERRIRQAPETTDENAAESIDQLEIFDHIRDIKDPEHPYSLEQLNVVTEDSIELNDESNHVRVIFTPTVEHCSMATIIGLCIRVKLVRSLPPYYKVDIRVAPGSHATEAAVNKQLNDKERVAAALENPNLLDMVEECLSPTFD

SEQ ID NO: 15313 - protein, 155 aa, Humulus lupulus
IDTTLIGKSFPPTEGAFRGDIRAFIDPIIGHLVWAKTPLLANIYPYFSHKDNPGSVSLQYALFTSPNVVVWDKGLGYQNLFDAILDALYSSLEGAWGGSLDVVVSESGWPSAGGFATSDENARTYLSNLIRHVKKGTPKRPNKPIETYIFAMFNH

SEQ ID NO: 15314 - protein, 118 aa, Glycine max
  misc_feature (103)..(103): Xaa can be any naturally occurring amino acid
  misc_feature (111)..(111): Xaa can be any naturally occurring amino acid
  misc_feature (114)..(114): Xaa can be any naturally occurring amino acid
GELRSGRTRSPRAPWPVPVAPSASSSRAFFGAFLPPAAAGPPKVSLALYYESLCPYCSRFIVTRLAGIFDSGLIHAVDLLLVPYGNAHVHGANNTISCQHGPXECLLNNVXACXIDAW

SEQ ID NO: 15315 - protein, 568 aa, Arabidopsis thaliana
MNLSADQAPVTAVDELAPPSQPHRLSTSCDLHPEERFSGFCPSCLCDRLSVLDHNAAPPPSSSSRKPPSISAVSLKALFKPSSSGTNNSNGNGRVRPGFFPELRRTKSFSAKNNEGFSGGFEPQRRSCDVRLRDDERNLPINEAASVDKIEEEARESSVSEIVLEVTEEAEIEEDEENGEKDPGEIVEEKSSEIGEEEEELKPMKDYMDLYSQTKKPSVKDFAGSFFSAASVFSKKLQKWKQKQKVKKPRNGVGGGRPQSEIGVGRRSSDTDPRFSLDAGRFSVDIGRISMDDSRYSLDEPRASWDGHLIGRTTAARVPLPPSMLSVVENAPLNRSDMQIPSSPSIKPISGDSDPIIIIPGGSNQTRDYYTGPPSSRRRKSLDRSNSIRKIVTELEDVKSVSNSTTTIDSNSMETAENKGNQNGDKKSRRWGKWCILGFIYRKGKDDEEEDRYSRSNSAGMVERSLSESWPEMRNGEGGGPKMRRSNSNVSWRSSGGGSARNKSSRYSSKDGENGVLRFYLTPMRRSWKTSGGSGGGGGGGGGGGWEKTAAKANSHGHSIARRVMRLY

SEQ ID NO: 15316 - protein, 555 aa, Coccidioides immitis RS
MWLREYGESVRHRGPDWSGNFVSNNTILAHERLSIVGVESGAQPLVNDDETLALAVNGEIYNHRILRKGLKTQYKFKTHSDCEVIIPLYMEHDIDAPKFLDGMFSWVLFDKKQNRVIAARDPIGITSFYQGWSSQTPGAVYFASELKSLHPVCDKIISFPPGHVYDSKTDTMTRYFQPKWWDPTNVPSTPIDYKLIRESLVRSVRKRLMAEVPYGVLLSGGLDSSLVASIAQRETQRMMVAQNGTVTNGESGAGLVGIDDSNELSTVTSFPQLHSFSIGLPGAPDTKAALEVANFLGTKHYAFTFTVDDGLNALSDVIYHLETYDVTTIRASTPMYLLSRKIKAMGVKMVLSGEGSDEIFGGYLYFHAAPDKKAFHEETVRRVKNLHLADCLRANKSTSAWGLEARVPFLDKQFLEVSMGVDPQEKMITKERIEKYVLRKAFDTSDEPETKPFLPDNILWRQKEQFSDGVGYSWIDALRDNAELQVTDEMMKNPKPEWGDDIPDTKEAYWYRMMFDEHFPPCCASTVMRWTPTWSKQTDPSGRAISTHVAKYDHA

SEQ ID NO: 15317 - protein, 319 aa, Medicago truncatula
MDPTNNQFNTQNSSDYPFNYQNPNNYQHPNQFSNQHPQNPNQFPNQNPQNMSNFGFASNFNHPSSVPNNFNPYFRSMMGYPSQTPPFNGYMPMVNENFQSVGEYPEFSSQINRGGMTRDNEVAPTPEDTTPKSKRNQQPSWNTEQNLVLISGWIKYGTCSVVGRNQTSEAYWGKIVEYCNEHCSFDSPRDVVACRNRFNYMNKLINKWVGAYDSAKRMQGSGWSEDDVLTKAQKLYACGKNVQFTLKEEWRALRDQPQYSSQMGGNVDSGSSVSKRSYEDSVGSSARPMGREAAKKKVKRKARTRHWRRWKMSGFNSKN

SEQ ID NO: 15318 - protein, 250 aa, Triticum aestivum
  misc_feature (232)..(232): Xaa can be any naturally occurring amino acid
MLALHTVRTSLPSPRRSSPRRHALHLSKRRFSICACSSEDAGSDGPLPHGGDQRQQEVLAKIAMLQTQKVRITNFLDERSAYLTKFTKDADTEFDMIGQNAMKELDQIGDQIMERLDSKMQSYEETAEMQRQEIEMNERVLEDFEDWIEEEKNEGMFFKSLGKVKKPQNNEEIKVKARIEAQKVKEIAEESAGSKARMNIYLALTAILGLTIANAVFATPEVEWRKVAALGXIFMGRVAQVSLTQKFPRR

SEQ ID NO: 15319 - protein, 613 aa, Oryza sativa
MILCRCPFLASARSHTCSLSTVAVAAAVRRGDLTGAEEAFASTPRKTTATYNCLLAGYARALGRLADARHLFDRIPTPDAVSYNTLLSCHFASGDADGARRLFASMPVRDVVSWNTMVSGLSKSGAVEEAKAVFLAMPVRNSVSWNAMVSGFACSRDMSAAEEWFRNAPEKGDAVLWTAMVSGYMDIGNVVKAIEYFEAMPVRNLVSWNAVVAGYVKNSHADDALRLFRTMVREANVQPNASTLSSVLLGCSNLSALGFGKQIHQWCMKLPLSRNLTVGTSLVSMYCKCGDLSSACKLFGEMHTRDVVAWNAMISGYAQHGDGKEAINLFERMKDEGVEPNWITFVAVLTACIHTGLCDFGIRCFEGMQELYGIEPRVDHYSCMVDLLCRAGKLERAVDLIRSMPFEPHAYAYGTLLAACRVYKNLEFAELAAGKLIEKDPQSAGAYVQLANIYAGANQWDDVSRVRRWMKDNAVVKTPGYSWIEIKGVMHEFRSNDRLHPQLYLIHEKLGQLAERMKAMGYVPDLDFVLHDVDETLKVQMLMRHSEKLAISFGLISTAPGMTLRIFKNLRVCGDCHNAAKVISKIEDREIILRDTTRFHHFRGGHCSCGDYW

SEQ ID NO: 15320 - protein, 764 aa, Kalidium foliatum
MGVVLLPDLGTEIIVPACAVIGIVFSLIQWYIVSQVKLSPDSGLGNNSKNGIAESLIEEKEGLNDHSVVAKCAEIQNAISEGATSFLYTEYQYVGIFMVAFAVLIFLFLGSVEGFSTSSQECTYDKTRRCKPALATAIFSTVSFLLGAVTSLASGFLGMKIATYANARTTLEARKGVGKAFIVAFRSGAVMGFLLAANGLLVLYIAILLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTAMLYPLLVSSVGILVCLITTLFATDFFEIKAVKEIEPALKKQLIISTAIMTVGVAIVTWVALPPSFTIFDFGSQKEVRNWQLFLCVAVGLWAGLIIGLVTEYYTSNAYSPVQDVADSCKTGAATNVIFGLALGYKSVIIPIFAIALSIFVSFSFAAMYGIAVAALGMLSTIATGLAIDAYGPISDNAGGIAEMAGMSHRIRERTDALDAAGNTTAAIGKGFAIGSAALVSLALFGAFVSRASISTVDVLTPKVFIGLLVGAMLPYWFSATTMKSVGSVALKMVEGVRRQFNTIPGLMEGTAKPDYANCVKISTDASIKEMIPPGALVMLTPLIVGTLFGVETLSGVLAGSLVSGVQIAISASNTGGAWDNAKKYIEAGSSEHARQLGPKGSDAHKAAVIGDTIGDPLKDASGPSLNILIKLMAVESLVFAPFFATHGGLLFKIF

SEQ ID NO: 15321 - protein, 334 aa, Pseudomonas aeruginosa UCBPP-PA14
MTSQINRQYQLAQRPSGLPGRDTFSFVETPLGEPAEGQILVKNEYLSLDPAMRGWMNDARSYIPPVGIGEVMRALGVGKVLVSKHPGFQAGDYVNGALGVQDYFVGEPKGFYKVDPSRAPLPRYLSALGMTGMTAYFALLDVGQPKNGETVVISGAAGAVGSVAGQIARLKGCRVVGIAGGAEKCRFLVEELGFDGAIDYKNEDLAAGLKRECPKGIDVFFDNVGGEILDTVLTRIAFKARIVLCGAISQYNNKEAVRGPANYLSLLVNRARMEGMVVMDYAQRFPEGLKEMATWLAEGKLQSREDIVEGLETFPETLLKLFSGENFGKLVLKV

SEQ ID NO: 15322 - protein, 308 aa, Bacillus cereus ATCC 10987
MKEVLEVLPKTMKQLVENCKQYDALEEIRVRIGRPLECIAHGEVFFYDYIVTADDAIYLLNKLSHFSIYTMEEELKRGYVTLRGGHRIGLAGKVITEKSTVKMIRDVSSFNIRIARQKIGIAEPLLPYLYESRWLNTMVIGPPQTGKTTLLRDVARCMSQGVSTSKIPSCKVGIVDERSEIAGCVKGIPQYDFGTRVDVLDACPKAEGMMMMIRSMSPDILIVDEIGRKEDSEAIMEAVHAGVQLFISAHGFSYDDVVKRPSLKAVLELGIFDRFVELSKARGPGTVMQVKDKYGKPVLPHRKAESVC

SEQ ID NO: 15323 - protein, 788 aa, Lotus japonicus
MRDMHKSGSGSRNSTGSSNNGSSSGSGGSIRPPALRLSSPQQTLRRLGLCSQIATGEQTSPVVFPEKRGRVRGSRRSSEVSGNSRPDEQDAVVKNFEHRIDIGGGVGGGGGGGDEKSDLLGYVVFSGKLLFDKRKAAVNKNDDAQQGSSDITKQGAVDAKLTSKALLWGSKVLHLDDVISVSYNVGFRHFTVHSYPMNKASCGLSCFIKSRRSRKDFRFVASNVEEALQWVGGFADQQCFVNCLPHPLGSSKKQASQELLRTDMPPELIFRCKTPPRMLVILNPRSGRGRSSKVFHGIVEPIFKLAGFRLEVVKTTSAGHARSLASSVDISTCPDGIICVGGDGIINEVLNGLLSRDNQKEGISIPIGIIPAGSDNSLVWTVLGVRDPVSAAIAIVKGGLTATDVFAVEWAQTNKVHFGLTVSYYGFVGDVLELSEKYQKRFGPLRYFVAGFLKFLCLPRYSYEIEYLPASKTEREGKLSGEREVVDMSDLYTDIMGRTNKEGMPRASSLSSIDSIMTPSRMSGGDLDTCSSTHASTEPSELVRGLDPKSKRLSSGRSNVTAEPEVIHPQLPLSTTPNWPRTRSKSRNDKGWTGLTTTHDTSKWGNTTTNDREDISSTLSDPGPIWDAEPKWDAEPTNWDVENPIELPGPSDDAEVGSTKEVVPHFGDKWVVSKGQFLGILVCNHACRTVQSSQVVAPKAEHDDNTLDLVLVHGNGRLKLIRFFVLLQMGRHLSLPYVENIKVKSVRIKPGKHTHNGCGIDGELFPLNGQVISSLLPEQCRLIGRFRI

SEQ ID NO: 15324 - protein, 400 aa, Zea mays
MVQQPRINSAIVSAIRAARMSKNTNPAAAGSSAGSHHYIQNVDRPDRAYTTERAKRGGKANASSGQIFVTTAPDHFGPILAEHDPRRNTGVRVGETWEDRLECRQWGAHLPHIAGIAGQSRFGAQSVALSGGYEDDEDHGEWFLYTGSGGRDLSGNKRTNKEQGFDQTFVKMNEALRQSCLRGYPVRVVRSHKEKRSSYAPELGVRYDGIYRIEKCWRKIGVQGTFKVCRYLFVRCDNEPAPWTSDDHGDRPRPLPNIPELKDATDINERDERPSWGYDEKEGRWKWMYEPPTSRKPVRTGLRPKTGKQARKRARSDEMPNDPEKLLNEFSCCICFQVMAEPLTAPCGDSFCKACLLGAYDNQSSVRERSCGGRTLRAQKIVKTCPSCPTDICDFLENPQ

SEQ ID NO: 15325 - protein, 906 aa, Methylococcus capsulatus str. Bath
MKKRVYAFSEGDGKNKRLLGGKGANLCEMTQIGLNVPPGFVITTEACLEYLADKKLPAGLMDEVREHMARLERATGKRFGDPANPLLVSVRSGSALSMPGMMDTILNLGLNHDTLQGLIRQTGNERFGHDAYRRFIQLFGKVALGVPDELFDAEFEAIKHQAGVAADIGLSAVHLADIGERFLAVVRRHTGKPFPEDVYEQLEIAIRAVFDSWMGKRAVDYRREFHITPDQANGTAVNVVTMVFGNMGDDSATGVGFTRNPGTGENEMFGEYLVNAQGEDVVAGIRTPKPVHEMATEMPALYAQLVELRDKLEAHYHEVQDFEYTIEKGVLYCLQTRNGKMNAQAMVRTSVEMCREGLITRDQALLRVNPAHLEQLLHPCLDTSHNPTPLAQGLPASPGAASGRCVFDADQAELLGRAGEKVILVREETKPEDIHGFFAAQGILTSRGGKTSHAAVVARGMGKACVAGAEGIRVDSRARLATVGEVTLHEGDIITIDGSTGRVYLGAIPTIAPTFSEHLRTLLSWADEAAHLKVKANADTPEAAKEAREFGAVGIGLCRTERMFNASDRLPVVVEMILAPDVEERKAALDKLLPMQRCDFQAIFTLMAPYPVTVRLLDPPIHEFLPDEHSLADEIDALRQFRRVAKGRAAALSALGQAVETDGVGEDAVAAVIARKERLLAKVRELHEINPMLGHRGVRLGITFPEIYEMQIRAVLEAAAECVEAGVAAAPEIMVPQVVDGAELERVRAMVDRLRQEIEASHGVRLDFKFGSMVETVRACVSADGLARTAEFFSFGTNDLTQATWSFSREDAENKFLPQYIGSGILEDNPFEVLDVVGVGAMMRMAVEKGRSVRPDLEIGICGEHGGHPGSIRFCDGIGLSYVSCSAPRVPVARLAAAHAALLNGG

SEQ ID NO: 15326 - protein, 289 aa, Oryza sativa (japonica cultivar-group)
MPSEFVAARKKPPVEIRRVWAHNVEEEFRIIRNAIDHFPYVSMDTEFPGVIHRPTKHPALLTAGDRYDLLRRNVDALHLIQVGITLAASPTAAPALAFEINLSDFDQRVHRHAAESVQLLAEHGVDLAAHRRHGVRASALAPLLMSSGLVCSHGAVKWVTFHSAYDFAYLVKLLMGRKLPRSMAEFLNLVRVFFGDEVYDVKHMMRHCGGELYGGLERVAAALQVKRAAGRCHQAASDSLLTWDVFRRMRELYFLKHGVEAYQGVLFGLELDMDMPSNKTPSLPLVAAR

SEQ ID NO: 15327 - protein, 361 aa, Oryza sativa
  misc_feature (211)..(211): Xaa can be any naturally occurring amino acid
  misc_feature (216)..(216): Xaa can be any naturally occurring amino acid
MECSISRTNLNCISLGDPDTKKSVALLKQACLDSGFFYVVDHGISQELMDDVFAQSKKFFDLPINEKMELLRDEKNRGYTPMLDEILDPENQVNGDYKEGYYIGIEVPEDDPQANRPFYGPNQWPSDEVLPRWRKVMEQYHSEALRVAKSIARIIALALNLEEDFFDEPEMLGEPIATLRLLHYEGGQKTGHAFLPFSILLHKKHNEFCRXCSFFXSGKVSNPAEGVFGAGAHSDYGLITLLATDDVVGLQICKDRNAQPQVWEYVAPVKGGFIVNLGDMLERWSNCIFRSTLHRVVLDGRERHSIAFFVEPSHDCVVECLPTCKSESNPPKFPPITCSAYLSQRYKDTHADLTAYSSNKA

SEQ ID NO: 15328 - protein, 438 aa, Aspergillus oryzae
MPITKIHARSVYDSRGNPTVEVDVVTETGLHRAIVPSGASTGQHEAHELRDGDKTHWGGKGVLKAVENVNKTIAPAVIEENLDVKDQSKVDEFLKKLDGSANKSNLGANAILGVSLAIAKAGAAEKGVPLYAHISDLAGTKKPYVLPVPFQNVLNGGSHAGGRLAFQEFMIVPSAAPSFSEALRQGAEVYQKLKTLAKKKYGQSAGNVGDEGGVAPDIQTAEEALDLITEAIEQAGYTGKMKIAMDVASSEFYKADVKKYDLDFKNPDSDSSKWLTYEQLADLYKTLASKYPIVSIEDPFAEDDWEAWSYFYKTSDFQIVGDDLTVTNPLRIKKAIETKACNALLLKVNQIGTLTESIQAAKDSYADNWGVMVSHRSGETEDVTIADIAVGLRSGQIKTGAPARSERLAKLNQILRIEEELGNNAIYAGEKFRTSVNL

SEQ ID NO: 15329 - protein, 440 aa, Alnus glutinosa
MAEITHIKARQIFDSRGNPTVEAEVTTANGVVSRAAVPSGASTGVYEALELRDGGSDYLGKGVLKAVDNVNKIIGPALIGKDATEQTAIDIDFMFQQLDGTVNEWGWCKQKLGANAILAVSLAVCKAGASVKKIPLYKHIANLAGNPKLVLPVPAFNVINGGSHAGNKLAMQEFMILPVGASSFKEAMKMGVEVYHHLKAVIKKKYGQDATNVGDEGGFAPNIQENKEGLELLKTAIAKAGYVVIGMDVAASEFYEKDKDITNFKEENNDGSQKISADQLKDLYKSFVDEYPIVSIEDPFDQDDWEHYSKLTAEIGEKVQIVGDDLLVTNPKRVEKAIKEKACNALLLKVNQIGSVTESIEAVKMSKRAGWGVMAHRSGETEDTFIADLSVGLATGQIKTGAPCRSERLAKYNQLLRIEEELGSEAVYAGANFRTPVEPY

SEQ ID NO: 15330 - protein, 467 aa, Listeria innocua Clip11262
MLYSENDKRKHESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKEMSYLGTSTVGSSEACMLGGLAMKFRWRNNAEKRGLDIQAKRPNLIISSGYQVCWEKFCVYWDVDMRVVPMDKEHLSLDVEKVFELVDEYTIGIVGILGITYTGKFDDIALLDEKVEAYNEANEHQLVIHIDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTALYLSKTVEKSGYFEIINDGSNLPIVCYKLKDDLDVEWTLYDLADQLLMKGWQVPAYPLPADLSDTIIQRFVCRADLGYNVAEEFAADFADALHNLEHARVLYHDKERNDSYGFTH

SEQ ID NO: 15331 - protein, 1058 aa, Lactobacillus plantarum WCFS1
MPKRTDIHKIMVIGSGPIIIGQAAEFDYSGTQACLALKELDYEVVLVNSNPATIMTDKEIADQVYLEPITLEFVSQILRKEHPDAILPTLGGQQGLNMAMELSKSGILDELHIELLGTKLSAIDQAEDREQFKALMEELGEPVPASGIARTVDEALAFAKQAGYPVIVRPAFTMGGTGGGIAETPQQLHDITENGLALSPVTQVLIEQSIAGYKEIEFEVMRDAADNAMVVCNMENFDPVGIHTGDSIVYAPVQTLADREVQLLRDAALKIIRALKIEGGCNVQLALDPNSFNYYIIEVNPRVSRSSALASKATGYPIAKMAAKIAVGLHLDEIKNPVTGTTYAEFEPALDYVVCKIPRWPFDKFTHADRRLGTQMKATGEVMAIGRNIEEATLKAVRSLEIGVHHVEEPALRSVDDDVLSDKLIHAQDDRLFYLTEAIRRGYPIDELAELTKINVFFLDKLLHIIEIEQALRTHTDDIETLTVAKRNGFADQTVADYWHETIDQVRDFRLAHKLAPVYKMVDTCAGEFASETPYYYGTYEFENESIVTKRPSVLVLGSGPIRIGQGVEFDYATVHSVKAIQKAGYEAIIMNSNPETVSTDFSVSDKLYFEPLTIEDVLNVIELEKPVGVIVQFGGQTAINLAKPLADHGIKILGTSVADVNRAEDRDEFDKVIKALAIPQPAGDTASDEATALAIADKLGYPVLVRPSYVLGGRAMEIVKKRTDLDYYMHNAVKVSHDHPVLVDSYLVGKECEVDAICDGQTVLIPGIMEHIERAGVHSGDSMAVYPPQSLSAAVQAQIVDYTEKLAIALNCVGMMNIQFVIHDDQVYVIEVNPRASRTVPFLSKVTNIPMAQVATRAILDQSLAEQGYQTGLVTPGPLVHVKAPVFSFSKLNRVDSLLGPEMKSTGEVMGSDVTMAKALYKAFEAAKLHVPSHGNVLLTVRDEDKPETVALAKRFHALGYQLLATRGTATALTTHGLPVTTVDKIDSGERDLLHRMEAGEIQVVINTVSDEEQAENDGTLIRNTSIMHGIPLFTALDTVAAILQVRESQSFVTQAL

SEQ ID NO: 15332 - protein, 446 aa, Lactobacillus plantarum WCFS1
MKEVSAAPKITNVKAAILGFQHLLAMYSGDVLVPLLIGAALHFSQEQLTYLVSIDIFMCGIATFLQLKRTPLTGIGLPVVLGCAVQAVNPLIQIGKTYGLGTMYGSIIGAGIFIFLIAGLFSKIKNLFPPVVTGSLITIIGFTLIPVAFQNLGGGDTSAKDFGNLQALGIGFLTIAIILLISVFARGFMKSVSILIGILVGTLIAGAMGMVSLKPVAEASWFHLPTLFYFGTPHFEWSSILTMILVSLTTMVESTGVFFALGDITGRKIEGDDLKRGYRAEGIAVILGGLFSTFPYSTFSENVGVVQLSGVKTRKPIYFSAAFLVVLGLLPKIGALATIIPDPVLGGAMVVMFGIVGIQGIRMLAQVDFRNNNNLLVAAVSIGLGLGVTVQTNIFQFLPGALQIMLSNGVVVGSVAAVGLNLLFNRHAAENTVDDESVGLNETEQP

SEQ ID NO: 15333 - protein, 190 aa, Zea mays
  misc_feature (27)..(27): Xaa can be any naturally occurring amino acid
  misc_feature (44)..(44): Xaa can be any naturally occurring amino acid
MLLKSAEISNAVASVLSILGPLHTPAXKRNFLKGIQTIKSQVTXGKILFGGSAIESEGNFVQPTIVEITPSAPVVKEELFGPVLYVMKFQTLKEAIEINNSVPQGLSSSIFTKRPDIIFKWLGPHGSDCGIVNVNIPTNGAEIGGAFGGEKATGGGREAGSDSWKQYMRRATCTINYGSELPLAQGINFG

SEQ ID NO: 15334 - protein, 680 aa, Brucella suis
MQEIAEAIREGASAYLTRQYSTIAIVGIVVFLLAWYLLSLNAAMGFLIGAVLSGVTGFIEMHVSVRANVRTAQAVSLSLAGGLELAFKSGAITGLLVAGLALLGVSVYYFVLTVWLGYAPADRTVIDSLVSLGFGASLISIFARLGGGIFTKGADVGGDLVGKVEAGIPEDDPRNPATIADNVGDNVGDCAGMAADLFETYAVTVVATMVLGAIFFHGSDALTNVMLYPLMICGACVITSIVGTFFVKLGVNGSIMGALYKGLIATGLLSIVGLGVANTLTVGWGEIGTVAGKSITGTNLFVCGLIGLIVTGLIVVITEYYTGTNKRPVNSIAQASVTGHGTNVIQGLAVSLESTALPAIVIVGGIISTYQLAGLFGTAIAVTAMLGIAGMIVALDAFGPVTDNAGGIAEMAGLDPEVRKATDALDAVGNTTKAVTKGYAIGSAGLGALVLFAAYSNDLAYFAANGQIYPYFADMGPVSFDLSNPYVVAGLIFGGLIPYLFGGMAMTAVGRAGGAVVQEVRRQFREKPGIMTGKERPDYARAVDLLTKAAIREMIIPSLLPVLAPIVVYFGVLLISGSKAAAFAALGASLLGVIINGLFVAISMTSGGGAWDNAKKSFEDGFTDADGVKHMKGSEAHKASVTGDTVGDPYKDTAGPAVNPAIKITNIVALLLLAVLAHMA

SEQ ID NO: 15335 - protein, 664 aa, Sinorhizobium meliloti
MQEVAGFIREGAQAYLTRQYTTIAIVGVVVFIAAWLLLSGAAAIGFLIGAVLSGAAGFIGMHVSVRANVRTAQAASVSLASDIDIAFKSGAITGMLVAGLALLGVSVYYFVLIVWLGYAPADRAVIDSLVALGFGASLIAIFVRLGGGIFTKGADVGGDLVGKVEACIREDDPCIPATIANNVGHNVCGCAAMAADLFETYAVTVVATMVLASIFFAGAPVLATVMTYPLAICAACIITSIIGTFFVKLGANASIMGALYRGLIVTGALSILGLGAATSLTIGWGSIGTVAGMDITGWNLFLCGIIGLIVTALIVVITEYYTGTNKRPVNSIAQASVTGHGTNVIQGLAVSLESTALPAIVIVGGIIATYQFAGLFGTAIAVTAMLGLAGMIVALDAFGPVTDNAGGIAEMSHLPPEVRKSNDALDAVGNTTKAVTKGYAIGSAGLGALVLFAAYSNDLAYFAANGDKHPYFADVGTISFDLSNPYVVAGLIFGGLIPYLFGGIAMTAVGRAGSAVVEEVRRQFKEKPGIMEGKDRPDYGRAVDMLTKAAIREMIIPSLLPVLAPIVVYFGVLLISGSKASAFAALGASLLGVIVNGLFVAISMTSGGGAWDNAKKSFEDGFVDRNGTRHMKGSEAHKASVTGDTVGDPYKDTAGPAVNPAIKI

SEQ ID NO: 15336 - protein, 478 aa, Ralstonia solanacearum GMI1000
MQQRDTLFINGQWVAPQGKGTIDVIHSTTEAVMGTIPEGSAADAEAAVAAARAAFDGWAATPAPKRAEIIQKIADGLKARSEALAQLIAGEVGMPIKLARAIQVGSPVFNWGHFARLLGAFPFEARVGNSLVVREPVGVVGAITPWNYPLHQITLKVAPALAAGCTVVLKPSEVAPLNAFVLAEVIEAAGLPPGVFNLVTGYGPVVGEVLASHPEVDMVSFTGSTRAGKRVAELASQTVKRVALELGGKSASVVLDDADLAAAVKGTLSACFLNSGQTCSAHTRLLVPRARYEEVKALAKQFAATYVPGDPAQETTRLGPLISAVQRDRVLGYIRKGLEEGAELIAGGPEKPEGVSTGYFVRPTVLGNVKPSDTVAREEIFGPVLTILCYDDEEEAIRIANDSIYGLAGGVWSGDEARAMRVARRIRTGQVDINGGPFNMLAPFGGYKQSGNGREQGQYGLEEFLEYKALQLKPAQAT

SEQ ID NO: 15337 - protein, 207 aa, Triticum aestivum
  misc_feature (100)..(100): Xaa can be any naturally occurring amino acid
MALLATTPLLAPLALSPAPISASQSSLLFLRAPAPALLSLRSASPGARLLAAVASKEPELGGGGSEGGDGAGSGSGGGGGSDPQGGGDEGEEGKMGEGLXPMSQKLTLAYAALVGAGGVMGYMKSGSQKSLAAGGISALLLFFVHTQLPVRPVFASAIGLGISAALLSVMGSRFKKSGKIFPAGVVSLLSLVMVGGYAHGIMRSSHA

SEQ ID NO: 15338 - protein, 149 aa, Zea mays
FYDRSAPIYTQPRHLPPSKVLDADVTDSVIGEGCVIKNCKIHHSVVGLRSCISEGAIIEDTLLMGADYYAETEADKKLLAENGGIPIGIGKNSHIRKAIIDKNARIGDNVKILNADNVQEAARETDGYFIKGGIVTVIKDALLPSGTVI

SEQ ID NO: 15339 - protein, 141 aa, Triticum aestivum
  misc_feature (71)..(71): Xaa can be any naturally occurring amino acid
  misc_feature (76)..(76): Xaa can be any naturally occurring amino acid
  misc_feature (79)..(79): Xaa can be any naturally occurring amino acid
  misc_feature (89)..(89): Xaa can be any naturally occurring amino acid
  misc_feature (94)..(95): Xaa can be any naturally occurring amino acid
  misc_feature (100)..(100): Xaa can be any naturally occurring amino acid
  misc_feature (109)..(109): Xaa can be any naturally occurring amino acid
  misc_feature (126)..(126): Xaa can be any naturally occurring amino acid
  misc_feature (131)..(131): Xaa can be any naturally occurring amino acid
  misc_feature (133)..(134): Xaa can be any naturally occurring amino acid
  misc_feature (136)..(136): Xaa can be any naturally occurring amino acid
MAPAVMASSATTVAPFQGLKSTAGLPVSRRSSGSLGSVSNGGRIRCMQVWPIEGIKNSKTLSYLPPLSTEXLLKQXDYXIRSKWVPCLXSTRLXXLPFSXNIPPGYYDXPYWTIWKLLCSGCTDAXTSVNXVXXVXKDYPE

SEQ ID NO: 15340 - protein, 397 aa, Prosthecochloris aestuarii DSM 271
MQKKTLSDISCKGKRILMRVDFNVPLDLNGTITNDKRIIEALPSIRQVLETGGRLILMSHLGRPKGKVTPELSLAPVARRLSELLDTDVVMANNCIGTEAMQQALALQDGEVMMLENLRFHPEEEKNDPEFARELASMGEIYVNDAFGTAHRAHASTEGICHYVPISVAGFLIEKELRYLGNALANPERPFLAILGGAKISGKIDVLDNLFDKVDTILIGGAMIFTFFKAQGYQVGTSLVEEDKIELAKHLLEKAAAKNIRMLLPEDVIAASAFSADAETATVPIDSIPETMMGLDIGPKTIDTYSREILKARTIVWNGPMGVFEIDAFATGTIAIAHALADATAKGAISIIGGGDSAAAVMKAGLESGITHISTGGGASLEFLEGKELPGIAALND

SEQ ID NO: 15341 - protein, 187 aa, Triticum aestivum
AVAAALELVDPPGCRPTQRSPQPLLQALEPKLLKSSTEPADQDACSSSSATRRSSAAPPAAKKPRTETPMPTFKVRKEKLGDRVTALQQLVSPFGKTDTASVLHEAIGYIKFLHDQVASLSSPYFIRCSGGPVQLQHKQASDGDAGEAKEDLRSRGLCLVPVASTYTMGSETAAPEFWHPTFGGTFH

SEQ ID NO: 15342 - protein, 364 aa, Pseudomonas syringae pv. phaseolicola 1448A
MNNKKLRIAAIAGDGIGLEVLPEGVRVVQAAAAKHGLELEFEYFEWASCDYYLKHGKMMPDDWFEQLKGFDSIFFGAVGWPEKVPDHISLWGSLLKFRREFDQYANIRPVRLFPGVPCPLANREPDDIDFIVVRENTEGEYSSLGGIMFENTENEFVLQESVFTRRGVDRILRFAFEMASKRERKHVTSATKSNGMAISMPYWDKRTEAMASQYPDISWDKQHIDILCARFVLQPERFDVVVASNLFGDILSDLGPACAGTIGIAPSANLNPERNFPSLFEPVHGSAPDIFGKNIANPIAMIWSGALMLEFLGQGDERFTAAHDEIITAIEQVIASGDVTPDLGGKHSTQEVGAAIAGRVSAAQ

SEQ ID NO: 15343 - protein, 232 aa, Yersinia pestis CO92
MVKFKAIRGVAFDLDGTLVDSAPGLARAIDMALAHQGLPAAGEALVSTWIGNGADVLVERALHWAGREHNAQLVAQTRELFDHYYAKTVEQGSQLFPQVKATLAQLAANGLPIGLITNKPTPFVAPLLTSLGISDYFSVIIGGDDVVVKKPHPAPLYLLLGKLGLHAREMLFVGDSRNDIMAAQAAGCPCIGLTYGYNYGEAIATSHPDCVLAHFADLLPAIGLPSLKDQEV

SEQ ID NO: 15344 - protein, 540 aa, Kluyveromyces lactis NRRL Y-1140
MVDDIVRSSSPQRDSSVEDVYSDLYSTFSQMTTTTANDIEQRPYPFTWRTGIMFVSSTIGGMLFGYDTGVISGVLIAMNPKDLNFHSLEIWQKEIITSITCAGSFIGSIIAFPLADRCGRKHTLTVCCIIFAASSMLMAVSYTFEMLVTGRLVVGIAVGIAAQCIPIYLTEISPAKIRGTMLTLNSISITGGQFAAYVIAYFMIDNDHPQSTAAWRYLFALGSIPAIVFLLTLDFIPESPRWLLSKSRLVEAELALHKVYPAATVPEIRHKLRKLTSDLNKLRYHNDETDPLLFPVNKRRSVASTRTGRSSLGATYYNEQLGKKRHRWEGKSKRALIIGCVLMFFQQTSGFNAFMYYSATIFEQVGFTNPLVPAIIVAFTNFSFTLLAMKLIDTMGKRTLLLMTIWIMTVGLLLCSVGFELNNLALLVVSVIVYVGAYATGMGVVPWSSVEFLPLNRRAVGGSMISCTNWLTNSVLSLTYLTITDRIGNENTMLLFALFTIFNWLFVYIWYPEVKGLSLEEIGQVFENGVDVHFIYRNYH

SEQ ID NO: 15345 - protein, 196 aa, Halobacterium sp. NRC-1
MTDRTAAVTRETAETDVAVTLDLDGDGEHTVDTGIGFFDHMLAAFAKHGLFDVTVRCDGDLDVDDHHTVEDVGIALGAAFSEAVGEKRGIQRFADRRVPLDEAVASVVVDVSGRAVYEFDGGFSQPTVGGLTSRMAAHFWRTFATHAAVTLHCGVDGENAHHEIEALFKGVGRAVDDATRIDQRRAGETPSTKGDL

SEQ ID NO: 15346 - protein, 351 aa, Arabidopsis thaliana
  misc_feature (220)..(220): Xaa can be any naturally occurring amino acid
MQIGQALAAAKEGESQMIVMMGNNLSLTSIILNGDPSIEHKGKLTCLDEQVKISQFYHCEGLLLCILKDDSRFVVCNPYLEQTRWIEPRYSHRPYGMDRFSYALGYVNTDSCRSYKLLRFIDYYYNAPEKQFFWYEVYDFDSDLWTTLDVTPHWRIAFCNTGVPFKGNTYWCAAERNVDVDEVLANRLICFDFTSERFGPLLPLPFSGGHHDYTTLSCVXEEKLAVLLQHDESNPYELDLWITTKIETEEVLWSKFLRVETAGFNSYVPFISGSFFIDEEKKVAFGFDERNRQRVIVIGEAGYLRGLDLVGDFGDQSCKPDLCSYVPSLVQIKQPEGGEREEESEYGEASI

SEQ ID NO: 15347 - protein, 213 aa, Zea mays
MPYAATRTSPQQHSRVASNGRAVAACAGHAGVPDEVARHHEHAVAAGQCCSVMVQSIAAPADAVWSLVRRFDQPQGYKRFIRSCHLVDGDGVEVGSVRELLVVSGLPAENSRERLEIRDDERRVISFRILGGDHRLANYRSVTTVHEAASEGGPLTMVVESYVVDVPPGNTVEETRIFVDTIVRCNLQSLEDTVIRQQAMAAPAAPHNDHNHS

SEQ ID NO: 15348 - protein, 189 aa, Arabidopsis thaliana
MKAPNMETITESLEKSMMNCSLNDRRRRVVGDGFGRSSSNEHMTPISDRTLELNSHLSLPCHWEQCLDLKTGEIYYINWKNGMRVKEGPRKVMNADPDSGDSYGTVCSEEDSSYYDSEESSSESSPSSRENHKEEEEEEEEEEEEEEDVLVVAGCKACFMYFMVPKLVEDCPKCAAQLLHFDRPHSASS

SEQ ID NO: 15349 - protein, 338 aa, Agaricus bisporus
MVKVGINGFGRIGRIVLRNALQFQDIEVVAVNDPFIDLEYMAYMFKYDSVHGRFKGTVEVKNGSFVVDGRPMKVFAERDPAAIPWGSVGADYVVESTGVFTTIDKASAHLKGGAKKVVISAPSADAPMYVCGVNLDKYNPKDTIISNASCTTNCLATLAKVIHDNFGIVEGLMTTVHATTATQKTVDGPSHKDWRGGRGVGNNIIPSSTGAAKAVGKVIPSLNGKLTGLSMRVPTQDVSVVDLVVRLEKPASYEQIKEVMRKAAEGEYKGIIAYTDEDVVSTDFISDNNSCVFDAKAGIQLSPNFVKLIAWYDNEWGYSRRVCNLLQYVAKEDAKAGI

SEQ ID NO: 15350 - protein, 332 aa, Aspergillus nidulans FGSC A4
MKLSVNTCRSCRPTLYSRISYRTTTTTAPSPTTWQSPSQLQIQKVPPLRDLTPGHISYYWDTSTPTKLQLAYADKLFAPSRHSPKKLWSAAKFRTTPLSSIEPEVAFLGRSNVGKSSLLNAVMGKEMCWTSSKPGRTREMNAFGIGGTKGGESKIVLLDMPGYGKASRTEWGVEIMKYLQGRKQLRRAFLLIDSEHGIKPTDAAILSLFRQYAIPHQIILSKVDKLLFNKRPKPTSIPSAAKLTGLRTTLEKLRPVVQPDSRTARTEGPGALGELLTCSADTPIGEGRFLGVSAIRWAIISAAGLDGTVEARAELGHPELLSADSELVGGVA

SEQ ID NO: 15351 - protein, 435 aa, Pseudoalteromonas tunicata D2
MPSYANRYISNLTRETYALILAGGRGSRLHELTDWRAKPAVYFGGKFRIIDFPLSNCINSGIRRVGIATQYKSHSLIRHVNRAWGHFKKELGESVEILPASQRYGDEWYCGTADAVFQNMDIIRHELPKYVMILSGDHVYRMDYGALLAKHVETGADMTVCCIEVPCEEAAGTFGVMTVDNDKRVMRFDEKPADPSEIPGKAGQCLASMGNYVFNTEFLFEQLKKDSERAGSGRDFGHDIIPAIIEEHNVFAFPFSDPSHDSQPYWRDVGTLDSFWEANMELVTPEPQLDLYDARWPIWTYQEQLPPAKFIFDDDDRRGMAVDSTVSGGCIISGSTVRKSLLFSKVHIHSYCLIEEAVLLPGVVIGRHCKIRRAIIDRSCEVPENTVIGFDREQDQANGFRVSNKGIVLVTRDMLIAYVAKQAKREQALEESEVV

SEQ ID NO: 15352 - protein, 589 aa, Burkholderia thailandensis E264
MADSARTVQDSGAAWLGRRAVISSKPWGPRMYQYDQYDQTIVDERVAQYRDQVRRRLSGELSEDEFRPLRLQNGLYMQRHAYMHRIAIPYGNLRSVQLRMLARIAREHDRGYGHFSTRSNIQYNWVKLEETPEILAKLASVQMHAIQTSGNCIRNITADQFAGVAQDEEIDPRPWAEILRQWSTFHPEFAWLPRKFKIAVSGSKADRAAVQIHDLGVYLKKNEAGEVVASILAGGGLGRTPIVGAIIRENLPWQHLLTYCEAALRVYNRFGRRDNLFKARIKILVKALSPAKFSQMVEEEWQHLKDGPSTLTQAEVDRVSQFFQPPAYEKLADTDASFEQHLLENRAFARWVERNVAPHKVPGYAAVTLSLKNHRVAPGDASAEQMEQVADWADAYSFGELRVSHEQNLILANVKKRDLFAVWEKAKAAGFATPNVGLLTDIIACPGGDFCSLANAKSIPIALAIQQRFDDLDYVYDLGDVSLNISGCMNSCGHHHVGNIGILGVDKDGAEWYQVSLGGEQGTGAGGARLGRVIGPSFSAEEVPDVISKLIDTFVESRIDGERFIDTYDRIGIAPFKERVYAARQTAHA

SEQ ID NO: 15353 - protein, 336 aa, Burkholderia thailandensis E264
MTIRVAINGYGRIGRNTLRAFYENGKKHDLEIVAINDLGDAKTNAHLTQYDTAHGKFPGEVSVDGDYLVVNGDKIRVLANRNPAELPWGELGVDVVMECTGFFTSKEKASAHLKGGAKKVIISAPGGKDVDATIVYGVNHDVLKAEHTVISNASCTTNCLAPLVKPLNDKIGLETGLMTTIHAYTNDQVLTDVYHEDLRRARSATHSQIPTKTGAAAAVGLVLPELNGKLDGYAIRVPTINVSIVDLSFIAKRDTTVEEVNAIMKEASEGALKGILGYNDAPLVSIDFNHNPASSTFDATLTKVSGRLVKVSSWYDNEWGFSNRMLDTAIALANAK

SEQ ID NO: 15354 - protein, 469 aa, Idiomarina baltica OS145
MSASKIFDAIKEHDVKFVDLRFTDTKGKEQHVTIPVSQIDDDFFEEGKMFDGSSIAGWKGINESDMVLMPDAESLVLDPFTDEMTLNVRCDILEPDTMQGYSRDPRSIAKRAEEFLQASGVADSAFFGPEPEFFLFNDVRFHTDMSGSFYKIDAEEAKWNSGREYSEGNLAHRPGVKGGYFPVPPVDSAHDIRGTMSLVMEDMGLVVEAHHHEVATAGQNEVATQFNSLTKKADEIQIYKYVVHNVAHSYGMTATFMPKPLVGDNGSGMHVHMSLAKDGQNLFAGDQYAGLSETALYYIGGIIKHARAINAFTNPSTNSYKRLVPGFEAPVMLAYSARNRSASIRIPLVSSAKARRIEVRFPDPSANPYLCFTALLMAGLDGIRNKIHPGDAMDKDLYNLPPEEAKDIPTVCHSLEMALDALDKDRDFLKQGGVMDDDMIDAYIGLKYNEVETLKKTTHPVEFDMYYSV

SEQ ID NO: 15355 - protein, 456 aa, Campylobacter jejuni RM1221
MKAIIDNIKILEQNAINKGLDELILMENAGLNLAKLIKKEAKKIRIQRKIRKVKILFLLGGGNNASDGLVALRNLKHAKAYKIGFKENTLFKKQEQILQNYAFKFCQKEPNFKKFHIIIDCILGTGSNRCLDEKTSLIIQKVNQSKALKIACDIPTNLGFYPCFKADITLCMGALKEILLEDFAKEFVGRIKIANLGIRSKKFYPNSQAFLLEKKDLKTIDRKINANKGNFGHIYIVANASAGTLAGLGALNFGAGLVSLVAQKSFSPLLMLKEKIENNASAIALGMGLENLDFLKDEILQNTPLILDANCFLSEALLWYLNRKDVVITPHPKEFIKLYKMCFDENLDIETLQKNRFFYARKFSQNYDCVLVLKGANPIIVQKEKLFVVNLGNQALAKGGSGDVLSGMIAAHLGFGFSALEAAKNATLAHGLVAKKYKFNKNSFDALKLIKGLKCL

SEQ ID NO: 15356 - protein, 213 aa, Triticum turgidum subsp. dicoccoides
FSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVP

SEQ ID NO: 15357 - protein, 172 aa, Brassica napus
MEQVMIHSSSFLLPSIPADEASAYAIVVLNQKLPRFTPLLWEHAKLRLCADGGANRIYDELPLFFPREDALLIRNRYKPDVIKGDMDSIRPDVLNFYVSLGTKVIDESHDQDTTDLDKCILFIRDSTLNQESCRLQILATGALGGRFDHEAGNLNVLYRYPDTRIILLSDDC

SEQ ID NO: 15358 - protein, 205 aa, Triticum turgidum subsp. dicoccoides
RLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVP

SEQ ID NO: 15359 - protein, 161 aa, Triticum aestivum
  misc_feature (23)..(23): Xaa can be any naturally occurring amino acid
  misc_feature (80)..(80): Xaa can be any naturally occurring amino acid
  misc_feature (84)..(84): Xaa can be any naturally occurring amino acid
  misc_feature (88)..(88): Xaa can be any naturally occurring amino acid
  misc_feature (93)..(93): Xaa can be any naturally occurring amino acid
  misc_feature (96)..(96): Xaa can be any naturally occurring amino acid
  misc_feature (100)..(100): Xaa can be any naturally occurring amino acid
  misc_feature (103)..(105): Xaa can be any naturally occurring amino acid
  misc_feature (116)..(116): Xaa can be any naturally occurring amino acid
  misc_feature (126)..(126): Xaa can be any naturally occurring amino acid
  misc_feature (130)..(130): Xaa can be any naturally occurring amino acid
  misc_feature (138)..(138): Xaa can be any naturally occurring amino acid
  misc_feature (145)..(145): Xaa can be any naturally occurring amino acid
  misc_feature (150)..(151): Xaa can be any naturally occurring amino acid
MAPAVMASSATTVAPFQGLKSTXAGLPVSRRSSGSLGSVSNGGRIRCMQVWPIEGIKKFETLSYLPPLSTEALLKQVDYXIRSXKWVXCLEFXKVXGFVXREXXXSPGLYNGRYWXTCWKLPIFGXRPQXKFSNKVEXVKKGVPXPNVRXXGFKTPRGTTP

SEQ ID NO: 15360 - protein, 501 aa, Glycine max
MENLSNGHLESFVKIPTIKFTKLFINGEFLDSVSGKTFETVDPRTEEVIAEIAEANKEDVDIAVKAAREAFDCGPWPRMPGAERAKIMLKWSELIEQNAEEIAALDTIDGGKLFSWCKAVDVPEASNILRYYVGAADKIHGDVFKTSRDLHLYSLMEPVGVVGHIIPWNFPTVMFFAKVAPALAAGCTMVIKPAEQTPLSSLFYAHLARLAGIPDGVLNVVPGFGSIAGAAISSHMDIDAVSFTGSTETGRKIMQAAALSNLKPVSLELGGKSPVLIFDDADVDKAVDLALFGILHNKGEICVAFSRVYVQEGIYDEFEKKVVEKAKTWVVGDPFDPKVQQGPQTSKAQYDKIISYIEHGKSEGATLLTGGKPAGNKGYYIEPTIFVNVKEDMLIAQEEIFGPVMTLSKFKTIEDAIKKANNSKYGLAAGIVTKNLDIANTVSRSIRAGIIWINCFFAFDIDCPFGGYKMSGFGRDYGLEALHKFLKVKSVATPIYDSPWL

SEQ ID NO: 15361 - protein, 457 aa, Halobacterium sp. NRC-1
MGISPPLTAVSAFGTDVSGNAFIGAGVATLAVLMVLSAFFSSSEIAMFSIPRHRIDALVEEGRSGADAVAALKSDPHRLLITILVGNNLVNIAMSSIATGLFATSMSQGKAVLAATFGVTALVLLFGESAPKSYAVENSESWALSIAKPLQWSERFLYPLVVLFDYLTRAVNQFTGGRAAIESSYVTRSEIQDMIKTGEREGVIEEDEREMLQRIFRFNNTIAKEVMTPRLDVVAVSKTDTIEAAIQTCTQAGHERVPVYDGELDNVIGVVSLEDLVRESLYGETEDAELDDLIEPTLHVPESKNVDDLLQEMQDERVQLVVVIDEFGTTEGLLTAEDITEEIVGEILDGGEDLPIDSVDEDTVRVRGEVNIEEVNEALNIDLPEGEEFETIAGFIFNRAGRLVEEGEAFRFEDIELTVEHVENTRIMKARVQRLDSAAEADANAEVLTADSTGNGA

SEQ ID NO: 15362 - protein, 337 aa, Podospora anserina
MTVKVGINGFGRIGRIVFRNAVEHPDVEIVAVNDPFIEPKYAEYMLKYDSTHGVFKGTIQVSGSDLIVNGKTVKFYTERDPSAIPWKDTGAEYIVESTGVFTTTEKASAHLKGGAKRVIISAPSADAPMYVMGVNEKTYDGKAAVISNASCTTNCLAPLAKVVNDKFGIVEGLMTTVHSYTATQKTVDGPSAKDWRGGRGAAQNIIPSSTGAAKAVGKVIPELNGKLTGMAFRVPTSNVSVVDLTCRLEKPASYETIKAALKEASEGELKGILGYTEDEIVSSDLNGNANSSIFDAKAGISLNDNFVKLVSWYDNEWGYSRRVLDLLSYVAKYDASH

SEQ ID NO: 15363 - protein, 337 aa, Schizophyllum commune
MAVKVGINGFGRIGRIVLRNALQLGNIEVVAINDPFIALDYMVYMFKYDTVHGRYKGTVEVKDGKLVVDGHAITVFAEKNPADIKWGSAGADYIVESTGVFTTVEKASLHLQGGAKKVVISAPSADAPMFVVGVNLDKYDSKYQVISNASCTTNCLAPLAKVIHDKYGIAEGLMTTVHATTATQKTVDGPSHKDWRGGRSVNNNIIPSSTGAAKAVGKVIPSLNGRLTGLAFRVPTLDVSVVDLVVRLEKEASYDEIVATVKEASEGPLKGILGFTDESVVSTDFTGANESSIFDSKAGIAISKSFVKLIAWYDNEWGYSRRVCDLLVYAAKQDGAL

SEQ ID NO: 15364 - protein, 67 aa, Triticum aestivum
  misc_feature (3)..(3): Xaa can be any naturally occurring amino acid
  misc_feature (14)..(14): Xaa can be any naturally occurring amino acid
  misc_feature (41)..(41): Xaa can be any naturally occurring amino acid
  misc_feature (48)..(48): Xaa can be any naturally occurring amino acid
RVXGPEIGYITTPXVLVQCALVLLSQRANLPKGGVYTPGAXFGPTDLXKRLEENGLSFELISTKTLP

SEQ ID NO: 15365 - protein, 333 aa, Triticum aestivum
MAAVGLLGVRPAPATGRLERQARASPDAVSWGWRARARPLRSVPPPGRAGRGGARAARPLRAAMGGGDLYALDFDGVFCDSCGESSLSAVKAAKVRWPWAFEQVDAAMEEWIVEQMHTLRPVIETGYENLLLVRLLVEIQIPSARKSSVADGLSIQEILDNWSKLLPTLMDEWQEDRESLVDLFGRVRDDWLENDLSGWIGANRFYPGTADALKLSSSELYIVTTKQSRFTGALLKELAGVDFPSERIYGLGTGPKVKVLQQLQEMPQHQGLTLHFVEDRLATLKNVIKEPALDKWNLYLVKWGYNTQEEREEAGAISRIQLIDLPDFSKQLK

SEQ ID NO: 15366 - protein, 295 aa, Exiguobacterium sibiricum 255-15
MGYNKDNFLEGTLNDFINFEKVSEGLPKTEDQQPLPYYERDDYRAAGKLKGKVAIVTGGNSGIGRAISIAYTLEGAKIVIAFYGDQEGAEETKARLEELGGEVLLSQGDIGDGAYCEELVKKTIDRFGRLDIVVNNASMQKPEDSLLDITDESMEKTFKTNIFGMMRLARAALPHLTLGSAIINTTSSTAYEGNSLLIDYSSTKGAIVSFTRSLSMNLAKQGIRVNAVAPGPIWTPLITDTFPDESVKTFGKNTPMDRPGQPAEMASAYVFLACNDSSYMTGQVLHLNGGVIVNG

SEQ ID NO: 15367 - protein, 677 aa, Oryza sativa
MLSCSGNMLRAVHVLAIAAAVLTLAPLAASYPWQACNGSSNYTANSAFQRNLGVLAAALPGNASTSPDLLANATVGGAPDTVYALAFCPPIDNQNASGCRACVASAFADARSLCPNNRGAHIIYDGCVLTFSGRDFLGAATNPADMERKLRNTENVTVSDVGEFNGAIYEVLNATADYTAAAARRFGTGEISFDPTYPVIYSMAWCTPDMAPGRCRACLADTIAQMHAYFNPNAQGARLVGVRCAARYEIYPFYTGRGMVQVPVSRPPAVPGTPGKKSKTGKILAIVLPIVAALLASAMICFCCWRRRTKATKLSLSYSSRSEDIQNIESLIMDLPTLRIATDNFAENNKLGEGGFGEVYKGSFPGGQTIAVKRLSQSSGQGIGELKNELVLIAKLQHKNLVRLVGVCLEQEEKLLVYEYMPNKSLDTFLFDPEKRKQIDWAKRFMIIKGITGGLQYLHEDSQLKIIHRDLKASNVLLDANMNPKISDFGLARLFGDDQSQETTNRVVGTYGYMAPEYALRGQYSIKSDVYSFGVLLLEIITGRKNSDSYNSEQAVDLLSLVWEHWAMKTITEMVDPYLRSDSSSLDEILRCIHVGLVCVQEDPMDRPTLSMINIMLDGNTVSAKAPSRPAFFTEMLGNINIGSSMYSQPYPVTDSTAKHSMAMSLNDVTVTEPEPR

SEQ ID NO: 15368 - protein, 251 aa, Coccidioides immitis RS
MMVPDSLPTTKRSTLPADLRAAPVVLPPLMAQGFLPISLKLSVESTGAVSRCLITLICSTVIMGLSLRDVRTLVENEHSRQFKKFIKDNGITSYVMPIIANKDPKIFTSQNTVLEVLRILFNPDNHPVLVHCNKGKHRTGCIIACFRRAQGWSNTAAVAEYIKYSAPKTRVLDRKFIEAFDANRLCELVDRVGAQYWVPSNLSERKDLRSTPGCHLNGNPKEVGECDGASALVLPSDPQQIYGLATCKLPS

SEQ ID NO: 15369 - protein, 665 aa, Zea mays
MTPRLRPRPFQVRGSPAAYLPALFNSPRANNQRGAAPLAPIINNRNARHPWLPYHHHSTGTAAVPPPPPTPTMASTASLQRFLPASPHASSRRRAGRARAAVSIPSSSPPATRDNEVPAERLEPRVEAREGGYWSLKERYRTGLNPHEKVKLEKEPMALFMDGGVRDLAKIPMDVIDAAKLTKDDVDVRLKWLGLFHRRKHQYGRFMMRLKLPNGVTTSEQTRYLASVIEAYGADGCADVTTRQNWQIRGVTLPDVPAILDGLRAVGLTSLQSGMDNVRNPVGNPLAGVDPHEIVDTRPYTNLLSSYITSNSQGNPAITNLPRKWNVCVIGSHDLYEHPHINDLAYMPAVKDGKFGFNLLVGGFISPKRWAEALPLDAWVAGDDVVPACKAILEAYRDLGFRGNRQKTRMMWLIDELGMEVFRSEVEKRMPNGVLERAAAEDLVDKKWERRDYLGVHPQKQEGLSYVGLHVPVGRLQAADMFELARLADEYGTGELRLTVEQNVVLPNVSNRRLDALLAEPLLQRQRLSPQPSLLLRGLVACTGNQFCGQAIIETKARALQVAREVEKRVAVPRPVRMHWTGCPNSCAQVQVADIGFMGCLTKDRDGKVVEAADIFVGGRVGSDSHLADVYRKSVPCKDLVPIVADLLVERFGAVPREREEEDEE

SEQ ID NO: 15370 - protein, 335 aa, Zymomonas mobilis subsp. mobilis ZM4
MPHNRYDIVAIGNAIVDVLAATDDQFLSEKNITKGSMQLIDADSAETLYQEMNPTHEISGGSAANTLVGVAALGGRCAFIGQVANDPLGQVFQQDIRAQNIHFDVPVQEATIPTGRCLILVSPDGERSMNTFLGVAQTLHQTAIKPEVIENAEILYLEGYLWDPEVPRSAMKEAIQIARKAGKKVALTLSDTFCIERHREDFKQLINNGLIDILFANEGELRSLVQHDDLDRGIEEVAAKLPLLVVTKGPDGAIAVQDMERTEVSAKKIDQVVDTTGAGDLFAAGFLAGQARNLSIAASLEMGAIAAAEIISHYGARPENDIKTMIESALNISLN

SEQ ID NO: 15371 - protein, 833 aa, Sphingomonas elodea
MEFLEATAILADASSAEAVRSAETRQHLVVIGNGMAGCRAVEELLARDGTGFRVTIFGAEPHVNYNRIMLSPVLAGEKTFQEIVINDSDWYAQHGIELVAGDPVVAIDRAACTVTAKSGRITGYDKLLIATGSDPFIIPVPGHDLPGVISFRDMADVNVMLAAASEGGDAVVIGGGLLGLEAAHGLTLRGMKVTVLHLMPTLMERQLDEAAGWLLKSALEARGQTILTGADTAAILGDGKVEGVQLKDGRILPAKLVVMAVGIRPSVKLAREAGLAVGRGIQVDDHMVTSDAKVLAVGECVEHDGQCYGLVAPLWDMCRSLADGLVARTNPYRGSVTSTKLKVAGLDVFSAGDFSGGEGCEDIVLRDAARGIYKRVVLKDDRVIGAVLFGDTSDGSWYFDLLKKGEDVAPIRDMLIYGQAFASGGGQPDPKAAVAALSDDAEICGCNGVSKGQVVATINGGACSLDAVRAGCKASASCGSCTGIVETLLALTLGEDGVQSGPKTMCKCTTYSHDEVRRAIVEGAMKSIPEVMQRLHWSTPDGCSSCRPALNYYLLCAWPGEYVDDQQSRFVNERLHANIQKDGTYSVVPRMWGGVTTPAELRAIADVVEKFNAPMVKVTGGQRLDIFGIRKEDLPAVWADLNAAGMVSGHAYAKALRTVKTCVGSEWCRFGTQDSTGLGIKLERGFWGSWMPHKFKMAVSGCPRNCAEATIKDFGVVCVDSGYELHVGGNGGIHVRATDLLVKVATEEEAMHYAAAFVQLYREEARYLERTAPWIERVGLASVKARVVEDEPGRDALAARFWHSQSFSQDDPWAERVAGADAGLHQPLLAAAE

SEQ ID NO: 15372 - protein, 468 aa, Ralstonia solanacearum GMI1000
MAYPPIPVPADAAPSANTAWQARSRAAVWHPCTQNARLDAMPPLPIARGQGPWLIDFDGKRYLDGTSSWWVNLFGHANPHINAALKAQLDMLEHTMLAGATHRPAVELAERLVGLTGGVLGHSFFGSDGASAVEIALKMSFHAHRNAGQGARSRFVCLEHGYHGETLGALGVTDVAIFRDAYDPLILQSHRVASPDARLAGPGETGADVAERALAALRDCLSANAGTIAAVIIEPLVQCAAGMAMHDASYLRGVRALCDQFGVHWIADEIAVGCGRTGTFFACEQAGVWPDLLCLSKGISGGYLPLSIVLSRDAIYDAFNEDAPVRSFLHSHSYTGNPLACRAALATLDLFAEEDVFARNRVTAARIAQGLAPLSHDARFAHLRQAGMITAFDVHPEVAGPRFAERFALTARAHGLLLRPIGHTVYLLPPYVLTDDETDTLVERTLHTLEDTLAQATGAHEGETHAIA

SEQ ID NO: 15373 - protein, 861 aa, Sphingomonas elodea
MSDAVRTTCAYCGVGCGIRATVTGERAVRIEGDPDHPANHGRLCSKGTHLGETIGLEGRLLHPMIGDRRASWDKALDLVARRFREAIAEHGPDSVAFYVSGQLLTEDYYVANKLMKGFIGSANIDTNSRLCMSSAVAGHMRAFGEDVVSGSYADLDAADLIVLVGSNTAWCHPVVYQRIMAARAERGTKLVVIDPRRTETAEEADLHLAVRPGSDVALFNGLLAHCRAEGLADAANLDVPAGFWEALGEGHDLWSTAQTCDLVPADLQRFYQLFAAHPRTVTLFSQGINQSIRGTDQVNAILNLHLATGRIGTPGAAPFSITGQPNAMGGREVGGLASTLAAHRGFGAQDIADVGRFWAAERMATRPGLKAVDLFRAVGEGRIKALWIMATNPAVSMPDAGRVREALAACPFVVVSDVIAQTDTSVHAHVRLPAAAWGEKDGTVTNSERTISRQRAFLPLPGEAKPDWWIVSQVARRMGFRTAFPFDRPAEVWREHARLTAYRNGGARMLDLQAKAAIGNQAYDEMAPFSWHPQPFADGRYPTPSGRARLVPVAQRPLDAPLRDWPMTLNTGRYRDQWHTMTRTGLSPRLARHREEPLVEIHPDDAAALALADGALARVATPQGNSLFRVAHHAGQRRGELFTPIHWTDRQSRGGRTGLLARDLADPHSGQPGFKLSPARITPVAVDWRGFLIVRGEGAAPDCLWATRVTVPGGVLYELAGTGDAAPLDRALPAGERIEAIDPARGTRRVAVLRDGRLAAVLFVTRAGALPSRDWLIGQLDQPQGPQVLAGRAPGRAADRGPVVCACFDVGLHTITAAIRDQRLLDVAAIGTALGAGSNCGSCRPALARILTDMPKDAAHG

SEQ ID NO: 15374 - protein, 260 aa, Triticum aestivum
LTEQVCTKKQAGTGPEFPGYRRPTRPRTRGLPLPGFEDCFPRSTKKCSGVVHDETGHALKVPFRRVHLTGDIGHFDTYDTTGPQNISPRLGLPKIRKEWIDRREKLGSPPYTQMYYAKHGVITEEMLYCTKRENLAPEFVRTELARGRAIIPSNKRHLELEPMIAGTNFLVKENANIGNSAVVSSIEDEVHMLQWATMWGADTVMDLSTGRHIHETRQWIIRNSSVSIGTVPIYQTLEKVNGIADHLIWEVVKHTLIEKA

SEQ ID NO: 15375 - protein, 375 aa, Staphylococcus epidermidis ATCC 12228
MSYLFNNYKRDNIEFVDANQNELIDKDNNVYLDFSSGIGVTNLGFNMEIYQAVYNQLNLIWHSPNLYLSSIQEEVAQKLIGQRDYLAFFCNSGTEANEAAIKLARKATGKSEIIAFKKSFHGRTYGAMSATGQKKITDQFGPVVPGFKFAIFNDFNSFKSLTSNNTAAVIIEIIQGESGVLPADPLFMKQLNEYCKQKDILIIVDEVQTGIGRTGKLYAHEHYQLSPDIITLAKGLGNGLPIGAMLGKKNLGHAFGYGSHGTTFGGNRLSLAAANQTLSIINDADLLNDVQSKGQFLIENLRKSLVNKRNVIEVRGVGLMVGIEVTNDPSQVVREAKRMGLIILTAGKNVIRLLPPLTITKKQLEKGIEILTEII

SEQ ID NO: 15376 - protein, 554 aa, Pseudomonas syringae pv. phaseolicola 1448A
MAYYRNPSDVTALPAWQALSKHRQSMQNFSMREAFNSDPQRFSQFTLSSAGLFLDYSKNLITTETRDLLVSLAGEVNLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSSKSFNTLETLKNAQAARAWYLAQGGSEVELHRHFIAVSSNNAAAVAFGIREENIFPMWDWVGGRYSLWSAIGLPIALAIGMSNFKELLSGAYTMDQHFQSAPFEQNMPVLLALLGVWYGNFWNAQSHAILPYDHYLRNITKHLQQLDMESNGKSVRQDGTPTSTDTGPVIWGGVGANGQHAYHQLLHQGTQMIPADFIVPIVSFNPVADHHQWLYANCLSQSQALMMGKTRAEAEAELREKGMSEEEVQKLAPHKVIPGNRPSNTLVVERISPRRLGALVAMYEHKVFVQSVIWGTNAFDQWGVELGKEMGKAVYQRLTGGTEEPADDASTQGLINYFRGRHRG

SEQ ID NO: 15377 - protein, 656 aa, Yersinia pseudotuberculosis IP 32953
MSVEKQFSVSAEKTCNTENKCNTEKKFDVICMGRIAVDLYGQQIGARLEDVASFAKYLGGSSGNVAYGSARQGLRSSMLARVGDEHMGRFLREELHQVGCDTSHLTTDKKRLTALVLLSIKDRDTFPLIFYRDNCADMAITAQDFSEQYIASARCLAITGTHLSHPNTREAVLTALRYARRNGVRTVLDIDYRPVLWGLTSLGDGETRFIESHQVTAELLAVFNLFDVIVGTEEEFHIAGGSTNTLDALRGVREVSDAALVCKRGALGCSVYTEAIPQTLDEGLTVSGVRVKVLNVLGAGDAFMSGLLRGYLNDEGWPQACRYANACGALVVSRHGCAPAMPSKIELDNYLARADAVVRPDLDVHLNHLHRVTTRRRQWPELCVMAFDHRSQLEEMALQCGADLCHISTLKTLILQASREAVHTAGLQGKAGLLCDGTFGQDALNAITGAGWWIGRPIELPGSRPLAMEHGNIGSQLIGWPQEHIVKCLVFFHPEDAYSLRLEQEQKIIEVYRACCQSGHELLLEVILPAGMPRSDELYLRAISRFYNLGVYPDWWKLPPLASEGWAALNKLIERRDPHCRGVVILGFDASLEALRTGFNAAAGYPIVKGFAVGRTLFGDASLAWLKRDIDDTQLIARIRDNYLQLITLWRERGQK

SEQ ID NO: 15378 - protein, 337 aa, Zea mays
  misc_feature (52)..(52): Xaa can be any naturally occurring amino acid
  misc_feature (61)..(61): Xaa can be any naturally occurring amino acid
  misc_feature (211)..(211): Xaa can be any naturally occurring amino acid
  misc_feature (282)..(282): Xaa can be any naturally occurring amino acid
MGYLPALGGKAAHLVNDLATVILNPRPPSASASHTTPTHLPEATEGEDTLFXDDEFLTQIXDGPGTSSFRAFLMSFVPSSTASKNSMETIPEHNLDVEYPTLTPVGKACSGRKGLFSRGKHSLGRIISKAGLGNLRQKQTHSIDGEIIGQTESVAPRFEVKGSKESTLHDKLPAMSEPSLLLTEMMRAVLYTSLPVLVQGRNWMLVYSTWXGHGISLSTLYRRSRLCAGYSLLIGGDRRGAVFGGLVEAPLQPIVKRKYQGTNDCFVFTNVDGCPVICHPTXMTGSSSTSETFNNPCLSHTQEFKIKDVELWGFVNASKFEEMLMICRTEKQGIWNL

SEQ ID NO: 15379 - protein, 339 aa, delta proteobacterium MLMS-1
MSRPIGITVSRHIMDSQRLHPEATGELTGLLYELIVAAKTISAEVNMAGLADILGMSGKTNIQGEHVQKLDEFANNTIKRRMARCGYLAAMTSEEEADIIPVVEGYEGKYTLAFDPLDGSSNIDVNVSIGTIFSVHRRLTPEDGPGEESDLLQAGRQQVAAGYVIFGSSTMLVLTTGDGVHGFTLDPSVGEFYLSHPNIRVPEKSKYFSVNEGNHCYWQEPVRRFLEHLKEEDKASGRPYSGRYIGSMVADFHRNLIAGGVFLYPRDSKDPTKPYGKLRLLYEAAPMALLIEQAGGRAITDDGREILDITPEDLHQRVPLVIGSRHDVALFEEFMNGRR

SEQ ID NO: 15380 - protein, 304 aa, Kluyveromyces lactis NRRL Y-1140
MSIITENNDIEDIKIEGEYDGIIELDQWFDPKAENSVLLILNQRIKLDHSAFEALWNSYTIKICADGAANRLFDYYRDSDGKRYHPDVIAGDMDSIREDVLEYYEAIETTTVIKQNTQYSTDFTKSVNVATLLLLGIDLNAVEINEYDGIHKLYQQADKSQLKDIPLLILNGIDGRFDHTIHSMVQFYALRRQDPYFKMCFLTMSDMIILIPSSKKGYWLKLDKVKPLIGNCGLLPLAGPNIITKTKGLKWDVEDWPTSIESGNVSSSNRFVGENCLIACEESIVMSVELKWDKITQHLIDESE

SEQ ID NO: 15381 - protein, 116 aa, Bradyrhizobium sp. BTAi1
MSDSPSWPFSLVRRAGGLVFLSGEVPVADDGTIPEGIAAQTDLTFKLIGETLAGEGLSLDDVVSCMVHLADKADFAAFNEAYRKHFKDPLPVRTTVQAQMMADVKIEITVVAAARS

SEQ ID NO: 15382 - protein, 177 aa, Glycine max
  misc_feature (125)..(125): Xaa can be any naturally occurring amino acid
  misc_feature (169)..(169): Xaa can be any naturally occurring amino acid
MASSMISSPAVTTVNRAGAGMVAPFTGLKSMAGFPTKKTNNDITSIASNGGRVQCMHVWPPFGKKKFETLSYLPDLDDAQLAKEVQYLLKKGWIPCLKFKLKHNFMYHEHNKSPKYYDKHYCTIXNLPIFNYTDTSQVFKELQHANTTYPNNFIHIIIFDNVQQVHDIXFHHYEPQS

SEQ ID NO: 15383 - protein, 445 aa, Halobacterium sp. NRC-1
MNRETSRELYDRSLDVLVGGVNSTVRAAPQPYPTFVQSGDGGHVIDADGNRYIDWVMGLGPLLLGHDLPQPVTAAIQRRASDGPLFGTPTEIEVEHAEFVARHVPSVELLRFVNSGTEATVSAVRLARGYTGRNKIVVMQGGYHGAQESTLVEGDADHRGPSSAGIPPAFAQHTIPVPFNDADAVTEVFETHGDDIAAVLVEPILANKGIVEPVAGYHETLRDLTHDHGALLIWDEVITGFRVGGLGCAQSEFDITPDVTTFGKIIGGGFPVGAIGGRTDVMEEFTPTGDVFQAGTFSGHPVTMAAGLETLQYAAENDVYEHVNRLGGRLREGLAAVVAEHAPAYTVVGRDSMFKVVFTRDGDAQSGACTDGCRQDPDCERHAACPKTGADVGDAAVQRWNRVFRPQLLDAGVLLSQNQFESQFVSYGHTEADVDETIEAYRSAL

SEQ ID NO: 15384 - protein, 200 aa, Triticum aestivum
LRIAIASAAASSRPWWARPPAARAPASPTGFGGTPPKAEEMSGEVECSVCHAKVAVPAAAVSKAYDSHRSTVSSRQRALNVLLVSGDCVLAGLQPILVYMCKVDGKFKFSPVSVNFLTEITKVIFAIIMLFFQARRVKVGEKPLLTVSTFVQAAHNNVLLAVPAFLYAINNYLKFTMQLYFNPATVKMLGNLKVLIIAVL

SEQ ID NO: 15385 - protein, 322 aa, Arabidopsis thaliana
ETLFEVVADDLQRLNDNLLSIVGAENPVLISAAEQIFSAGGKRMRPGLVFLVSRATAELAGLKELTVEHRRLGEIIEMIHTASLIHDDVLDESDMRRGRETVHELFGTRVAVLAGDFMFAQASWYLANLENLEVIKLISQVIKDFASGEIKQASSLFDCDVKLDDYMLKSYYKTASLVAASTKGAAIFSKVESKVAEQMYQFGKNLGLSFQVVDDILDFTQSTEQLGKPAANDLAKGNITAPVIFALENEPRLREIIESEFCEPGSLEEAIEIVRNRGGIKKAQELAKEKAELALKNLNCLPRSGFRSALEDMVMFNLERID

SEQ ID NO: 15386 - protein, 219 aa, Burkholderia sp. 383
MKDIIEGFLKFQRDAYPERAALFRDLARSQNPRALFISCSDSRLVPELVTQREPGDLFVIRNAGNIVPSYGPEPGGVSASVEYAVAALRVTDVVICGHSDCGAMTAIATCQCMDHMPAVGHWLRYADSARVVNEARTHRSERERIDSMVRENVVAQLANLKTHPAVRLALEEGRLALHGWVYDIESGCIDAYDGATGRFVSLADHPAVRATPATLPVAA

SEQ ID NO: 15387 - protein, 310 aa, Bacillus megaterium
MPLDPHIQIFLNQYNEMPRPSLEDVTPPQLREMEKMSLTPSKEAVKKVYNEEIELNERTLTLRVYEPEGTGPFPALVYYHGGGWVLGSLDTHDSICRSYANETNCIVVSVDYRLAPESKFPAAVNDAYDALDWISAHASQLNIDSNKIAVGGDSAGGNLAAVVSILAKQRQGPSIVHQLLIYPSVGFKNQHPASMKENAEGYLLSKDLMDWFRLQYLNNKEEEQHPYNAPVLLEDLSSLPSATIITAQYDPLRDSGKDYADALKNHGVPVTYENYETMIHGFLGFHEFVPLAQQAINKSAAQLRQVFDSI

SEQ ID NO: 15388 - protein, 519 aa, Mycobacterium tuberculosis CDC1551
MKPYYVTTAIAYPNAAPHVGHAYEYIATDAIARFKRLDGYDVRFLTGTDEHGLKVAQAAAAAGVPTAALARRNSDVFQRMQEALNISFDRFIRTTDADHHEASKELWRRMSAAGDIYLDNYSGWYSVRDERFFVESETQLVDGTRLTVETGTPVTWTEEQTYFFRLSAYTDKLLAHYHANPDFIAPETRRNEVISFVSGGLDDLSISRTSFDWGVQVPEHPDHVMYVWVDALTNYLTGAGFPDTDSELFRRYWPADLHMIGKDIIRFHAVYWPAFLMSAGIELPRRIFAHGFLHNRGEKMSKSVGNIVDPVALAEALGVDQVRYFLLREVPFGQDGSYSDEAIVTRINTDLANELGNLAQRSLSMVAKNLDGRVPNPGEFADADAALLATADGLLERVRGHFDAQAMHLALEAIWLMLGDANKYFSVQQPWVLRKSESEADQARFRTTLYVTCEVVRIAALLIQPVMPESAGKILDLLGQAPNQRSFAAVGVRLTPGTALPPPTGVFPRYQPPQPPEGK

SEQ ID NO: 15389 - protein, 500 aa, Glycine max
MTTAFERHALPLFLFLFLTPIINASIHDYSNEPFTHRSDAFFFHGGSEALFAKSFIRFETVTFARPRESASVHGRMQSNTGLVEAIILEVRDRNRIGGSYLKSDLICCDPKLAKDRNCNLGEVIIQKNPDNHELPKRIKTFFQGTDEQVQMDAVTLEINATGMYYLYFMFCDPSLKGTTIQGRTVWRNPNGYLPGKMAPLMTLYGFMSLAYLLLGLAWFLRFVQFWKDIIQLHYHITAVIALGMCEMAVWYFEYANFNSTGTRPMGITLWAVTFTSVKKTLSRLLLLVVSMGYGVVRPTLGGNVIAYRVLLLGLLYFSASEALELVEHLGNINDFSGKTKLLLVLPVVCLDSCFILWIFSSLSKTLEKLQTRRNLAKLELYRKFTNTLAVSVLLSIAWIGFELYFNATDPLSELWQIAWIIPAFWCLLSYALLVVICILWAPSRNPTRYAYMEETGDDFDEEGISLTSSVAKISGDVAAKLDRKAIDHAFGEDLEEDKRE

SEQ ID NO: 15390 - protein, 372 aa, Hemerocallis hybrid cultivar
STEIFSPVRIRSLAAVRQEEVKLMITGILASTSTDNSVKVNMKVVFSELMFNVIMKIIAGKRYFGVNTDSEVEEGQKFRVVFDEMFSTLEVASPQDFLPFLKWFGFKRMENRLTKLAKELDQLFQKLIEERRSERGKVQSTVIDVLLSLQETDREQYSDKLIKGMILSLIAAGTHTTAGTMEWAMSLLLNHPEALLKVRDEIDKKVGQDRLIDHSDLQNLSYLNNAIKESLRLFPTAPLLLAHESSAECTVGGFTIPSNTILFANAYALHRDPKVWTDPVSFKPERFENNGQQGSRIYVPFGLGRRSCPGEGLATQVVGLALGTLIQCFEWDRNGEEKVDMTDGSGLAMHMEKPLEAMCKPRQSIVDVINRL

SEQ ID NO: 15391 - protein, 254 aa, Prosthecochloris aestuarii DSM 271
MINHSTKSTIVSNNTKFAFIFDMDGVLVDNMHMHARSWVEVFMDLGLEGMDSDRYLRESAGMKGLDVLRHFLDPDISETDADRLSELKDFLYRVMYRETMCPMPGLESFLDHAASQNIALGVGTGAGERNIAYTLGIPGLRDRFSAVVGSHQVQHGKPHPETFLRVAEMLDADPANCIVFEDALPGIEAANRAGMQAVALTTTNPAEVMSQCSGLLDVVADFTAITPDIIIEKLCGTCNSRSGESIQKKPCKNI

SEQ ID NO: 15392 - protein, 222 aa, Hemerocallis hybrid cultivar
MLAAYWTTLAPNVEDYSGSVARVIAMGSGRVIQGILWCGDVTVERLKWGEQLLKRKMDPNAQSSRVSKEALQRMKRVKKVTKMSDKVVTGILSGVVRVSGYFTSSVVNSKAGKSFFGMLPGEVLLASLDGFAKICDAAEVAGKNIMETSSEVTTGVVSHRYGEQAAELTHEGFGAAGHAIGTAWSVFKIRKALNPKGALKPTTIAKSAVKSAAAGMRAKAKK

SEQ ID NO: 15393 - protein, 279 aa, Kluyveromyces lactis NRRL Y-1140
MLLLALSDAHIPERAIDVPLKFRKLLNVPNKIQQVTLLGNCTKSASFLKFVNTISENIVFVRGEFDPATVSTTKNPAEEMPLSTVISQGPFRIGCCNGYTLVPKNDPLSLLTLARQLDVDILLWGGTHNVEAYTLEGKFFINPGSCTGAFSTDWVQEDVEENYKTSEQQEPAEASTNGSNQQPKEIKEEIKEPSNNDSEKSGEDKADIIEDKGNSEEHLQEGKEYEHDSSDDEFDDIDINGGGIPSFCLLDIQDITCTLYIYTYVDNEIKVDKVVYRKD

SEQ ID NO: 15394 - protein, 230 aa, Triticum aestivum
TKVAPKTSWFPSGIPGISLNPRVRDWGRRTLTWAEGVEKARLPPPSKLYTYIVQPWPPPEMASSATTVAPFQGLSPTAGLPVSRRSNGDSLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEDSGKA

SEQ ID NO: 15395 - protein, 479 aa, Legionella pneumophila subsp. pneumophila str. Philadelphia 1
MMRLLMANKIKTDVVVLGSGPGGYTAAFRAADLDKKVVLVERFDSLGGVCLNVGCIPSKALLHIAKVVDEAHEMSEQGVAFGKPKFDNKKLVAWKNSVVAKLTGGLKALAKQRKVEVITGTGKFSGTHQILVETKEGTVEIEFDNAIIAVGSESIKLPFIPEDKRIFSSTGALELADIKGDLLVLGGGIIGLEMATVYSSLGVNVTVVEFMDQLIPNADADLVNILQKRMTKKGVKFLLKTKVTAVEAKKDGIYVSMEGEHATDKPLCFQQVLVSVGRKPNGGAINAEKAGIKVDERGFIPVDNQLRTNVPHIFAIGDVNGQPMLAHKAIPEGKVAAEVIAGKKHYFEPKCIPSVAYTDPELAWAGLTEKEAKEKGINYEKASFPWAASGRALSMGREEGMTKLLFCPETNRILGAGIVGVNAGDLIAETALAIEMCCDVEDIALTIHPHPTLSETIAQSAEAFEGTITDLYLPKKKKK

SEQ ID NO: 15396 - protein, 453 aa, Triticum aestivum
MAARAHNVAAAQQQNRALGGVPAMGKQQKAAMAGRPDPKNTRRALGDIGNVEANNRRAPLGDIANVVNARAAEGKPQPHEPVNRPVTRNFGAQLLKNAQEKAKNPAARPAVRRAHHVKPAPPPPEHVIEISSDSDVTKSEAGSVSSVRKYSRKKVVTTLSHVLSARSKFAAGITEEPAIQDIDKLDGDNQLAVVDYIEDIYKFYKVAENECRASDYMDSQEEINAKMRGILIDWILEVHQKFDLMPESLYLTVYIIDMYLSLQSVLRRELQLVGVSALLIACKYEEIWAPEVNDFILISDSAYTREQILKMEKAILNRLEWNLTVPTPYVFLVRFAKAASSSDHKNDKEMENTVFFFAELALLQYGLVQSKPSMVAAAAVYAARLTLKKTPLWTDTLKHHTGFTEAQLMDAAKILVASHSTAPDSKLKVVYKKYSSEKLGGVALRPPATDLCK

SEQ ID NO: 15397 - protein, 275 aa, Oryza sativa
  misc_feature (27)..(27): Xaa can be any naturally occurring amino acid
RAVVVRPILPSCCTLAGVPPPPPPPPXPPLHPLIAHAPYDVVLHRSVVLSISSARDQAELASFWCYIRLGGGASAKRAAGEDDRSRSSLTAARGGGGETMSGRGRGDPLVLGRVVGDVVDPFVRRVALRVAYGAREVANGCELRPSAVDDQPRVAVGGPDMRTFYTLVMVDPDAPSPSDPNLREYLHWLVTDIPATTGVSFGTEVVCYESPRPVLGIHRLVFLLFEQLGRQTVYAPGWRQNFSTRDFAELYNLGLPVAAVYFNCQRESGTGGRRM

SEQ ID NO: 15398 - protein, 893 aa, Legionella pneumophila subsp. pneumophila str. Philadelphia 1
MLGNYFMTNETNLDLDPIETREWLDALQAVLFNDGPERTAFLLQQLLNKANAEGVKLTSSINTPYRNTIKPHEEKQMPPDEGIGKRINALIRWNAVAMVLRAGKYAPELGGHIASYASASTLYETGFNYFFKGQKGENGGDLLYIQGHSAPGIYARAFLEGRLTEKQLEKFRQEVEVDGLSSYPHPWLMNDFWQFPTVSMGLGPLQAIYQARFLKYLENRGLIKAEGRKVWAFLGDGEMDEPESVGALSIAAREKLDNLIFVVNCNLQRLDGPVRGNGKIIQELEGLFRGAGWNVIKVIWGGRWDPLFARDNQGWLQKRMEECLDGDYQSYKANDGSYVRQHFFNQYPELKKMVENMSDEEIWRLNRGGHDPQKVYAAYARAVEHKGTPTVILAKTIKGYGMGAAGEGQNITHQQKKMTIDQLKAFRDRFNIPISDDKIADIPFYKPDDDSPEIKYIKKQREALGGYLPHRSTEVEQLKIPDLGEFSSITKGLGDREISTTMAFVRILSVLLKNKDINSRIVPIVPDECRTFGMEGLFRQIGIYSPVGQLYTPVDHEQVMYYREAVDGQILEEGINEAGAFCSWIAAATSYSSNKLAMIPFYIYYSMFGFQRIGDLAWAAGDMQARGFLLGGTAGRTTLAGEGLQHQDGHSHVLASTIPNCISYDPTYAYELAVIIQNGLHRMYEKQENVFYYITIMNENYSHPDMPAGVEEGIIKGMYLLKENKKKSKNHVQLMGCGTILREVIKAAEMLEEDFSITSDIWSVTSFNELRKEGLAVERYNNMHPQNKPQESYVTSQLKGRRGPVIASTDYMRIYADQIRPFVPNRYITLGTDGYGRSDTRTQLRHFFEVDAKFIVLAALNALVAEGSLDKTKIVDAMKRYNINQDKLDPMTH

SEQ ID NO: 15399 - protein, 483 aa, Burkholderia sp. 383
MNEFLRTGHYIGGEWHESHGASDATYPVLNPATGETIAKVAKGGADDTQRAIDAAAHAFPAWRALTAKERGARVKRWGELMLENRDALAELLTREQGKPLAEARGEVVYAASFLEWFAEEAKRMYGDVIPSPKPNSQIVVTREPVGVVAAITPWNFPLAMITRKAGPALAAGCTMVLKPSEETPLSAFALAVLAERAGVPAGVFNVVSGDAVAIGETLTSSSVVRKLSFTGSTRVGKLLAKQSADTLKKLSLELGGNAPFIVFDDADLDAAVEGAIASKFRNTGQTCVCVNRFLVQDGVYDAFTRKLADAVRKLRVGNALAGEVDQGPLINEAALGKVERHVADATAKGAHALTGGKRHALGGTFYEPTVLTGMTADMLIAEEETFGPVAGCFRFATEEEAVAAANDTPFGLSAYFYTRDLGRAWRVSGALESGMVGVNDGIISTEVAPFGGVKQSGLGREGSKYGLDEYVELKYTLMAGLGR

SEQ ID NO: 15400 - protein, 216 aa, Bacillus cereus ATCC 10987
MTNNNQIGENKEQTIFDHKGNAIMTEDREIQIISKFEEPLIVVLGNVLSDEECDELIELSKNKLARSKVGSSRDVNDIRTSSGAFLDDNELTAKIEKRISSIMNVPVSHGEGLHILNYEVDQQYKAHYDYFAEHSRSAANNRISTLVMYLNDVEEGGETFFPKLNLSVHPRKGMAVYFEYFYQDQSLNELTLHGGAPVTKGEKWIATQWMRRGTYR

SEQ ID NO: 15401 - protein, 426 aa, Oryza sativa (japonica cultivar-group)
MPATDSSSAAAPLTSFGRSFLSHRRDQIPPPPPDHHSHSHTQHPSSSDLEIDAFHRHAADLLHDLLSDSNSDPSAPDLLSLAWTRRLLDSFLICLEEFRAILFALADSQPLSRPPLDRLLLDFLDRAVKALDLCNALRDGLDLIRQWRKHLAIAAAALATAPAAQRGEAQIRRARKALTDLTILMLDDKDAGGVVGQRNRSFGRAGTTRDSLPHGHGHHRRSSSGGSSGSGSGSHLRSLSWSVSRTWSAARQLQAIGGGLTVPRANDIAATGGLASAVYAMGAVLFVVTWALVAAIPCQDRGLQAHLTAVPRTFPWAGPLITLFDRILDESKKKDRKHSCGLLKEIHQIERCSRQLMEVTDAAEFPLADDKDSEVQEATQELVQVCGSLKDGLDPLERQVREMFHRVVRTRTEILDYLSRPHNAGL

SEQ ID NO: 15402 - protein, 363 aa, Rhizobium leguminosarum bv. viciae 3841
MTSPSGDRTHKIAAIPADGIGPEVIGAGLEVLHALQQRSDGLRFEITQFDWGSDYYREHGKMMPEDGLAQLRKHDAIYFGAVGAPDIADHITLWGLRLPICQGFDQYANVRPTRILPGIPTPLRDRGVGDLDWVIVRENSEGEYSGHGGRAHRGLPEEVATEVAIFTRVGVTRIMRFAFRIAQSRPRKLLTVVTKSNAQRFGLVLWDEIAAEVSTEFPDVKWDKVLVDAMTVRMTLHPESLDTIVATNLHADILSDLAGALAGSLGVAPTANIDPERRFPSMFEPIHGSAFDITGKGIANPIASFWTACQMLDHLGEAEASARLMKAIETVCSAGISTPDVGGTATTREVTDAVIKAIFGSNA

SEQ ID NO: 15403 - protein, 484 aa, Rhizobium leguminosarum bv. viciae 3841
MMRHYGNLYIDGRWQEPAKAGQKLLTDPYTETPFASVTTGGMAADVDKAALAARRAFETFSRTSLEERAALIDRIIAAYEERVDEFADVMAQEVGIPVSARAQATGPIGHMKVARDLLRTYHFESRLGDTIIRREPIGVCALISPWNWPVQTPVIKAIYGIAAGCTLLLKPSDASPISSVILAEVFEKAGVPAGVFNLIIGRGSEVGAAMSTHPEVDMISFTGSTSAGARVGEAAAQTIKRVSLELGGKSANIVLEDADLEKAARWNIQRCFFNAGQSCHAPSRMLVHESQIDEVSNYLVDEVSKYKLGDPRDPATTMGPVVNKSQYDSIQRYIQIGIDEGARLACGGTGKPEGRNQGYFVKPTVFTHVTPEMTIAKEEIFGPVLAVIPYSSEEQALEIANDSPYGLGGYVFAGDRKKGYEFSAGLRAGRICFNGAATNSVTPMGGYKQSGIGRSMGTVGLEEYLETKSVYGFEEEATSLPEFA

SEQ ID NO: 15404 - protein, 652 aa, Hordeum vulgare subsp. vulgare
  misc_feature (557)..(557): Xaa can be any naturally occurring amino acid
MLDHLPPPRLTKGKGTEPSISAAVAGEIDPTVPWYLRVCTLTRLLRDREFLAVLRHADPSPPPQALGLPSALICCAALSLPSGVAQVHALAAKGGLVPASDSYILSALLSSYCRLGLLPCARQLLDEMPAASTPPATVLTAFNSLISGCALHALTPACFALFRRMRVHVAGLRFNAVTLLALLPVAPATVVPQLQALAAQSGLASRTTVANCLISVYGRSSPTLARQVFDEMPLATRDLVSWTAVLSAHAQGGLAVDALELYRRMRGHGVEPDALTLVGVLSSCSHLAARSVGLDVDRYVRQRLPGFRANVQLCSALINFHARCGSLPQAQQLFDEMPRKSIVSWTALITGYGMHGHGDIAINFFQRMVSQGIRPDNVSMVALLSACSHAGKYEEGCKYFFAMESTYKLRPTLEHYACMVDLLGRAGRLEEARELISSMPMPADGSVWGALLGACKIHKNVEAGEEAFKHVIMLEPSNVGYYVLMANMYTDSGQQDGVARVRAMMRERGLKKEPGRTQVVRHLLMDDDHSHPQAKRIYELVIELEQMVKEKMNVTAXNEGKLSADKKVAAPLVGTHSEKLAVPFSLLNTVDVEIVVMMNLRVCGDCHSLLKMASAIANRVFLVRDSSCFHRFEVGACPCQDYWRRNWIESSL

SEQ ID NO: 15405 - protein, 426 aa, Streptomyces coelicolor A3(2) [sequence omitted]

SEQ ID NO: 15406 - protein, 326 aa, Arabidopsis thaliana
MRSFVSLISLLLLLSFSSSVLSTKKSSFQKLPVPGNRTGPEAFAFDSTGKGFYTGVTGGKILKYLPKKGYVDFAQITNSSKSSLCDGALGTTNVEKCGRPAGIAFNTKTGDLYVADAALGLHVIPRRGGLAKKIADSVGGKPFLFLDGLDVDPTTGVVYFTSFSSTFGPRDVLKAVATKDSTGKFFKYDPSKKVVTVLMEGLSGSAGCAVSSDGSFVLVGQFTKSNIKRYWIKGSKAGTSEDFTNSVSNPDNIKRIGSTGNFWVASVVNSATGPTNPSAVKVSSAGKVLQTIPLKDKFGDTLVSEVNEYKGQLYIGALFGPFAGIP

SEQ ID NO: 15407 - protein, 170 aa, Bacillus licheniformis ATCC 14580
MDLKKYVTIVPDYPKEGVQFKDITTLMDKGDVYRYATDQIVTYAKEKEIDLVVGPEARGFIIGCPVAYALGVGFAPVRKEGKLPREVIKVDYGLEYGKDVLTIHKDAIKPGQRVLITDDLLATGGTIEATIKLVEELGGVVAGIAFLIELTYLEGRNKLDGYDILTLMQY

SEQ ID NO: 15408 - protein, 262 aa, Brassica napus
MKMKKKGKVYPSPPPSTQPPPPTPSSSSSSHYLNEDHSLSVLRLLPATILVLVTVLSPEDREVLAYLITRGTATISADSNKKKAATKKKKNKSSRNHKPPVFDCECFDCYTSYWLRWDSSPNRELIHDIIEAFENHHLATGGEDSAASRNKSKRGKKKEKPGRRGGGDNDEKKPVVEVEPVIETAVLESHVSSPDNSPGRLSEAEVTGEDVEEEVVNGEEEESAVVLPAAAASGHKGLARKVLPDVLGLFNSSFWRLWNPNA

SEQ ID NO: 15409 - protein, 335 aa, Frankia sp. EAN1pec
MATRVGVNGFGRIGRNFWRALAASRRSDLEIVAVNDLTDNKTLAHLLKYDTTLGTLPESVSVGEDGIRVGDSTIKVLAERDPAALPWADLGVDVVIESTGRFTTAETAGKHLTAGAKKVIISAPAKGEDLTVVMGVNDDVYDPAKHHILSNASCTTNCVAPLAKVLDEAFGIERGLMTTIHAYTNDQVILDFPHSDLRRARAAAQNIIPTTTGAAKATALVLPHLKGKLDGIAMRVPVLDGSVTDLVVNLARPASKDEINAAYKAAAEGPLKGYLVYTEDPIVSSDIVGTPASCTFDSLLTMSSGSQVKVVGWYDNEWGYSNRLVDLTGLVAARI

SEQ ID NO: 15410 - protein, 400 aa, Frankia sp. EAN1pec
MRTIDDLQVTGHRVLVRSDLNVPLDHSKGAPRITDDGRVRASVPTIQALLDRNAKVIVCSHLGRPKGAPEEKYSLAPVAERLAELLGIPVAFAGDGGGDIAGDRAREVVGQLAEGQVALLENLRFHPGETSKDTVARATFADELSALAEFYVGDAFGAVHRAHASVSEVPKRLPHAAGRLVLTELEVLRALTAAPARPYAVVLGGSKVSDKLGVIRALLPKVDALLVGGGMCFTFLAALGHPVGASLLESEMIDTCKDLLAEAGDRLVLPTDVVVADRFAADAETAVVAADAIPDGWLGLDIGPASTAAFARVVAGAATIFWNGPMGVFEFAPFAEGTRGVAEAVASGGGFSVVGGGDSAAAVRILGIPEDDFSHISTGGGASLEYLEGKTLPGLAALDV

SEQ ID NO: 15411 - protein, 198 aa, Triticum aestivum
MAPTVMASSATSVAPFQGLKSTAGLPDSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPGRYVRIIGFQNMRQVQSVNFLPFKPTGWRGIRARPNHLPPDKAYIKAAIASIGSPRP

SEQ ID NO: 15412 - protein, 270 aa, Frankia sp. EAN1pec
MAKGAPARGSAGTGRRTLVAGNWKMNLNHLEAIALVQKVAFDLKPAELERVEVVFLPPFTDLRSVQTLIDGDKLAVGYGGQDLSPHGSGAYTGDISGPMLARLGCSYVVVGHSERRTYHHEDDALVASKVLAAYKHGITPILCVGEHEDIRAAGTHVEHVLAQLEGSLAGVSAEQAATLVVAYEPVWAIGTGRTASAQDAQDMCAAVRGQLTKLYDEPIAAGIRVLYGGSVKAANAAELFTMPDVDGGLVGGASLVAEEFVGIIRSGPAA

SEQ ID NO: 15413 - protein, 118 aa, Salinibacter ruber DSM 13855
MATDLMSVVEATQLRDDVPDFDSGDTVNVHLRVVEGEKERIQQFEGVCLSRRGSGPNETITVRKVSEGVGVERIFPVHSPRVAQIDVVRRGAVNRSKLSYLRGLSGKDARIQEQIRGN

SEQ ID NO: 15414 - protein, 474 aa, Burkholderia sp. 383
MRTERNYVNGRFVAPESDTFIVVHNPATEAPFARVPAATPADALAAVDAAAAAQKAWRKLPSAERATYLHRFADALTARASEIGAALAQESGKSVEDASNEAVYAGQITRYHAEWARRIEGEIIPSDTPDENLFLQREPIGVVACLIPFNYPVYTLLRKVAPALIAGNTVVVRPSNHTPVSAFEIAKAAGDAGFPPGVINILTMDHATAEALCTHPAVGMITLTGSVNAGRKVLDYCKANIAKPSLELGGKTPAIIEPDADLERAAAALVASKTTHCGQLCTAIERVYVHDSVHDRFVALLKEKMAAVRIGDRAEDATRMGPLVSASARAHIHGMVERAIAAGATLETGGAIPAGPGFFYPATLLTGVRQDMEIVQEETFGPIMPVLRYSTIDEAIAQANDHQFGLSSVLYTEHYRTAMTVANAIEAGELYVNRTPADPYQGFHAGWKRSGLGGDDGKHGMLEFTQTRLVVMKY

SEQ ID NO: 15415 - protein, 471 aa, Fremyella diplosiphon
MTTPQEVLKLIQDQKIQMIDLKFIDTPGTWQHLTVYYNQIDESSFTDGVPFDGSSIRGWKGIEESDMTMVLDPNTAWIDPFMKEPTLSIICSIKEPRTGEWYNRCPRVIAQKAIDYLVSTGLGDTAFFGPEAEFFIFDDARFDQTANSGYYYVDSVEGRWNSGKDEGPNLAYKPRFKEGYFPVAPTDTFQDMRTEMLLTMAACGVPIEKQHHEVATGGQCELGFRFGKLIEAADWLMTYKYVIKNVAKKYGRTVTFMPKPIFGDNGSGMHCHQSIWKDGKPLFGGDKYAGLSDMALYYIGGILKHAPALLGITNPTTNSYKRLVPGYEAPVNLAYSQGNRSASVRIPLSGTNPKAKRLEFRCPDATSNPYLAFAAMLCAGIDGIKNKIHPGEPLDRNIYELSPEELAKVPSTPGSLELALEALENDHAFLTESGVFTEDFIQNWIEYKLVNEVKQLQLRPHPYEFYLYYDC

SEQ ID NO: 15416 - protein, 134 aa, Triticum aestivum
  misc_feature (21)..(21): Xaa can be any naturally occurring amino acid
  misc_feature (61)..(61): Xaa can be any naturally occurring amino acid
  misc_feature (100)..(100): Xaa can be any naturally occurring amino acid
RKLEVSLKEMLIDFLPTDGGXSLAEAPALVKAPGGAPANVPIGAPRLGGMAVLRLKLGDDXFGQMLDKMLRHNGVNTVGDNFDSGARTALDFVTLTALGXRKLMFYRNRKAIMLLTANELMVDIINKAEVFHYR

SEQ ID NO: 15417 - protein, 344 aa, Mesorhizobium sp. BNC1
MTNMMKALVKAKPEEGLWMERVPLPEIGPNDVLIKVRKAAICGTDVHIWNWDEWARKTVPVPLVTGHEFVGEVVDVGSAVTEYRIGQRVSGEGHIVCGHCRNCRAGRGHLCRNTLGVGVHRPGAFAEYISLPQHNVVAIPDDVPDEIAAIFDPLGNAVHTALSFDLVGEDVLVTGAGPIGIMGALVAQCVGARKVVITDINPGRLALAKKLGVRHVVNAREEKLTDVMRKLGMTEGFDVGLEMSGSASAFRDMIDVMNNGGKIAILGIAPTGFEIDWNKVIFKMLHLKGIYGREMFETWYKMIALVQGPLDISGLITHRISADDYREGFAAMRSGEAGKVVMDW

SEQ ID NO: 15418 - protein, 1411 aa, Mycobacterium avium subsp. paratuberculosis K-10
MAPENAVNTMCAYCGVGCGMVLQITTDPQTGRRHVAKSVGNKEHPANFGRLCTKGATTADLLAAPGRMDSAHARAGRGEPLEPIDTDQAITRCAKQLRAIIDEHGPDAIAMYVSGQMSLEAQYLANKLTKGFIGTNQIESNSRLCMASAGSGYKLSLGADGPPGSYQDFEHADVFFVIGANMADCHPILFLRMMDRVKAGAKLIVVDPRRTATAEKADLFLQIAPGTDLALLNGLLHLIVENGHTDREFIAEFTEGWEVMPSFLEQYTPDRVSEITGIPEQDIRAAAQLIGEADNFMSCWTMGLNQSTHGTWNTNAICNLHLATGAICKPGSGPFSLTGQPNAMGGREMGYMGPGLPGQRSVASVADREFVEDVWGVPRGRLRTEVGTGTVDMFSRMADGQIKACWIICTNPVASVANRKTVLAGLERAELVIAQDAYLGTETSEYADVLLPAALWAETEGVMVNSERNITLSQPAVAAPGGAMPDWQIIARIACEMGFSEAFSYSCAEEVFEEIKRFWNPTTGYDLRGVSYERLRRQPLQWPCPPQSTADRNPIRYLNDGVSQTQLVREDGTVPRLAFPTPSGRAVFFARPHLQPEEMPDDDYPFLLNTGRLPHQWHTMTKTGKVAKLNKLNPGPFVEIHPDDAARLGIGEHDRVEIASRRGRAVLPAVVSDRVRPGNCFAPFHWNDAFGEYLSINAVTNDAVDPISNQPEFKACAVTLTKVAVSHPDSAIGTGPSAGHDTPESSPTEVREISVSQVDALGELLGVATSFKPEFNELGRSYLAGMLTGLRSDVGRRAGGVPTLPPSAPFDSRTRLWVDGLLAGLFSRADASQQAALPEPPQPAAQQPPAAPAGATPAPERAPVVVLWASQTGNAEELAADVAAQLAAAELPVALHSMDDFPAAELAATRELLLITSTTGDGDAPDNGSGLWRALTGDAAPRLGNTRYAVLALGDSNYDDFCGHGRKLDARLAELGATRIAERVDCEPDYEQAAAKWVADVIDALTRTPTAVGGDGGATVSARTSPVAAPSRPNTPAPHTYSKKHPLITDMVRNTTLNGPKSTKDVRHLVFNLPEDAVSYEAGDALGVWPRNSDELVDEWLAVTGLDGQTPVEVGEHGLMSLRSALTERIEIAHISRDLVRFVQERTGDAKLAELLKPENKRALADWTWGRQSIDLLAQLPVSASAHEWLRVLKRLQPRLYSISSSPKACPGEVHLTVSPVRYNFQGVPRRGVCSTYLAARSPGDRVAVYLQPSSNFRPPSDPDTPMIMIGPGTGIAPFRGFLQERRALGHRGPNWLFFGEQHAATDFYYRDELEQMREDGFLTELDLAFSRDQQHKVYVQHLMRNRGKQLWSWLQDGAQLYVCGTADPMAKDVDRALCDIAAEFGNLDPDAAKAYVQSLSADKRYHRDVY

SEQ ID NO: 15419 - protein, 484 aa, Rhizobium leguminosarum bv. viciae 3841
MTDKQQYTYPKIGLLIDGEWIYDREALCDVENPSDESILGQVPKATARDLQNALESSARGFETWRKTPPTVRAAVMRRAAALVRERAKDIAPIFTAESGRTYAEVLAEIERSATFLDWDSEEIRRLYGRIVPTDPPIQQFVVREPVGPVAAFTPWNVPMSAPSRKISASLAAGCSIILKPAEETPATACLFAQCFLDAGLPKGVLNVVFGEPDEVSRTLVLSPITRLVTLTGSINVGKHLTRLAVETMKPVLMELGGHAPVIVDENTNADEIAQLAVNWKFRMAGQFCSAPSRFLIHRSRYEDFVSSISEKASKLKVGDGFTEGVQMGPLANRRRLAAMADLVEDAVSHGARVTTGGKRVGNRGWFYEPTVLADVPLDARVMSEEPFGPIAPCMAVDSMDEALKISNSLSMGLAAFVFTNDMERADYLSRELQVGSVALNVFTSPGGDAPFGGVRESGIGREGGTEMYHSYTVAKTIAERRVKV

SEQ ID NO: 15420 - protein, 429 aa, uncultured candidate division WS3 bacterium
MLTMEEARRGRATDALAAVARDENMEVDELVALVAAGRAVILRNRLSSRRPVGLGPGLRTKVNANLGTSSDASSLSEELAKVDAAIAAGADAIMDLSTGGDLNEIRRAVLARSTVPVGSVPLYQAAVDARRRGDGMVHMTAEDMLGAVEDHARDGMDFVTVHCGVTREVAEHCRRAHRLADVVSRGGSFLMEWMSYNGRENPLYERYDDLLDIAAEYDVTLSLGDGLRPGSLADANDAPQIAELTVIAELVRRARERGVQSIVEGPGHVPLNLVESSVELEKSLCHDAPFYVLGPIVTDVAPGYDHVSAAIGGAVAAAAGADFLCYVTPAEHLRLPDVDDVREGVYAIRVAAHAADVAKNVPGARDWDDELSRARKGLKWDRVIELSLDRDKARAFRDASSPSDDELCTMCGEFCAIRKMTDVRKGEGE

SEQ ID NO: 15421 - protein, 354 aa, Brassica napus
  misc_feature (69)..(69): Xaa can be any naturally occurring amino acid
NPFADELIANAAYIGTPGKGILAADESTGTIGKRLASINVENVETNRRALRELLFTAPGALPCLSGVIXLFEETLYQKSSDGKLFVDILKEGGVLPGIKVDKGTVELAGTNGETTTQGLDGLGDRCKKYYEAGARFAKWRAVLKIGENEPSELSIHENAYGLARYAVICQENGLVPIVEPEILVDGSHDIHKCAAVTERVLAACYKALSDHHVLLEGTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 15422 - protein, 140 aa, Mesorhizobium loti MAFF303099
MALERTFSMIKPDATRRNLTGAITKMLEDAGLRVIASRRVWMSRREAEGFYAVHKDRPFFGELVEFMSSAPTIVQVLEGENAIARNREVMGATNPANAAEGTIRKVHALSIGENSVHGSDAPETAAQEIKYWFSDTEIVG

SEQ ID NO: 15423 - protein, 532 aa, Triticum aestivum
MAVPTPQRRLLAAAMALLLALASSGAGAVAFAGPIKTVVVVVMENRSFDHMLGWMKRLNPAIDGVTGAEWNPANASDPAAGPRVYFGDGAQFVDPDPGHSYQEIRQQIFGSDDASGPPRMNGFVQQARSIGGGNMTDAVMNGFAPDSVAVYRELVAQFAVCDRWFASVPSSTQPNRLFVHSGTSGGATSNNPELLAKGYPQRTIFDNVHDAGLSFGVYFQDVPAVLFYRNLRKLKYILNFHPFHNAFRDHASRGSLPNYAVIEQHYMDSKDHPANDDHPSHDVYQGQMFVKEIYETLRASPQWNETLMVLTYDEHGGFFDHVPTPVDGVPSPDDIVGPPPYNFTFNRLGVRVPAILISPWIEKGTVMHGPNGSPTPTSQFEHSSIPATVKKLFNLPQDFLTKRDAWAGTFEGVVQTRTEPRTDCPEQLPTPTRIRQTEANEEAKLSSFQQEIVQLAAVLNGDHQLSSLQERIRERMNVREGTSYMRSAVRRFFEAGMSAKRMGLADDEQIVKMRPSLTTRMTSSPADQDDSP

SEQ ID NO: 15424 - protein, 572 aa, Burkholderia thailandensis E264
MTPAIDPNFKRLRRFIEFPLPVGVWARTGADARRTGYARHVPDACRRACARPSAGLSAMRRGACDARVRASHGPSRCSTVHAHAAWLCIASRVLTLSRRISIDAALARRPRQRASRHLPDIVRSISEELSMTEHVSQTPDLSAFWMPFTANRQFKEAPRLLVAAKGMYYTSHDGRRILDGTAGLWCVNAGHGRDEIVAAVQAQAREMDFAPTFQMGHPKAFEAATKIARHTPGDLKHIFFTNSGSEAVDTALKIALAYHRARGEGQRTRFIGRERGYHGVGFGGISVGGIAPNRKAYSGALLPSVDHLPHTLNLKEAAFSKGQPAWGAHLADELERLVALHDASTIAAVIVEPVAGSTGVLIPPQGYLERLRELCDKHGILLIFDEVITGWGRLGAPFASQFFGVTPDLLTMAKGTNNAAVPMGAVAASGAIHDAIVDGAPAGIELFHGYTYSGHPLAAAAAVATIDLYEREGLLTRAAQIAPIFEREIHKLKDARHVIDVRNLGLVGGVELKPRDGKPGARAYEVFVKCFANGAMIRYTGDILAFSPPLIVEEAQIVELFSIVAQALKETE

SEQ ID NO: 15425 - protein, 320 aa, Oryza sativa
MFYAGYGYHGSNFEQTYRCYPASFFDKPHLEGGDKVIMPPSALDRLASLHIEYPMLFELHNDATQRISHCGVLEFVAEEGMIIMPYWMMQNMLLQEGDTVRVKNTTLPKGTYVKLQPHTTDFLDISNPKAILEKTLRNFSCLTTGDSIMVAYNNKQYYIDIVETKPASAVSIIETDCEVDFAPPLDYKEPENPQQPSVPASEATAEDENAKVEDELKFKPFTGSGKRLDGKASKLQATEVPSASRSSPSDSNKRVNQETLAPASSGASNSTRQKSGKLVFGSSANNNKEPQKASVKDDESPKKDEPKFQAFSGKSYSLKR

SEQ ID NO: 15426 - protein, 691 aa, Synechococcus sp. CC9311
MSTIHRGSPWPLGSTITPRGVNFSVAAPTANRLELLIFSHPEAKTPEQVIELSEEHRSADYWHVEVEGVGAGCCYCYRVFGPIEPGGHGFRPAKVLVDPCARAIDGWNIYQRAAATGASPNTDRCLKSVVCERDPFDFQAHPRPRHSWQETVIYELHIGGFTKRPDSGVSPDQRGTYLGVIEKIPYLKELGVTTIELLPIQAFDPNDAPAGRDNVWGYSPLSWFAPHHEYATGSDPHSARDQVRDLVAACHDEGIEVLLDVVYNHTTEGNRNGPTLSWRGFADRNYYHQSDAGEYMDVSGCGNSIAANDPLSRQLILESLRCWSNELGIDGFRFDLGIALSRGEKLKPLEHPPLFEAMEADPQLSELKLVSEPWDCGGLYRLSDFPAKRIGTWNGHFRDALRSFWKGDEGSTWPLGQRFRGSPDLYNGKAASLGSSVNLITAHDGFSLLDLVSFNNKHNLANGENNRDGENHNNSWNHGVEGPSSDRAIQTLRRRQQRNLLSTLLLSRGVPMLLMGDEVGRSQGGNNNTWCQDSPLSWMIWGDDHCDHELQAYVQRLLNVRQQLAVLFNPIRPHIEKKPLRSNDSDELWRQWHGVELSKPDWANWSHCLAMSLQQGHQGAVLWMGFNAYFKSMHFDLPEAASPWCRLIDTALPAGEDLPTRIERWSPSGVPLEARSLVVMVAQEYADRLSL

SEQ ID NO: 15427 - protein, 148 aa, Prosthecochloris aestuarii DSM 271
MNTVASFHAAGLAGINSKPLLSMSFTIPECLFCRIVGGEIPADIIYSDEHVIAFRDIEPVADHHILIIPKKHIASLSHLAEEDMTIAGHIMLAARKVAEKVGIAESGYRLVFNTGPDSLQSVFHIHGHLIGGQKMGWPPFPASPVKHG

SEQ ID NO: 15428 - protein, 208 aa, Pyrococcus furiosus DSM 3638
MEEVTFRIAPEEKVKKKPSFLKPWFGLKYLFKKPVTIKIPYEFIEPAPRYRGFHTLDWKKCIGCNMCGQICPARAIEMTWIEGEKRPHPKIDYGRCTFCQFCVDVCPTGALGFIETYMLTTTWREEELLLYDWVPIEPEKFKEIQEKFKDYKFPVEKIEFNKETKEVTYYLRDGTTFKFKILGYGLKPPVKPQPTTKQQEEEKKESGQ

SEQ ID NO: 15429 - protein, 391 aa, Pyrococcus furiosus DSM 3638
MVSQEELIREARQNGMELYPIDKDTYELFFGPQHMATENFSIILKMDGNRVVKAIANPGFLHRGFEKLAEYRPWYTNIALLLRICVPEPDVPEAIYSMAVDEIIGWEVPERAQWIRTLVLEMARVTAYLFWIMGLSFKLGVYTAGQWAAAYRERFMALFEQLTGARVYHIYTIPGGVRRDIPGDKWLRQVRDTVEYLKDKLKDFDNVLFENYITYKRLEGIGVMDKKFALEEGVTGPNLRATGVAYDVRKSDPYLLYPELDFEIPVLKEGDALARVLVRRYELEQDLYIIEQLLDMGPPSGPYKVQDPKLKNLPRFKVPPGEAFAHVEATKGDFGAYVVSDGGHKPYRVHIRGPSIAHGVRVLEQLLVGARLADVPAILMSLDNCPPDIDR

SEQ ID NO: 15430 - protein, 736 aa, Salinibacter ruber DSM 13855
MAKELERDLGLPSVLAISIGAMVGSGIFILPALAMKMAGPAVVLAYLLAGVLVLPAALSKAEMATAMPEAGGTYVYIERGMGPLLGTIAGIGTWFSLSFKGALALVGGAPYIVLLFDVPPQALALGIAGVLIVVNLLGVKQTGRIQVALVAVMLAAMVWFVGGSLGDVDPVRFEGFFDEGIGGLLAATGFVYVSYAGVTKVASVAEEIEHPDRNIPLGLLGSLAFTTLLYVLVVTVIVGAAPTAGLAGSSTPVADVAGSTLIQWGVLVVVAAAILALVSTANAGLLSASRYPFAMSRDKLVPDALQHVSDRFDTPTTAITVTGGVVLAMIAFVPIDDIAKLGSAFKILVFILVNLALVAFRESDLDDYEPAFRDPMYPWTQGVGVLGGLALLSQMGLVPLVGAVLITGAGALWYGAYARRRVGREGVVRDELRRRVGQQAAERTRVALDTGQRADRVVVGTTEDLRPDRETALVEVGAALTGAFEGGLTVVRFDAVPDQLPLDSAAEVQSPDDVDFETRMDRFGASVDGPFEYGEVVSHDVRHAVANFARHHAVDLLVLERTLSADRSWLDERDLDWISRHCSADLVLVEPTPLAVLDRIALVTDNGPFDPRKVELANGLAAAAGASLVLGHAVPADATEDQRATVRTYHEDLMGLCTVPVESNIVGTTTPAAMARAVSAADLVVVESDAAWWARLLDNREPQRIAGAFGGPAIVVRPQQAEGPSPVRRLLERVAF

SEQ ID NO: 15431 - protein, 391 aa, Synechococcus sp. CC9311
MKAMILAAGKGTRVQPITHVIPKPMIPILQKPVMEFLLELLKEHGFTEVMVNVSHLAEEIENYFRDGQRFGVEIAYSFEGSIQDGELIGDALGSAGGLKKIQDFQTFFDDTFVVLCGDALIDLDLTEAVRRHRAKGALASLVTKTVPKDQVSSYGVVVSDDDGKIQAFQEKPSVEEALSDTINTGIYLFEPEIFEHIPSGTSFDIGADLFPTLVKQGAPFYALPMDFEWVDIGKVPDYWQAIRSVLQGEVRQVGVPGKEVKPGVFTGLNVAANWDKINVEGPVYVGGMTKIEDGATLIGPTMIGPSCYICEGATIDNSIIFDYSRIGAGVQLVEKLVFGRYCVDKEGDHIDLQEASLDWLITDARRQDLVEPSPQQKAMAELLGTDLTQAS

SEQ ID NO: 15432 - protein, 128 aa, Triticum aestivum
  misc_feature (31)..(31): Xaa can be any naturally occurring amino acid
  misc_feature (49)..(49): Xaa can be any naturally occurring amino acid
  misc_feature (57)..(57): Xaa can be any naturally occurring amino acid
  misc_feature (79)..(79): Xaa can be any naturally occurring amino acid
  misc_feature (100)..(100): Xaa can be any naturally occurring amino acid
  misc_feature (104)..(104): Xaa can be any naturally occurring amino acid
  misc_feature (110)..(110): Xaa can be any naturally occurring amino acid
MNMVHGKLEVLLVSAKGLEDTDFLNNMDPFXVILTCRTQEQKSSVANGXAGSEPEWXNETSVFTVSDDTPAVHLKIMDXDLTNDISSGEQHPLGAVFQRXTFPXGGHPAXKEENYAEGSHLIPTTDPA

SEQ ID NO: 15433 - protein, 216 aa, Triticum aestivum
  misc_feature (25)..(25): Xaa can be any naturally occurring amino acid
NDADRSESGSTTRRAENHPLLQETXRPTYRNFLNELLNVNNISTSNTKINGEESGGHDDELVSRLMMLGHCKEKELAVKILKTIKFLGLHEETQIPKDCSSAFSVICQRMEQRMAYGHNEQDMVLLHHEVEVEYPDGRPTEKHQATLMEFGKTENGRSTTAMALTVGVPAAIGALLLLQNKVQKKGVIRPLQPEIYIPALEILEASGIKVIERVET

SEQ ID NO: 15434 - protein, 312 aa, Corynebacterium efficiens YS-314
MTETNGSTTDNAHHETTDQLTFQNPVTRYPEIEPPIQDQPEPGLDADLVPKTDRGEFSYRGTGRLKGRRALITGGDSGIGAAVAIAFAREGADIALNYLPDEEEDAQWVRDVVEKDGRKITLLPGDLADAEFCRQLVTDAVDTLGGLDILVNNAGRQIAQDSLEDLTDEQLEDTFNVNILAMFRITREALKHLEPGSSIVNTTSIQAYQPSANLLDYASTKAAINNFTKGLGQQLAPKGIRVNAVAPGPFWTPLQVSDGQNKEDLPEFGKNTPLGRAGQPTELAPAYVFLASSESSYVIGETLNVNGGTPAP

SEQ ID NO: 15435 - protein, 376 aa, Aspergillus oryzae
MSSTVGKAAIAWAAGEPFSVEDVEVAPPKAHEVRIKIIHTGVCHTDAYTLSGKDPEGAFPVILGHEGSGIVESVGEGVTTVKPGDQVIALYTPECGECKFCKSRKTNLCQKIRTTQGKGVMPDGTSRFRARGKDILHYMGTSTFSQYTVVADISVVAVTTKAPTDRACLLGCGITTGYGAATVTANVEQGSNIAVFGAGCIGLSVIEGAVKNKAGKIIVVDVNDGKEQWARKFGATHFINPTKVKNGKTIQEELIELTDGGCDYTFDCTGNVGVMRAALESCHKGWGESIIIGVAAAGQEISTRPFQLVTGRVWRGCAFGGIKGRSQLPGLVDDYVAGYLKVDDYITHRESLGTINTAFQHMKSGDCIRCVLDMKV

SEQ ID NO: 15436 - protein, 417 aa, Aspergillus oryzae
MSSKEKVVIIGGGWGGYRLGYGIDHRKYDITLIAPDNTSAVTPLLASAACGLFDPRLAHEPIRRKDFHAKYIKAFVVDIDFSRQVLVCQPAFEELKEDRFEVSYDRVILTPGCRSNTFGIPGVAENAIFVKTVANANTVRTRLNDILEMASLPGISEARQRQLLHIVIVGGGPTGIEVAAELTDLFEGDLGILFPHLKGLTSVSVIDVAPQILAPFDQRLSEYACSALKTNKVKVKLNCHIVNVTKDTIETRESGITGYGMLIWATGNRSIPLVDQLQLRKTEHGLVRILTDDHLNVFSPDGNVIPNVFAMGDAADIEGGTLPTTAEVAIQKADYLIRLFNSGLKDTRPFKYQQRSLVTYTGAWDGVVQGQREYTGYGAWLSWRSGNFFWTRSWRRRVLMCYAWFMDWLDGREIIRN

SEQ ID NO: 15437 - protein, 540 aa, Aspergillus oryzae
MGAGRGSPTVAGGQAIAYGPTGYKGIIKEPRIFGLACFASIGGFLFGYDQGVISGVLVMNSFVSHCLVHLISYHIKRLQSCVNTCLVSIMTLGAMCGAFANGPISDSLSRRWSILCANIVFLIGSVIQCAAENVAMLFVGRFVFGCAVGMLAMVVPLYLSELATPNNRGALVALQQLSITLGIMSSFWINYGTQYIGVRLLGESSFALQCLPSAILAIGTFFLPYSPRREEEAKQVLVRLRRLTATDYRLTLEFLEVKAARVFDEESRLAKYGDNSSRFQIAWNQYKELFTVPHLRRRTTIACLLQILQQFTGINAVIYYAPQFFEAIGLRGNSVNLLATGVVGIVFFICTIPAVMYLDQWGRRKTLILGSIGMSIAELIVATLYAVHPAAGWAACVFVWVYIGTFAFSIACVNWVMPSEMFPPATRGKAVGVAIAANYLSNFIVALITPWMLQSITFGTFYFFLVFSITLGVWTYFCVPETNGVPIEEMDTLFGGNEGEADLQRIASIRARLGFETSEDRKMVLEETKHDSVEHCERVD

SEQ ID NO: 15438 - protein, 558 aa, Zea mays
  misc_feature (221)..(221): Xaa can be any naturally occurring amino acid
  misc_feature (232)..(232): Xaa can be any naturally occurring amino acid
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDLGVHSRLDQLQLLLKGVSERGAKKIRVHILTDGRDVLDGSSVGFVETLENDLLELRGKGIDAQIASGGGRMYVFLDRYENDWDVVKRXGWDAQVLGEAXPYKFKSALEAVKTLRAQPKANDQYLPPFVIVDDSGKAVGPVLDGDAVVTINFRADRMVMLAKALEYADFNNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILDAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 15439 - protein, 493 aa, Rhizobium leguminosarum bv. viciae 3841
MRSYQLFIDGQFTDGERGEHIETLDPYHGKPWAELARATRGDVDRAVKAAREALDNGPWSKLTATARGRIMRKIGDLITRDADRIAEIEARDNGKLLAEVRGQLNGVAECWYYYAGLADKIEGAWIPVEKPDTMAFTMREPIGVVAALTAWNSPIWFATVKCAPALAAGCTVVVKPSEFASASTLELAAIVKEAGMPDGAFNVVTGYGHDAGAALVEHPDVAMITFTGSDLTGAKIYETAAKQMKRVALELGGKSPNIVFEDADLDLAAAGVVSGIFGAAGQMCTAGSRLLVQKSIKDVFTTKLVDLARYIRMGDPMDPNTNVGPISTPPQFQKVLDYIEIARKDGARCILGGSRATGADLSAGQFVEPTIFSDVTNDMRIAQEEVFGPVLSIIEFDTEEDATRIGNDIAYGLVAGVWTQNIGRAMRMTKALKVGTVWVNTYRAYSFMMPFGGTKKSGLGRESGIEAINEYLETKSVFLSTATEGPTNPFIMR

SEQ ID NO: 15440 - protein, 395 aa, Mesorhizobium loti MAFF303099
MFLTFSGRELSREARLDDTTTVAIIGAGPAGLAVAACLRQAGVDFIIIEKEQQAAPAWRRHYERVHLHTTKRYSSLPFVPFPKHYPRYVPRALFVDYLDAYAQRFDLRPQFGETVKAVTQDGRGWRVDAASGPLRAKDVVIASGYNAEPLRPAFAGIDTFTGKTLHSADYRNAKPFAGQSVLVIGMGNTGAEIALDLAENGAQPTISVRGGVHIVPRELFGVPIQMVGMAARLGPQRLNDALFPVILDLVLGRLDKYGLKRPGQGLLEQIAVASRIPVIDVGTIGKIREGAIKVAPDITEISQRGARFADGKHGEFDAIIFATGYRPGYARFLEPGIQPDRSGVTPKASDLGLYLIGFHNAVTGLLREIGIEAQAIADDIRHRLNRKKAAEILPV

SEQ ID NO: 15441 - protein, 960 aa, Oryza sativa (indica cultivar-group)
MQMLLHANSLLLAPTTSRLSASASPGRSGTARPLPPPQGHAHSARAAARGTRRPPAVAAASPRTPMAVGEECAAAVASQGFVSDARAYWVTRSLIAWNVNDQDTSLFLYASRDATMHVSDGAIHGYDSKIELEPEHASLPDNVAEKFPFIRSYRTFRVPSSVDVTSLVKCQLAVASYDAHGRHQDVTGLQLPGVLDDMFAYTGPLGAVFSDKDVDLYLWAPTAQDVRVCFYDGPAGPLLQTVQLKELNGVWSVTVPRYRENQYYLYEVKVYHPSTSQVEKCLADDPYARGLSANGTRTWLVDINSETLKPASWDELSDEKPNLESFSDISIYELHIRDFSAHDSTVDCNSRGGFRAFTFQDSAGIRHLRKLSAAGLTHVHLLPSFHFASVDDNKSNWKFVDEAQLAKLPPGSDEQQAAIVSIQQEDPYNWGYDPVLWGVPKGSYASNPDGPSRIIEYRQMVQALNRIGLRVVMDVVYNHLDSSGPFGVSSVLDKIVPGYYLRRNVNGQIENSAAMNNTASEHFMVDRLIVDDLLNWAINYKVDGFRFDLMGHIMKSTMIRAKSAIRSLTRDVHGVDGSKIYLYGEGWDFGEVAQNKRGINASQINMSGTGIGSFNDRIRDSVNGGNPFGNPLQQGFSTGLFLEPNGYYQGNEADTRRELATYADHIQIGLAGNLKDYVLRTHTGEAKKGSDIYTFDGSPVGYTSSPVETINYVSAHDNETLFDIVSIKTPIGLSIDEKCRINHLASSMIALSQGIPFFHAGDEILRSKSLDRDSYNSGDWFNKLDFTYETNNWGVGLPPRDKNEENWHLIKPRLENPSFRPLKNHILSVFDNFVDILKIRYSSPLFRLSTASDIEQRVRFHNTGPSMVPGVIVMSIKDAQNEKCKMAQLDKNFSYVVTIFNVCPHEVSIEIHDLASLGLELHPIQVNSSDALVRQSAYEASKGRFTVPRRTTAVFVQPRC

SEQ ID NO: 15442 - protein, 380 aa, Halobacterium sp. NRC-1
MHDRAAVNTYGCLPGVPVLGARSRTPEGAAGSVTTLPLGVVDDCMRDTSREWVFAERPEGEPDMDSFELRERDVPEPRHGELLVRVRYLSVDPYMRGRMRDSDSYADPWTVGEPLSGGVVGEVVESESDAYEAGDLVSGNGTWADYSLLDAANVAPVDPSVADLPAYLGVLGMPGRTAYFGLLEVGAPKPGDTVVVSGAAGAVGSVVGQIAKHNGCRVVGFAGSEEKVDWLTEDLGFDAGINYKQVDDYSAALDDAAPDGVDVYFDNVGGPISDAVFTKLNVDARVAVCGQIAHYNNEDVPTGPRKLPQLIAPRAKVQGLLVGDFATRFGEASEQLGQWVAAGDIEHRETVVSGLENAPDAFLGLFSGDNIGKQVVGVSE

SEQ ID NO: 15443 - protein, 376 aa, Thermus thermophilus HB8
MSRVPEPSVFLVVDEAKRKARERGVGLIDLSIGSTDLPPPEAPLKALAEALNDPTTYGYCLKSCTLPFLEEAARWYEGRYGVGLDPRREALALIGSQEGLAHLLLALTEPEDLLLLPEVAYPSYFGAARVASLRTFLIPLREDGLADLKAVPEGVWREAKVLLLNYPNNPTGAVADWGYFEEALGLARKHGLWLIHDNPYVDQVYEGEAPSPLALPGAKERVVELFSLSKSYNLAGFRLGFALGSEEALARLERVKGVIDFNQYAGVLRMGVEALKTPKEVVRGYARVYRERALGMAEALKGVLSLLPPRATMYLWGRLPEGVDDLEFGLRLVERGVALAPGRGFGPGGKGFVRIALVRPLEELLEAAKRIREALD

SEQ ID NO: 15444 - protein, 107 aa, Haemophilus influenzae R2866
METLDKIKKQISENPILIYMKGSPKFPSCGFSARASEALMNCKVPFGYVDILQHPDIRAELPTYANWPTFPQLWVEGELIGGCDIILEMYQAGELQTLLAEVAAKYA

SEQ ID NO: 15445 - protein, 372 aa, Legionella pneumophila subsp. pneumophila str. Philadelphia 1
MSSKSGGLAGVVAGQSAIATVGLAGKGLNYRGYSINDLAEYASFEEVAYLLHYGELPTQKELDVYIKKLVNLRHIPDVLKTVLKLIPKNTHPMDVLRTACSFLGTIEPEENFKQQYEIADRLLALFPGIMCYWYTYHFKNKEISGLSEEDTTGGHFLALLHGRKPSKIETDMMNVSLILYAEHEFNASTFAARVTAATLADFYSAITSAIGTLRGPLHGGANEAAMGLIERFKTPDEAAIGIKQMLASKELIMGFGHRVYTTCDPRSDIIKKWSFRLGEEKGNLLLYHISERIEEIMWQEKKLFPNLDFYSASAYHYCDIPTHLFTPIFVMSRITGWSAHVFEQRANNKLIRPTSEYIGPDSRPFPAIETRG

SEQ ID NO: 15446 - protein, 105 aa, Oryza sativa (japonica cultivar-group)
MVRKAKVEFDESPPDDFDPKNPYGDPVAMLEYREHLVREKWIQIETAKIIRDRLRWCYRIEGVNHHQKCRHLVDQYLEATRGVGWGKDARPPELHDPKKVVEADE

SEQ ID NO: 15447 - protein, 433 aa, Legionella pneumophila subsp. pneumophila str. Philadelphia 1
MGFSMSRSSDLFHKAQTIIPGGVNSPVRAFKGVGGEPVFFKSGKGAYLTDVDDKQYIDYVGSWGPLILGHCHPKVIEAVDNVLHRGMSFGAPTELEIQLAEKIASLMPSIEKIRMVNSGTEATMTAIRLARGFTNKNKFIKFNGCYHGHSDSLLVKAGSGLLTLGIPSTPGIPQSITEHTLTADFNNLEQVAQLFEKYPNDIATVILEPIPGNMGFILPKIEFLKGLRELCDQYNALLIFDEVMTGFRVGLHGAQGLFGIKPDITTLGKIIGGGMPVGALGGKREIMSFLAPEGPVYQAGTLSGNPLAMAAGLATLKEIEKINFFEDLSNTTNKLTEALADAAENANIPFFAASLGGMFGFCFTDKNSVENYLDVASSDEVLFKKFFHAMLAQGVYFAPSMYEAGFVSSMHGDLEIQKTYDAAELVLNQLKSA

SEQ ID NO: 15448 - protein, 298 aa, Ustilago maydis
MDKYQRIEKVGEGTYGVVYKAKDLTPGANGRIVALKKIRLETEDEGVPSTAIREISLLKELRDDNIVRLFDIVHQESRLYLVFEFLDLDLRKYMDHVSRNRGGDGMGPEIVRKFTYQLIRGLYYCHAHRILHRDLKPQNLLIDREGNLKLADFGLARAFGIPLRTYTHEVVTLWYRAPEVLLGSRHYSTAIDMWSVGCIFAEMTLGHPLFPGDSEIDQIFKIFRALGTPTDDVWPGVQQLPDYKDSFPKWAGRPLRDAVPGLDEAGLDLLEGMLVYDPAGRTSAKRSLVHPYFRRLLT

SEQ ID NO: 15449 - protein, 151 aa, Glycine max
MGAFTEKQEALVNSSFEAFKANLPHHSVVFFNSILEKAPAAKNMFSFLGDAVDPKNPKLAGHAEKLFGLVRDSAVQLQTKGLVVADATLGPIHTQKGVTDLQFAVVKEALLKTIKEAVGDKWSEELSNPWEVAYDEIAAAIKKAMAIGSLV

SEQ ID NO: 15450 - protein, 475 aa, Streptococcus mutans
MTKQYKNYVNGEWKLSENEIKIYEPASGAELGSVPAMSTEEVDYVYASAKKAQPAWRALSYIERAAYLHKVADILMRDKEKIGAILSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFTGSTGIGERIGKMAGMRPIMLELGGKDSAIVLEDADLELTAKNIIAGAFGYSGQRCTAVKRVLVMESVADELVEKIREKVLALTIGNPEDDADITPLIDTKSADYVEGLINDANDKGATALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 15451 - protein, 784 aa, Bacillus cereus ATCC 10987
MKGVILAGGKGRRLRPLTCNTPKPMLPLLEKPVLEYNIELLRQHGIREIAITVQYMSTAIKQYFGDGSKWGVNLYYFEDSPPLGTAGSIKQAEKFLDEPFVVISGDALTDFQLSEGITFHEQKKRMVTMFVKEVENPLSFGLVVMNKEQEVTRYIEKPSWNEVVSNIVNTGIYIMEPEIFSYIPPREFFDFSQDVFPLLANKNALFAYLSEGYWLDIGTFDQYRQAQFDLLTKKLQVPIPYTEVLPMVWMGEGVTIGKGTKIHGPSFIGEGARIGAGSVIEPYSIIGKNSVVSSYSHLQKSIIFANAHIGKYCELLETTIGEHTMVEDDVTLFQKSIVADHCHIGKSTVIKQKGKLWPYKAIDSHSVVGSAGVQESEKSAGWLQKSRIVGRGNVEITPQFIVKVAMAYGSLFTKGESILIGSQEHIETTSYKNLFLHAIHGIGIHTMECKEMNESLFQYSIQDLQCAGGVFIQAEKEKEIVIKLYGKDGAQLTYKQQKAIEQVYMSESFYYVCEKEMGRNKLVHVSLHNYIEAVLERIDIEKIKKQKFHLLINKRNDMLQHLLMLFLQRLGCTVTWIYAGEQKDHVKALMKSSKANMALMFSEQGNYFELYDNHSNIYQGTDFEEIDIPDLLLESAGNIYPMSLKLGECYLLFYTQDEKKSFQARWKRDILYRIGKLFELIALQGKTFLSIVEQSPPLYLLCDEVVCSWNEKGKVMRKLLADIERKEEGIFEGVQFKYTEKEWSYIVSDTKQPKFLVYSHARNPVIARENMKNLIEKIRQYQKV

SEQ ID NO: 15452 - protein, 355 aa, Triticum aestivum
MNAALTVAVAGEEIDEAVAGEEIDEAASRAQADMSEIMSSLPRCPVYLTRHYRGFWIREFVLKGMAAAQASFEPRPTDVFLASCPKSGTTWLKALAFATLNRATHLPSDSNHPLCHRNPHDCVAFLQTRPVPETMALPSPRLLATHIPCSLLPSRITECGRVVYVCREPKDALVSFWIYNNKIAPMLRRKFGLESPSPTFEEAFELFCEGQSSSGPPWRHALEYWEESRRRPGKVLFLRYEDMLQDPTGNANNLAAFMGCPFSCAEEEAGVVQEIVQLCSFEKLKSSEVNKNGSSAMMGVNNDVYFRKGAVGDWKNYMTPEMAARLDKIVQGGASRFRPDLWHLHVEGMGSELLL

SEQ ID NO: 15453 - protein, 234 aa, Mesorhizobium sp. BNC1
MKAYIAEVFGTFCLVFIGCGSVVLGGFGPLIPTGGALGIAVAFGVAVLAMAYAIGPVSGAHLNPAVTLGAFLAGRLPAKDVAPYMIAQVAGGILGALVLWIIASGKTGGAPANLAANGWSEYTTSAAFLGEVVATFIFVMVILGATSERHTTVMAGAVIGLTLTAIHICFIAVTGTSVNPARSIGPALFSGGAAISKLWLFIVAPLIGGALAGLVYKSHALENTQADLLKKAKA

SEQ ID NO: 15454 - protein, 90 aa, Triticum aestivum
  misc_feature (51)..(51): Xaa can be any naturally occurring amino acid
MAPTVMASSATSVAPFQGLKSTAGLPVSRRSNGASLGSDNNGGRIRCMHVXWPIGGIKKIMTLGYLPPLQIVGASWTGQLPGPFHGAAQN

SEQ ID NO: 15455 - protein, 270 aa, Staphylococcus aureus subsp. aureus MW2
METLNSINIPKRKEDSHKGDYGKILLIGGSANLGGAIMLAARACVFSGSGLITVATHPTNHSALHSRCPEAMVIDINDTKMLTKMIEMTDSILIGPGLGVDFKGNNAITFLLQNIQPHQNLIVDGDAITIFSKLKPQLPTCRVIFTPHLKEWERLSGIPIEEQTYERNREAVDRLGATVVLKKHGTEIFFKDEDFKLTIGSPAMATGGMGDTLAGMITSFVGQFDNLKEAVMSATYTHSFIGENLAKDMYVVPPSRLINEIPYAMKQLES

SEQ ID NO: 15456 - protein, 336 aa, Streptomyces coelicolor A3(2)
MTTSSDVIPDAPQPAGDAAGPSATLGGEQKRSIEQITLLLFITLPFLALVAAVPLAWGWGVSWLDLGLLVFFYFLGCHGITIGFHRHFTHGSFKAKRPLKIALAIAGSMAVEGPLVRWVADHRKHHKFSDDEGDPHSPWRYGETVPALIKGLWWAHIAWMFDEEQTPQEKYAPDLIKDPALRAVSRQFILWTVVSLALPALIGGLVTMSWWGAFTGFFWGSLVRVALLHHVTWSINSICHAVGKRPFKSRDRSGNVWWLAILSCGESWHNLHHADPTSARHGVMRGQLDSSARLIRWFEQLGWAYDVRWPSRSRIDSRRNTDQDGARRRKETAKAA

SEQ ID NO: 15457 - protein, 311 aa, Pyrococcus furiosus DSM 3638
MITAFGEVLIDFIAAEEGDLENVKIFEKHPGGAPANVAVGVSRLGIPSFLVSKVGDDPFGRFLIRRLKEEGVNTEGVLIDNEKHTGVVFVQLKGAKPSFILYDEVAYFNIKLSEVPWEILESSKIVHFGSVLLAREPSRGTMIKVIETLKEKSLVSFDVNIRKDLWRSEEELVETLKRVLSNVDILKLSDEEFNLLKEYGLEPRGKLITAITYGAEGCRIESDEASIFVPAYKVSPVDTTGAGDAFVSALLVGLLALDKQKLEESDMFLLGKFANLVAGLSTQKRGAWSVPRREELEKYEEGRKIFSLITL

SEQ ID NO: 15458 - protein, 548 aa, Burkholderia thailandensis E264
MSQAIEVKVPDIGDYKDVPVIEVLVKPGDAVEPEQSLVTLESDKATMDVPSPSAGTVKEVKVKVGDAVSQGSLIVLLDGAQAAGRPAQANGAAASAAQPAAAPVAAAPAPVAAGGGTVDVRVPDIGDYKDVPVIEIAVKIGDTVEKEQSLVTLESDKATMDVPSPAAGVVKDIKVKVGDAVSEGSLIVVLEASGAAAASAPQAAAPAQAAPAPAAAPAPAPQAAPAPQAAPAAAPAPAASGEYRPSHASPSVRKFARELGVDVSRVAGTGPKNRITKDDVTAFVKGVMTGQRAAPAAAAPAGGGELNLLPWPKVDFSKFGPFEAKPLSRIKKISGANLHRNWVMIPHVTNNDEADITDLEALRVQLNKEHEKAGVKFTMLAFVIKAVVAALKKFPTFNASLDGDNLVFKQYYHIGFAADTPNGLVVPVIRDADKKGLVEIAKEMAELSKAAREGKLKPDQMQGGCFSISSLGGIGGTHFTPIINAPEVAILGLSRGQMKPVWDGKQFVPRLTLPLSLSYDHRVIDGAEAARFNAYLGALLGDFRRIIL

SEQ ID NO: 15459 - protein, 123 aa, Sporosarcina pasteurii
MKTIHLGIGGPVGSGKTTLVKTLSEALKEEYSIAVITNDIYTREDANFLINENILEKDRIIGVETGGCPHTAIREDASMNFEAIEELKNRFDDLEIILLDEIIAWIKSDLLLEGKTNESASRV

SEQ ID NO: 15460 - protein, 413 aa, Frankia sp. EAN1pec
MRSPRVLGLVLAGGAGKRLAPLTADRAKPAVPFGGIYRLVDFVLSNLVNGGYLRIAVLTQYKSHSLDRHITTTWRMSNLLGNYVTPVPAQQRLGPQWFAGSADAIHQSLNLVHDEAPDVVVVFGADHVYRMDPRQMVAQHLETGAGVTVAGLRVPRSEGSAFGVIRTADDGVTIAEFLEKPADPPGLPGSPDEIFASMGNYVFTTDVLIDALRADAADPESVHDMGGSIVPMLVEQGTAAVYDFAANQVPGALERDHGYWRDVGTLDSYFDAHMDLCALDPVFNLYNRDWPIYTNVPPSVPPAKFVHDTPGRVGVATDSIVSNGVIISGGAVRRSVLSPGVRVNSWSVVENAVVMDNSVIGRRAVVRDAILDKNVVVPPGATVGVDKEHDRARGYQVSEAGVTVVGKGVTIAD

SEQ ID NO: 15461 - protein, 454 aa, Oryza sativa
MDSSSSFVLVVLILQAVVIGCSSLDELPVQLSNRRLLHDRNHAALLYKDHFPTVGNMTFPTSHQLQNDPNYKPLDSSSHPAEASANKGSSKGFKKWLYIVVIPVAGLIMLAGMAWMFLPCRKKSVATIGPWRTGLSGQLQKAFVSGVPQLQRPELERACEGFSNIVASHPYYTVYKGTLSSGVEIAVVSTTIKSSKDWSKHCEDCFRKKIESLSRINHKNFINLLGFCEEEEPFTRVMVFEYAPNGTLYENLHDEAFDHIDWRSRMRIIMGIAYCIQHMHELNPANVHPDLHSSAVFLSEDCAAKIADLSVWQEVVSDGKKSTANNDHHEPISARLAGNVYSFGILLLEIISGKPPYSENEGSLANLALGCIIKGRSIASMLDSVLESHKENELDVICQIIMECIQSDPTKRPGMREITTRLRETIAISPDAATPRLSPLWWAEVEVLSPVEPR

SEQ ID NO: 15462 - protein, 441 aa, Pseudomonas fluorescens PfO-1
MNKHIGTLARWRMQIFAVTWLAYAAFYFTRKAFSVAKLGIAEDPSFTLDKMAMANLDAIYLAAYAIGQFTWGMLADRFGPRIVVLGGLLISAAAALVMGSFATLPIFATCMLIQGLAQSTGWSGLCKNLGSFFPSEQRGRVLGLWSSCYAFGGLVASPFAGWWAYTLVGTWHAAFISSAAVVAAVAVLFFIFQRNKPEDVGLPAVEPEPVISAEEAEANSKLSVWEPLKEILRNRTVLVLGLAYFLLKPARYAILLWGPVIVFEQMPSVGKVGAAIIPTAFELAGLLGPIMIGLASDKLFGARRMPACVLSLLALTVTLALFMGALHTGSVMLVVALLFVMGLTLYGPDSMISGAAAIDFGKAKAGATAAGFVNGCGSVGAVLGGLLPGYFDSVTVFIVFAGCALFSALVLIPHWNSRPVGVMEPRAYVPNRALTVKPLRN

SEQ ID NO: 15463 - protein, 392 aa, Corynebacterium efficiens YS-314
MKALTWQGKRKVSVETVPDPILKAENDAIIQVTSTGICGSDLHLYEVLAPFMDEGDIIGHEPMGRVVEAGPASNLKEGDRVVIPFNISCGHCWMCKRGLFSQCEVTQVREYGSGASLLGYSRLYGSVPGGQAEYLRVPHADFGPIKVGDELPDHRYLFLSDVLPTAWQAVKYADVGEGDTLAVYGLGPIGQMCARIGRHLGARVFGIEPVPERRAMAARHGIEVFDLGDDTHDHIRDLTDGRGPDAVVDAVGMEAHGSPVGKLAHNAMSLLPDAAARKMMEHGGLDRLGALHGSIDLVRRGGTVSLSGVYGGEASPMPMLTLFDKQIQMRMGQCNVKSWIDDLLPLVEDPADPLGVDDLTTHRVSLDEAPAHYEKFQKKEDGCIKVVLDPTL

SEQ ID NO: 15464 - protein, 198 aa, Yersinia pestis KIM
MIMSVSALVCLAPGSEETEAVTTIDILVRAGINVTTASVAGDGALEIICSRGVRLLADTRLVDVADQKFDVIVLPGGIKGAECFRDSPLLVATVRQTHNEGRLVAAICAAPALVLEHHQLFPVGNMTGFPSLKDKIAPNKWMDQRVVYDRRVNLVTSQGPGTSIDFALKIVFLLLGREKAEEIAWQLVLPPGIYNYRE

SEQ ID NO: 15465 - protein, 413 aa, Triticum aestivum
  misc_feature (342)..(342): Xaa can be any naturally occurring amino acid
MAGGSTMQATVLGAPGVKGRKVRAFKRNGKDAGVTGVMRSIAGTEEQGAFFVFDLATVVDLYSRWCRALDGVRPYYAVKCNPEPAMLGAMAALGAGFDCASRAEIEAVLALGVVEPGSIVYANPCKPEAHLRYAAEVGVNLATYDTEDEVAKVKRCHPSCDLLLRIKGPDNPDAKIDLGTKYGARADEVVPLLRAAQRAGLRVAGVAFHVGACTSRVDVYRGAIEAARVAFDEAAQLGMPPMRVLDIGGGFMPNATFDEAAGAINDALAQHFPRGCGVEVIGEPGQYFAETAFTMAARVIGRRTRGEVRQYWIDDGIYGALSCTILGDYVPRPRPLAAPCPXAARTMCSTYASTVFGPTCDSRDKVVTGYQLPEMNVGDWLVFDGIGAYAASSGTNFNGFLIADIKTHLAYST

SEQ ID NO: 15466 - protein, 329 aa, Medicago truncatula
MMAGNPNWWSMHPSSLNIPPQYMLGSSSIPFNSLTENNAEVPPQSWSQLLFTGLPGEEERLGFNHFQPKNSENWDVQIMNPSSRVPFMDIIKHEVSQGENFYGQQGHHHEEFHANSGSLGSSWSHMVPVSSPSSHITSLSSDNILDFTYNKVDHSKNQLPDQISECNSSTTGVNKKARVQPSSSQPPLKVRKEKLGDRITALHQLVSPFGKTDTASVLLEAIGYIRFLQSQIEALSTPYLDTAASKNMMRNQHSVHVERNSVFPEDPGQLLDDTGLKRKGAPIPNQNAEGNKAKDLRSRGLCLVPVSCTQHVGSENGADYWAPAFGSGF

SEQ ID NO: 15467 - protein, 390 aa, Triticum aestivum
  misc_feature (41)..(41): Xaa can be any naturally occurring amino acid
ICLLGRGVSMAVNNVNSIIVPALVGKDPTVQTELDNFMVQXLDGTKNEWGWCMQKLGANAILAGLLAVCKAGASVKKIPLYQHIVNLVGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGEQVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 15468 - protein, 705 aa, Magnaporthe grisea 70-15
MASPLQFATRTLKDIRVFNADPAYADLPGFEKPTGNLRCCIYSPCGRYFAWASNEVVRVTDSNDGRVLAALSIPNVYELGFSPRGTFFITWERPGKDENGDATKNLKVWRTVEDLPEGTEKQPLGRFVQKSQNGWNLQYTNDEKYCARMVTNEVQFYDSNDLATVWNKLRVEGVSDFALSPGKAHALAVFVPERKGQPAAVKVFNVPQFTAPVSQKTFFKGDKVQLKWNALGSAIIVLAQTDVDKSNKSYYGETTLYLLSVNGSFDARISLDKEGPIHDVAWSPNSKEFGVIYGFIPAKITIFNQRAVATHSFPSGPRNTIIFSPTGRFVLVAGFGNLAGQIDVYDLERDYRKICTIESGSPSVCQWSPDSRYIMTATTSPRLRVDNGVKLWHVTGTLMYNEDMVELYNVLWRPVLPEHAPTGDALQPMPAPHASAATYMSTVKTPSKPAGAYRPPGARGSVTPLHFKREDEGGAAHSVSNGVSQLNINGFGRARHQVPGADFATVPGAGVPGAEAADDDGLSKAASKNKKKRANKKAKDAAAVEGGGASLAPPNNYNSDANGGRSPERNGRNYQHSHSRSQSRNNMNGGGGGGRSRSNTHRQAMGEGGGRARSRSARPQNRLANIQVSNLQGAAQAPVHSPISETAQNPQAKKQRGLQKKIRAIEDLEMRLAGGEKLEDTQMKKIGTKATVLKELEMLEKEMMH

SEQ ID NO: 15469 - protein, 158 aa, Legionella pneumophila subsp. pneumophila str. Philadelphia 1
MNSCIIMHFKLISLECMMAKELTLSIIKPDAVAKSVIGEIYTRFEKAGLDIVAAKMTQLSREQAESFYDIHRARPFFKDLVDFMISGPVMIQVLKGENAVAKNREIMGATNPKEAAPGTIRADFADSIDANAVHGSDSLENAAREIAFFFEQHELCNR

SEQ ID NO: 15470 - protein, 302 aa, Mycobacterium tuberculosis CDC1551
MMARQRFRDQVVLITGASSGIGEATAKAFAREGAVVALAARREGALRRVAREIEAAGGRAMVAPLDVSSSESVRAMVADVVGEFGRIDVVFNNAGVSLVGPVDAETFLDDTREMLEIDYLGTVRVVREVLPIMKQQRSGRIMNMSSVVGRKAFARFAGYSSAMHAIAGFSDALRQELRGSGIAVSVIHPALTQTPLLANVDPADMPPPFRSLTPIPVHWVAAAVLDGVARRRARVVVPFQPRLLMVGDAFSPRYGDRVVRLLESKIFGRLIGSYRGSVYRHQPTESAKAQAAQPERGYSSAR

SEQ ID NO: 15471 - protein, 463 aa, Sinorhizobium meliloti 1021
MSAFDYDLFVIGGGSGGVRSGRLAAALGKKVAIAEEFRYGGTCVIRGCVPKKLYVYASQFAEHFEDAAGFGWTVGESRFDWAKLVAAKEQEIARLEGLYRKGLANAGAEILDTRAELAGPNTVKLLASGKTVTAERIVIAVGGHPSPHDALPGHELCITSNEAFDLPALPESILIAGGGYIAVEFANIFHGLGVKTTLIYRGKEILSRFDQDMRRGLHAAMEEKGIRILCEDIIQSVSADADGRRVATTMKHGEIVADQVMLALGRMPNTNGLGLEAAGVRTNELGAIIVDAFSRTSTPGIYALGDVTDRVQLTPVAIHEAMCFIETEYKNNPTSPDHDLIATAVFSQPEIGTVGITEEEAARKFQEIEVYRAEFRPMKATLSGRKEKTIMKLVVNAADRKVVGAHILGHDAGEMAQLLGISLRAGCTKDDFDRTMAVHPTAAEELVTMYQPSYRVRNGERVG

SEQ ID NO: 15472 - protein, 506 aa, Oryza sativa (indica cultivar-group)
MAFLLFFVFVTAAVLCFVVPAFLLLCTSVQRRRDVGQGGGRDWQKKKKLRLPPGSMGWPYVGETLQLYSQDPNVFFASKQKRYGEIFKTNLLGCPCVMLASPEAARFVLVSQARLFKPTYPPSKERMIGPSALFFHQGEYHLRLRRLVQAALAPDSLRALVPDVDAAVAATLAAWSGGHVASTFHAMKKLSFDVGVVTIFGGRLGRRHREELRTNYSVVERGYNCFPNRFPGTLYHKAIQARKRLRAILSEIVAERRARGGGGDDLLGGLMRSRDDGTAGAVALLTDDQIADNVVGVLFAAQDTTASVLTWILKYLHDSPKLLEAVKAEQMAIYVANEGGKRPLTWTQTRSMTLTHQVILESLRMASIISFTFREAVADVEYKGFLIPKGWKVMPLFRNIHHNPDYFQDPQKFDPSRFKVAPRPSTFLPFGSGVHACPGNELAKLEMLVLVHRLVTAYRWEIVGASDEVEYSPFPVPRGGLNAKLWKQEAEEDMYMAMGTITAAGA

SEQ ID NO: 15473 - protein, 369 aa, Aspergillus oryzae
MLSDLPKIPTLDWADFAEGDTDQRLKLAQGLVQGFKRFGFVKLVNHGLSDELIQQLFAEVSRHSLLVKRFYRLPDELKQKAAHPPGPNPQRGWSGIGVESTSKLYGEQTERPSGKLKDAKVGTDFSSSKSSRELTHMKEHYDIGPPTDTQFPTRWPDEQDIPGWRAFMESYYARGQSFCLDLMEALEIGLELPKNTLRSMCIPDGSELRLLHYPEIPAAELRTGDTARIWPHTDFGLITLLFQDGVGGLEVEDPLQQGHYIEVAREQPYEMIVNVSATFERWMNGVIKAAVHRVNITPEGKHVEDAVVPERWSAAYFFKAHKMAHAGPLPAFVTPERPALYDDITALEFQKRRTDLVYTGQQLKVEEAA

SEQ ID NO: 15474 - protein, 231 aa, Sinorhizobium meliloti 1021
MDARQMKIKAAEAALEHVESGMRLGIGTGSTAEEFVRLLAEKVASGFQISGVPTSERTARLCLELGVPLKSLDELPELDLTIDGADEVDGKLRLIKGGGGALLREKIVASASTRMIVIADESKVVDVLGAFKLPIEINPFGQVATRLAIEKTASRLGLAGEIVVRSSGDGVFMTDGGHLILDASFGRIPDADALAVELNAIPGVVEHGLFIDVASMAIIAGPEGARTLTAS

SEQ ID NO: 15475 - protein, 234 aa, Zea mays
MCPTKKEMSAESSGSASSWTSASTSTSPEHQTVWTSPPKRPAGRTKFRETRHPVFRGVRRRGSAGRWVCEVRVPGRRGCRLWLGTFDAAEAAARAHDAAMLAIAGASACLNFADSAWLLAVPASYASLAEVRRAVAEAVEDFQRREAAAGDDARSATSPAPSTSGTDDDATTDGEESSPATEDSSFQLDVFDDMSWDLYYASMAQGMLMELPSAVPAFGDDGYTNIADVPLWSY

SEQ ID NO: 15476 - protein, 140 aa, Glycine max
  misc_feature (79)..(79): Xaa can be any naturally occurring amino acid
MDCKKRVRDDSDESVLESPEAKRLRDDLLEFFDDADDAASSQDLDSVMKSLQEEISGVASDSGESQAQIGYLLEASESXSDSSGIGELWEFEEQIPRYDLFDLGMGFGYECDTTEYAAFGGLFDHSDLYYDSWRHETLPT

SEQ ID NO: 15477 - protein, 92 aa, Glycine max
DNAKQKKQSLDPASPDFLPLPSFEQCFPKSACEHREVTHEETGHVLKAPFRRVHLCGEAGHFVPYDTGGAQNVNPWTGLPKLCGGWVFWREK

SEQ ID NO: 15478 - protein, 343 aa, Haemophilus influenzae R2866
MKDLDWNNLGFSYIKTDYRFIAHWKDGKWDEGKLTTDNTLHIHEGSTALHYGQQCFEGLKAYRCKDGSINLFRPQANAERMQRTADRLLMPRVPTELFVRACKEVVKANQDWLGPYGSGATLYLRPFLIGVGENIGVKTAPEFIFSVFCCPVGAYFKGGLAPSNFITTDYDRAAPMGTGGVKVGGNYAASLLPHELAAEQGTPERKFADAIYLDPKTHTKIEEVGAANFFGITKDNKFITPKSESILPSITKYSLLHIAKERLGMEAIEGDVYIDQLDQFVEAGACGTAAVITPVGGIQHNGKFHVFDSETEVGPVTRRLYDELTGIQFGDIEAPEGWIVKVE

SEQ ID NO: 15479 - protein, 517 aa, Candida albicans SC5314
MSKRSAEDDLSGNRSTSHTAIKTNKDSLPTTTNGKEEEPDNMDIGEFEDPYGDEFESDEEIIELDDNNDEEDDEMIDENSTQAKIEELEAKEQEQEQQSSIYLPHKSKPLGPDEVLEADPTVYEMLHNINLPWPCLTVDILSDSLGNERRSYPATVYLATATQAAKAKDNELLAMKASSLAKTLVKDENEEDEEDEDDDDDVDSDPILDSESIPLRHTTNRIRVSPHAQQTGEYLTASMSENGEVYIFDLSAQYKAFDTPGYMIPKSSKRPIHTIRAHGNVEGYGLDWSPLVNTGALLSGDMSGRIYLTNRTTSSWTTDKTPFFASQSSIEDIQWSTGETTVFATGGCDGYIRIWDTRSKKHKPALSVIASKSDVNVISWSSKINHLLASGHDDGSWGVWDLRNFTNNTTSNPSPVANYDFHKSPITSISFNPLDESIIAVSSEDNTVTLWDLAVEADDEEISQQRKEAQELHDIPPQLLFVHWQRDVKDVRWHPQIPGCLVSTGGDGLNIWKTISV

SEQ ID NO: 15480 - protein, 476 aa, Solanum lycopersicum
FYNFSKKLQGMAKTNGFMGHDMLAPFTAAWMIDMGPLVIDKAEGSYVYDVNGKKYLDSLSGLWCSVLGGSEPRLIEAANKQLNKLAFYHSFWNRTTKPSLDLAKELINMFTANKMGKVFFTSSGSEANDTQVKLVWYYNNAIGRPNKKKIISRKNAYHGSTYMTAGLSGLPSLHLKFDLPPPYILHTDCPHYWNYHLPGETEEEYSTRLANNLENLILKEGPETVAAFIAEPVMGGAGVIIPPATYFEKIQAVLKKYDILFIADEVICGFGRLGTMFGCDKYNIKPDLVSIAKALSGGYIPIGAVLVSEEISKVIMSQSNQLGVFCHGFTYSGHPVACAVALEALKIYKEKNITEVVNKLSPKFQEGLKAFIDSPIIGEIRGTGLVLSTEFVDNKSPNDPFPPEWGVGTYFGSQCQKHGMLVSFSGDHVNMAPPFTLSLEELDEMISIYGKALKDTEKKKKKKKKKKKKKKKKKKK

SEQ ID NO: 15481 - protein, 116 aa, Oryza sativa
  misc_feature (13)..(13): Xaa can be any naturally occurring amino acid
  misc_feature (39)..(39): Xaa can be any naturally occurring amino acid
  misc_feature (51)..(51): Xaa can be any naturally occurring amino acid
  misc_feature (75)..(75): Xaa can be any naturally occurring amino acid
  misc_feature (104)..(104): Xaa can be any naturally occurring amino acid
  misc_feature (110)..(110): Xaa can be any naturally occurring amino acid
MAPTVMASSATSXAPFQGLKSTAGLPVSRRSTNSGFGNXSNGGRIKCMHVXPLEGIKKFETLSYLPPLTGEDLLXHIEYLLRSKWAPCLDFSKGGFVYRENPRXPGYYHXTYWYHV

SEQ ID NO: 15482 - protein, 111 aa, Pseudomonas putida GB-1
MDIIDTIKEQIANNTILLYMKGSPNAPQCGFSAKASQAVMGCGEKFAYVDILQNPEIRANLPKYANWPTFPQLWVAGELVGGSDIMLEMFEKGELQTLIKEAAAKAKAAEA

SEQ ID NO: 15483 - protein, 298 aa, Crocosphaera watsonii WH 8501
MKQLSSLSSAQLSNWLMEASQEAKKGKLADYIPLLQRTDSSLLFICVVTKNNIFLTQGDSKITFSLMSIIKPFLLLYLLSELGDNFIFTKVGSEHSNYPFNSLDQLQLDQGFPRNPMINSGALTLASLLPGKDSHTRLNNLQEWLNKQSNANLFLDKLMLKSVESLPNLRNQSIIDNLTQRKHLKEPEITLDTYNKICCLSATIIDLAKLGLLLVNSPNISSKNVSIVTEIMTTCGLYEASENFAKKIGFPSKSGVSGAILSIVPKEGAIACYSPPLDAQGNSLGGLYMLQKIANYLN

SEQ ID NO: 15484 - protein, 462 aa, Xanthomonas campestris pv. vesicatoria str. 85-10
MSFESLGLAPFLLRALAEQGYETPTPIQQQAIPLVLAGHDLLAGAQTGTGKTAAFGLPLLQHLGTAPQTVNGPRKPRALILTPTRELATQVHDSLRGYSKYLRIPSAVIYGGVGMGNQLDALRRGVDLLIACPGRLIDHIERRSVDLSGIEVLILDEADRMLDMGFLPSIKRILTKLPRQDRQTLLFSATFEENIKQLALEFMRNPMQIQVTPSNTVAESITHRVHPVDGARKRDLLLHLLAQDSREQTLVFARTKHGSDKLALFLEKSGIKTAAIHGNKSQGQRMRALSDFKAGRVTVLVATDIAARGIDIDQLPKVINYDLPMVAEDYVHRIGRTGRNGSTGEAISLVAQDEAKLLRQIVRMLGRDVEIRDVPGYEPQTPIRWGNSAPGRAEQPGGERAPRKSHARRPHGDAPRQAHAHAGPKKPGGQRSGGPRQANAGAGAGRRDGGRGGNGRPANRGA

SEQ ID NO: 15485 - protein, 318 aa, Aspergillus oryzae
MTLRTVDFSGFLHGTEEQRRQVAAELVDCLKSLGFVRLINHEVPEKTIEGLLEQSKRFFTLPTSEKVKIANDPGPHPQRGWSRIGMEQTAKLREENLAEAAGREQYPNKWPESMPDFQPFVQESYQICQRTCFQIISAIELGLGLQAGRLTQCCQPAASEIRLLYYPPTTKNLFDEGLKKRAWPHTDLGIITLLFQDMVGGLEVEDRAAGKPRSFIPVKRVSPNEMIVNTSDSLQRWTNNVIRAGLHQVTAPDAAKLSNGVDMLPARCSSVFFFKAGRDTSVGPLPEFVTEDRPAAFEDMTALQYQQLKTRILHGVEG

SEQ ID NO: 15486 - protein, 324 aa, Legionella pneumophila subsp. pneumophila str. Philadelphia 1
MPDITLVEAVTQALAYELAHDENVVVFGEDVGKNGGVFRATVGLQDRFGENRVFDTPLAESMIAGLAVGMSIQGLKPVAEFQFMGFIYPAMNQIISHAARMRNRTRGRLHCPLVYRAPFGGGIRAPEHHSESTEALFAHIPGLQVVIPSSPKRAYGLLLAAIRNPDPVIFLEPKRIYRLVKQPVPDDGQALPLGKCFTLQQGDDLTLISWGASMHETLQAAKQLTDEGISCDVIDVATIKPLDIETILSSVEKTGRCVIVHEGAKTCGVGAEISAQIMEHCMADLLAPVQRVTGYDTVMPYFQLEKQYIPSIARIKNTVMSIME

SEQ ID NO: 15487 - protein, 421 aa, Rhizobium etli
MDTHRVVVVGGGFAGLQLAKDLKCPDTSITIVDRRNHHLFQPLLYQVATTVLATSEIAWPIRALFRGRKDVSTLLGEVVGVDTEARVVSLKDGNAIPYDTLVLATGARHAYFGRDEWEPFAPGLKALEDATTIRRRLLLAFEKAELEADPERRKAMLTFSIIGAGPTGVEMAGIIAQLAQRTLVEEFRSIDTRSARILLIEAGPRVLPVFPEALSRYAEQSLIKMGVEVRTGIPVTACNENGIAIGDEFVSSRTVIWAAGVQASNAAAWVGAEKDRAGRAVVQPDLTVGGKPEIFIIGDTASVKAADGTPVPGVAPAAKQQGKYVASVIEARRLGTPTPSAFRYRHLGNLATIGPNSAVIDFGKIRLKGGIAWWIWGLAHIYFLIGTRSRLAVGLSWLWIFVSGHHSARLITQKETLKDEV

SEQ ID NO: 15488 - protein, 183 aa, Pseudomonas fluorescens PfO-1
MTYRALITLAEGIDDLQCVTLIDVLRRAGIEVVAASIEGRRMLTCARGTRLTADGMLIDVLAQTFDLIVLPGGAVGAQHLAAHQPLQQLLKDQASAGRLFAAIAEAPAVALQSFGVLRQRRMTCLPVSSHNLSGCTFVDQPVVVDGNCITAQGSGAALAFALTLVEQLAGKAVRAKVAGELLA

SEQ ID NO: 15489 - protein, 468 aa, Bacillus cereus ATCC 14579
MIIGGGITGLTAMYNLQKNIHEKNLPIDTLLIEASGKLGGKIQTVRKDGFTIERGPDSFLARKESAARLVKELGLGDELVNNQAGQSFILVNNRLHKMPNGSMMGIPTQITPFLFSGLFSPIGKLRAGFDLLMPRSKPVSDQSLGQFFRHRLGNEVVENLIEPLLSGIYAGDIDEMSLMSTFPQMYQIEQKHRSISLGMRTLAPKEEKAEPKKGMFQTVKTGLESIVKSLEAKMHEGTIIKGTRIEKVAKQGDGYTITLSNGKEIEADAIVVATSHKVLPSMFAQYKQFRFFRNIPSTSVANVALAFQKSAIQRDINGTGFVVSRNSDYTITACTWTHKKWPHTTPEGKTLLRCYVGRAGDEAVVEQTEEELVQLVLEDLRKTMDITEDPEFTIVSRWKEAMPQYTVGHNERMKKLTTFMEKELPGIYLAGSSYAGAGLPDCMNQGEEAAKRVLFHLEKVIDAELIAQ

SEQ ID NO: 15490 - protein, 395 aa, Oryza sativa (japonica cultivar-group)
MLAAVRRRRLLLLPLPLRFFSAAAAAASTTTDPKVVSYLISSCGLTPAAAARAAATSPWLPLASPDFASNADAVVALLRRYGFTDADISATVRAFSRILASDPARTLQPKLDYLRSVGITAPLLPRVVSLSPVILHRSIESHLAPLIASLREVLGSDSRIVTALRQMPFAMRCSPKATFLRTLPVLRDVHGLTPSELSKLVASQPGVILLGPGRAGEIVQAVKDAGVEPGSPMFVYIFAAFSKLKAPTLENKFAIYRSLGFGKDDIAVMLRRLPNAAGISEERLKRTVGFLTGKAGLRREDIVAYPNLLSRSLDSHARRCAVLAVLRREGKPEGQHRVPHVLVASLARFMKAYVRRYEGEVPDVLRAINGEIPFEGFGLGELEKKKPQRQEKIRR

SEQ ID NO: 15491 - protein, 492 aa, Burkholderia xenovorans LB400
MKQYKNFINGRFVESDKRFAGINPATGVRFADVHEATREMVDEAVSAGHRAVRGWGSASVSDRADMLYRIADEIDRRADDFLTAEVSDTGKPVSLASKLDIPRGAANFRIFADILKTAPLDTFRTDLPGGSHAINYAVRKPLGVVGIISPWNLPLLLFSWKVAPALACGNAVVAKPSEETPGTATLLAEVMQTVGLPAGAFNLVHGFGPNSAGEFITTHPGINAITFTGESKTGTAIMHAAAEGVKPVSFELGGKNAAIIFADCDFDKTVAGMTRAAFLNSGQVCLCSERIFVERPIYDRFVKALAERAKQIKLGDPTDEATCMGPVISAAHRDKVLSYYALAREEGAEFITGGGTPSFGNQLDGGFWVEPTLLAGLPDDARCVTEEIFGPIGHVTPFDSEAEVIQRANATPYGLAATIWTSNVNKAHRVAQSMNVGVAWVNAWFLRDLRTPFGGSGLSGIGREGGLHSLNFYSELTNVCIHVDAPDGSHDR

SEQ ID NO: 15492 - protein, 385 aa, Ipomoea batatas
KIFVLTQFNSASLNRHISRTYFGNGVSFGDGFVEVLAATQTQGETGMKWFQGTADAVRQFTWVFEGAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLFRLLRWRYPTSNDFGSEILPAAVMEHNVQAYIFRDYWEDIGTIKSFYDANLALTEEFPKFEFYDPKIPFYTSPRFLPPTKIDNCKIKDAIISHGCFLRECTVEHSIIGERSRLDCGVELKDTLMMGADTYETESEIASLLADGKVPIGVGENTKIRNAIIDKNVRIGKDVVITNKDGVQESDRPDEGFYIRSGITIIMEKATIRYGTVI

SEQ ID NO: 15493 - protein, 315 aa, Ostreococcus tauri
MSTFTDLALSVERRVDGAIEKVWSEILERFHPFVIAGPLTFAYHELVYFGAWMPWLAMDRFEYFQKWKIQREKRPSAEMVMKCVVKLLKSHVFVQLPMQMMFYFVAPYFGFSLALEALPKSRDFLWQIPVFFVIEDFYFYWIHRFLHHKRVYKYVHKVHHEHKYPFGIAAEYAHPVETFFLGIGTLLGPLFFAKHMVTLWVWLFFRLLETVEDHSGYDVPWNPTNLIPFWGGAVHHDFHHKTFEGPYSSVFTWCDWMFGTDKEFRAHQPSFEVVRSRGRTRRCSEGHQTTRPWLRRAPPQKSSTSLVFFQLKESR

SEQ ID NO: 15494 - protein, 253 aa, Oryza sativa (indica cultivar-group)
MESAPASRVRREDVARAVAALLRWLQHHPTPAPEPIYLLVTLKRAPARRFEHTLRLPRSPFPSISLVSDRLPADLPDDIDPLPSPALGSLPPAARRGLVLVDRRLRVRPGGKGKAAAKAARVVPVDLADQAWADSAREAARRVELRVEGGTCRAVRVGHAAMAREEAVENVVAAVEAAAACVPRKWRNVRALHVKAPESVALPLYSAVGTGGGDDGGNGEAEDAKRKGVAVKEQGIVKRRKKSSSVSVGGDQL

SEQ ID NO: 15495 - protein, 457 aa, Candida glabrata CBS 138
MSSADPRLGMSYSSGDNTSSTPISIPIPRSGRTVVNNNASSSTIASYPRTTPSVATTGSGYLPMGTSVTTEETLASSQSSHSPFRDNTLLQTNSIASNTNTSHLISSNDTVSSTVEVLQSPTNPADEMASLRESIARPAYDHTTRDETILGTTERDEPRVSFAHDENLTRRDHYPGHESATENDNDTCTINNDDDNDDADMLTNHEEQLKFIRSHYRTKLNAKSETEEIEEVEEELNIAEFPTDKLLEMLTALLNKIIKSNDQMEPYKDKDKDEDHDDDESLTDSKLMSVKGTDKEKYLKSILSFKGKHVPQITLYQYFQRIQKYCPTTNDVFLSLLVYFDRISKKCNSSDSESADTSPADQLFVMDSYNIHRLVIAGVTVCTKFFSDFFYSNSRYARVGGISLSELNHLELQFLVLCDFELLISVDKLQRYANLLLRFWNNQGVDDSRSDTTVSQD

SEQ ID NO: 15496 - protein, 417 aa, Idiomarina baltica OS145
MSQLSYKAGQLHIESNNLSALAEQFGTPLYVYSKSQILANWQKFRAFWPSQHKLCYAVKANSNLAILQLLAQHGAWFDIVSGGELKRVLAAGGSANQVVFSGVAKSEAEIRFALEKGIACFNVESAAELERIEQVARALKTRAPVSLRVNPDVDAKTHPYISTGLKANKFGIAINDAMAVFRRAHTLNHIELLGADCHIGSQIMSDAPFLDAAKRMFKLLERLQEEAIELSHLDLGGGFGVDYEGHATLDLENYLQGVIDLAHDYPKLTLMLEPGRAIVGDAGVLISKVEYIKRSDDKQFVLVDAGMNDLMRPSLYQAWHDIVPVRELTGVADGIVDVVGPVCETGCFLGHARHLNVNADDLIAIKHAGAYGFTMASNYNTRVRPAEVLVENDRAWLIRERETFDDLIRGERLIAEE

SEQ ID NO: 15497 - protein, 703 aa, Zea mays
MGCAASRHGAVSSPPYDVSSSCSYNMSRSASASADLGSSSALSIWSRPVRLEAFDEEDDERRRLSGRDAAARLGNVRRCMEGEQAAAGWPSWLSAVAAEAVHGWVPLRAESFERLEKIGQGTYSSVFRARELATGRLVALKKVRFDSVEPESVRFMAREILILRRLRGHPNVVGLEGIITSRSSPSIYLVFEYLEHDLAGLSSSPDITFTEPQIKCYMRQLLEGLAHCHARGVMHRDIKCANLLVNNSGELKVADFGLANLFAPAPAAPLTSRVVTLWYRPPELLLGATAYEPSVDLWSAGCVFAEMHARRPVLQGRTEVEQIHRIFKLCGSPPEDFWRRLGLSHGAVFRPQQPYPSRLRDTFAASMPDHTFRLLATLLSLDPAGRGTAAAALDAEYFTTAPYACEPESLPKYAPNKEMDAKLREESRRRSNLPSQGGEADKGLSRGHKSMRLQDTNQSHVHAEESLPVVAENGVTMAGNDGDSRLFVDLEPVPAISKRHGGSVGGDHAAPCARARTMSTSFKEPPCVAEHLPLSGPVQLAASTGFSWAKKPRPDATTAAVTVTMRSGSMGPGTNRNNNSGGGDGARTTSGSGATATATATATATATAAPYEAEKQEVIKQWAQVADAFSASEAYNSRLRQTLDAKQLKTGMMHKGKVNRVDFSGPLLSQPRRIDELLHIHEQQIRQAGRRPWFMKGTEEEEH

SEQ ID NO: 15498 - protein, 431 aa, Bacillus licheniformis ATCC 14580
MRSYEKSKAAFEEAQRVMPGGVNSPVRAFKSVNMDPIFMERGKGSKIYDIDGNEYIDYVLSWGPLILGHSNEKVVKEIQKAAEHGTSFGAPTELETELAELVIDRVPSIEIVRMVSSGTEATMSALRLARGYTGRNKIVKFEGCYHGHGDSLLIKAGSGVATLGLPDSPGVPESIAKNTITVPYNDLESMKLVFQEFGDDIAGVIVEPVAGNMGVVPPVKGFLEGLRELTETHGALLIFDEVMTGFRVDYNCAQGYFGVTPDLTCLGKVIGGGLPVGAYGGKAEIMEKIAPSGPIYQAGTLSGNPLAMTAGLETLKQLTPESYREFSRKADRLEKGISEAAEKNGIPCTFNRAGSMIGFFFTNGPVINYDTAKQSDLGLFAEYYKGMADEGVFLPPSQFEGLFLSTAHTDDDIEHTIKAAERVFERISRSR

SEQ ID NO: 15499 - protein, 334 aa, Haemophilus influenzae R2866
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVAAGYIVYGSSTMLVYTTGHGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIQPTELHQRVPLFVGSEDMVKKAQEMMEEFKEE

SEQ ID NO: 15500 - protein, 714 aa, Legionella pneumophila subsp. pneumophila str. Philadelphia 1
MIKKIHRWLPLLVLIGLLVLFFSLHLDKYLSFNALRENHALLIAWTQTHYFIAPLIFIVFYTTAVAISIPGAVLLTLTGGFLFGVFWGVLFVVISATLGATILFFAVRTALGDWFAQKASGWIERMRQGFQHNAFSYLVTLRLIPLFPFWAVNIVPALLNIRAKTFITATFIGIIPGTTVYVMVGNGLSQIFAANQTPNLGIIFELQILGPLLALAVLSLMPVLYQFSTRKHQNHHSFSDISRVINCDLAIIGGGAGGLSLASGCSQLGLKVVLVESGKMGGDCLNYGCIPSKSLLAAAKTFYYAKHATHFGVHTEAIKINFQQVMQHVHQIIDNISEHDSVQRFESLGVQVIKQVGKFLNPDTLQAGDSIIKAKRFVVATGSSPFIPPIPGLDAVSYFTNETIFDLKEQPEHLIVIGGGPIGCELAQAFAMLGSKVTLLEGLNLLPKDDPDCVAVLRTQMKSMSIVIHEQIEITQINSHPDTGISVCFEFQNTQFTITASHLLIATGRRANVKPLDLEKAGVKLTSKGVEVNKYLQTSNKKIYALGDVTGLYQFTHMASYQASIVLRNIVFKLPSKVDYRAIPWVTYTDPELAHVGIGVSDALKHPDAQIIEWPFVDNDRAQTERSLNGKIKIITDKKARILGVTIVGPHAGELILPWVMAIREKKNLRSFTDVIVPYPTLSEISKRVAGSFYAPKLFSNKTRMLVRWLQKIG

SEQ ID NO: 15501 - protein, 271 aa, Staphylococcus epidermidis ATCC 12228
MSDLFQNAPPYIQALIAGIITWLLTALGAAAVFIFKKVNDKVLNSMQGFAAGIMIAASFWSLLQPAIESSENSAMPWLPAAIGFILGGVFIRVLDYIIPHIHQNAQDKNQQQEGVPTSLGKNALLVLAITLHNIPEGLSIGVAFGGVVSGNSHATFLGAIGLAIGIGIQNIPEGAALSMPIRAAGATRWKAFNYGQASAIVEPIFATIGAAAILVVNPILPYALAFAAGAMIFVVVEELIPDSQSSNNTDLATLSLMIGFTIMMILDVALG

SEQ ID NO: 15502 - protein, 137 aa, Burkholderia xenovorans LB400
MRTIKPTPQVLLRRIERSDALPPPHFRYSPAVQVGSDVYVSGLVGLDPATGGLAAETAAGQTRQIFRNIQALCAEQGWSLERVVVARVYCAGEGAADGMNEVWSEFFTQLAPPARTFTVVKSLPLGAAVEIEFQLSI

SEQ ID NO: 15503 - protein, 284 aa, Pseudomonas fluorescens PfO-1
MNRNNVILAGLIGAGIQASRTPALHEHEGDEQGLRYLYRLIDLDQLQLDSNALPDLLLAAERMNYTGLNITFPCKQAIIPLLDELSPEARGIGAVNTVVLKDGKRVGHNTDCLGFAEGFRRGLPDVARERVVQMGAGGAGAAVAHALLSEGVQQLSIFDVDVERAESLANNLNQHFGAGRAVAGHDLASTLSQANGLVNTTPMGMAKLPGMPVPTELLRPELWVAEIVYFPLETELLRNARALGCRTLDGGNMAVFQAVKAFELFSGRVPDAQRMLAHFQSMNG

SEQ ID NO: 15504 - protein, 519 aa, Mesorhizobium sp. BNC1
MTITHPDTVLIIDFGSQVTQLIARRVREAGVYSEIAPFQSAEEAYLRLKPKAVILSGSPASTVEIDSPRAPDVIFQSGVPVLGICYGEQTMCAQLGGKVESSDHREFGRAFLEIEEDCGLFAGIWAPGTRHQVWMSHGDRVTALPPGFKVVGTSAGAPFAAIADDKRKYYGVQFHPEVVHTPDGAKLLANFVHRIAGLKGDWTMAAYREQAVDAIRAQVGSGKVICALSGGVDSSVAALLTHEAVGEQLTCILVDHGLMRKNEAAEVVSMFREHYNVPLVLVDASDRFLSALEGETDPEKKRKTIGRLFIEVFEDEAKKLGGADFLVQGTLYPDVIESVSFTGGPSVTIKSHHNVGGLPERMNMKLVEPLRELFKDEVRVLGRKLGLPDHFIGRHPFPGPGLAIRCPGGITREKLEILRAADAIYLDEIRKSGLYDAIWQAFAVLLPVQTVGVMGDGRTYEYVCALRAVTSVDGMTADFYHFDMEFLGRAATRIINEVRGINRVVYDVTSKPPGTIEWE

SEQ ID NO: 15505 - protein, 181 aa, Triticum aestivum
MDLTDQSPEEMYSVWALLPEPVHRRLLGLMAGLRAAHGGAVFEPHATVLGAMRFRRSAAVEALRAAAAGLRPYTARVASIGRYGVNLLLEPTREVMATSDHCRAHFDYQRPAPYVPHLSLLYGDHLTEEEMAAARKKAGEMDKGIFGLQFEISELALYKTDPKDKSLESWELGQLCHLQKK

SEQ ID NO: 15506 - protein, 142 aa, Candida glabrata CBS 138
MFGLKARSLIMTRQLSKLTPVISANAPPAAASYSHAMKVNNLIYVSGQIPYTKDNKPVEGSISDKAEQVIQNVQNILKDSNSDLNRIVKVNIFLADMNNFAEFNKVYAKYFNVHKPARSCVAVAALPLGVDLEMEVIATEVE

SEQ ID NO: 15507 - protein, 538 aa, Armoracia rusticana
MKLLGIALVLLLAVVTCKAEITCEEDKPFTCNQTERLNRNHFDPDFIFGFASSAYQIEGSRGRGINTWDAFTHRYPEKGGADLGNGDTTCGSYEHWQKDIDVMAELGVNGYRFSFAWSRIVPRGKVSRGINQDGVNYYNNLIDGLLEKNITPFATLYHWDLPQCLQDEYEGFLDREIIEDFKNYADLCFQLFGDRVKNWITINQLFTVPTRGYATGTDAPGRCSSWLNKGCYAGDSGTEPYIVAHNQLLAHATAVDLYRKKYKKEQGGQIGPVMITRWFLPYDDTQASKDAVERNKAFFLGWFMEPLTKGKYPDIMRKLVGDRLPKFTESESKLVKGSFDFLGLNYYYTQYVYAIPKNPPNRLTVMNDSLSALSFVNKDGPIGPWFNADIYYRPRGILDTMEYFKTKYDNPLVYITENGYSSAGGDTPFEEVIADYNRTDFLCSHLCFLRKAIKESGCNVKGYFVWSLGDNYEFCQGFTVRFGVSYIDFKNITADRDLKESGKWYKRFLSVKDNKVPHESQDLLRSRFFLGQKKVADA

SEQ ID NO: 15508 - protein, 189 aa, Brassica napus
PRVRNAGSHDLPFSVETIEALTQLTKDGMKMKVPRYDKSAYSGRGDRAAAETWPEVEGPLKVILFEGWMLGFKPLPSEVVKSVDPQLETVNKNLEAYYDAWDKYINAWVIIKIKDPSYVYRWRLQAEIAMRQAGKAGMSDDEVNDFVSRYLPAYKAYLPTLYAEGPSGSDPYRVLAIDIDEERNPILAT

SEQ ID NO: 15509 - protein, 107 aa, Triticum aestivum
MAKHFSLLLVLAFVLVVTAEDCTVDLKGLIRECKPYVMFPASPKITPSSACCSVVQKVNAPCMCSKVTKEIEKVVCMDKVVYVADYCKNPLKPGSDCGSYHVPSQGR

SEQ ID NO: 15510 - protein, 220 aa, Idiomarina baltica OS145
MNKHPVAAVLFDLDGTLLDSAPDLGFALNQVCRENGLPEIPAEVFTPVASHGSRGLLGLTQLDEDALLALKPRFLDIYRSNLALHSKLFDGIEMLLSSLRRNQIKIGIVTNKPEFLTHPLIAQFEALQSISVVVCGDTLEEAKPSPKPLYYAAEQLAVDPKDCVYIGDAERDIVAGRNAGMVTVLAEYGYISSTDQPQQWLADYTIAHPNALMELLALPK

SEQ ID NO: 15511 - protein, 373 aa, Bacillus subtilis subsp. subtilis str. 168
MKNILIFPFLSISTGHHHVADALQAELESQGLAAEKIDIFSHSYRRLEKLSSVAYLKWIQYFPKTYSGIYRLLACGEFQHDKRYFMYECVFTQQMRHILQEKQPDIAFCTHALPSYLLNRLKPEYPNLTVVNVYTDFFVNQLWGRKNIDYHFVPSTEVKKQLISEGIDQNNIYLTGIPVHQNFEMESADTLQHHPPYTIIITGGSMGVGGILKWVQELSPGGKILYKILCGRNEKLYSYVKSLHHPLIEAIPYLHSKAEMNRLYEQATGIMTKPGGVTISECLQKRLPVFIYHALPGQEEMNLNLLHERKLVTDMRNWDMQKAEEYIAAFFQSNEQMKEYKKHVNGYLGEMSDRKIKDVLKRIIWKQKNTLLK

SEQ ID NO: 15512 - protein, 465 aa, Arabidopsis thaliana
MGCCYSLSSTVDPVQDHTTDASSEPRNGGGEDPPLTKFSFSALKTATNHFSPENIVSDQTSDVVFKGRLQNGGFVAIKRFNNMAWSDPKLFLEEAQRVGKLRHKRLVNLIGYCCDGDKRFLVADFMANDTLAKRLFQRKYQTMDWSIRLRVAYFVAEALDYCNTAGFASYNNLSAYKVLFDEDGDACLSCFGLMKEINNDQITTGSVNPENVIYRFGTVLVNLLSGKQIPPSHAPEMIHRKNVFKLMDPYLKGKFSIDEANVVYKLASQCLKYEGQESPNTKEIVATLETLQTRTEAPSYEVVEMTNQEKDASSSSNLSPLGEACLRMDLASIHSILVLAGYDDDKDIIELSFEEWIQEVKELQDVRRNGDRAFVEQDFKTAIACYSQFVEERSLVYPSVYARRSLSYLFCDEPEKALLDGMHAQGVFPDWPTAFYLQSVALAKLDMNTDSADTLKEAALLEVKK

SEQ ID NO: 15513 - protein, 272 aa, Pseudomonas fluorescens PfO-1
MQMNPNKDTQLCMSLSGRPGNFGLRFHNHLYEQLGLNFYYKAFSSQDLPGAVGGIRALGIRGCGVSMPFKEASIALVDELDASAAAIQSINTIVNTNGHLKAYNTDYIAIAQLLETHAVPKDTTFALRGSGGMAKAVASALRDDGYKNGLIVARNERAGRALADSLGYRWQAELGDERPQMLINVTPVGMDGGPEAGQLSFDVDVIKSADTVFDVVAIPSETPLIVRGRAEGKKVITGLEVIAIQALEQFVLYTGVRPTVEQFDAAVAFARS

SEQ ID NO: 15514 - protein, 563 aa, Pseudomonas aeruginosa
MRARPEQCVDEVAAMMVPTLEHELAPNEANHVPLSPLSFLKRAAQVYPQRDAVVYGARRYSYRQLHERSCALASALERVGVQAGERVAILAPNIPEMLEAHYGVPGAGAVLVCINIRLEARSIAFILRHCAARVLICDREFGAVAQQALAMLDAPPLLVGIDDDQAERADLAHDLDYEAFLAQGDPGRPLSAPQNEWQSIAINYTSGTTGDPKGVVLHHRGAYLNACAGALIFQLGPRSVYLWTLPMFHCNGWSHTWAVTLSGGTHVCLRKVQPDAIHAAIAEHAVTHLSAAPVVMSMLIHAEHASVPAVPVSVITGGAAPPSAVIAAMEARGFSITHAYGMTESYGPSTLCLWQPGVDELPLEARAQFMSRQGVAHPMLEEATVLDTDTGRPVPADGRTLGELVVRGNTVMKGYLHNPEATRAALADGWLHTGDLAVLHPDGYVEIKDRAKDIIISGGENISSLEIEEVLYQHPEVVEAAVVARPDSRWGETPHAFVALRADALPRTTGDDLVRWCRERLAHFKAPRHVTLTELPKTATGKIQKFVLREWARQEEEAGDAGR

SEQ ID NO: 15515 - protein, 229 aa, Oryza sativa
MPPPRLANRYFLVRAGESVYEGQGVVRTNPVSKTSVDSGLSPAGLRQAARPALELQRLGACEDDCWIWPSITQRAYQAAEIIAAANEINRSHIVPEYSFLDARGLGAFEGKSLETLPEVYASDSISPDIKPPPISDGTPNESVADVFVRVTQLMSILETQYSGDTVVIVSPDSDNLSILQAGLIGLDLRRHSSLFFQPGEVRPVDPASIPEYKQPASTVFKCTNPPSCK

SEQ ID NO: 15516 - protein, 429 aa, Aspergillus nidulans FGSC A4
MGQDAVHLQVLATSGDGPEQKHARTVLGLISKGKHWVLVTLLLGNVVVNESLPIVLDKTLGGGWPAVLGSTVLIGTILPPKRNLIFGEIIPQSVCVRYGLPIGAYLSPAVLVLMYAFAPVAWPTARLLDYLLGENHGTVYKKSGLKTLVTLHKSLGSQPAERLTEDEVTIITAVLDLKAKPVREIMTPMESVFTMPSNAVLDEKTMELILSAGFSRIPVHAPGNPGDFLGMLLVKTLITYDPDDAKRVKEFVLATLPETSPDTSCLDILNYFQEGHSHMALVSESPGSNGGALGVVTLEDVVEELIGEYAFPTFCVPISHEPSSKPAFPAVERQPSLPTPAPALTLDARTLRRSSTAPLAKTGLISTIPPEQRQQLDNLAPSNLARSPKQTRFPFVKIKRAGSGRASDTANGVGKDSGAVADENTPLLN

SEQ ID NO: 15517 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIGDGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFNLMAKGEGIRCIIRMEN

SEQ ID NO: 15518 - protein, 381 aa, Mycobacterium avium subsp. paratuberculosis K-10
MARDYYGLLGVSRGASDAEIKRAYRKLARELHPDVNPDEAAQAKFKEISVAYEVLSDPEKRRIVDLGGDPLEGAAAAGGGFGGFGGLGDVFEAFFGGGFGGGTTSRGPIGRVRPGSDSLLRMRLDLEECATGVTKQVTVDTAVLCDRCHGKGTNGDSAPVPCDTCGGRGEVQTVQRSLLGQVMTSRPCPTCRGVGVVIPDPCHQCMGDGRVRARREISVKIPAGVGDGMRVRLAAQGEVGPGGGPAGDLYVEVHEQPHDVFVREGDDLHCTVSVPMVDAALGATVTVDAILDGVSEITIPPGTQPGSVITLRGHGMPHLRSGTRGDLHVHVEVVVPSRLDARDTELLREFKGRRGRDVPEVRSTHAGGGLFSRLRETFTGR

SEQ ID NO: 15519 - protein, 700 aa, Xanthomonas oryzae pv. oryzae KACC10331
MRAMCLALTSASLRAWRTLSSIGLRHALARARAARDACGARPVTPRCQQAGALTMCGLAGLLLASPRLHGEQLDALVRPMGAALRHRGPDDAGTWCDAQAGVALAHQRLSILDLSPLGHQPMRSADGRYVLAYNGEVYNFAQLRAALSALGHRFRGHSDTEVLLAAVVEWGLDETLTRCNGMFAIALWDERDNCLFLARDRVGKKPLYYGWAGDTLVFGSELKALWQHPDFDNGVDRNALTLLLRLGYIPAPACIHAHTFKLMPGRVLRMDAQAVAAGAAAHRADQAQQPFWNAREAMQRALAAPFTGSDAQAEEQLDSVLRDAVALRMVADVPVGVFLSGGTDSSIVTAMMQAQSAQPVHTFSIGFEGSHHDEAPLAREVATHLHTDHTELYVSGADALAVVPCLPDMFDEPFADASQVPTALVARLARGGVTVALSGDGGDELFFGYGRYQRALRNWRMHGLVPGPLRRLMAVAARRNGESSRTGGLAALVAEAGARGIGDIYRNRISRWRDPAAVVPGATEPDSFYSLADPLHGSGTPADAMMLADFAAYLPDDLLCKVDRTTMAVGLEARAPLLDWRVAEFAWSLPLSLKYRDGMSKYLLKRVLCRYLPDTMVYRGKRGFGAPVSAWLRGDLHGWADDLLAHGALQREGVFAADTVAGLWRDFNGGERKWHTHLWTVLMFQAWQAHWREQRAAITR

SEQ ID NO: 15520 - protein, 172 aa, Brassica napus
MAVEYECCESNFFVHILVIVLLVLFAGLMSGLTLGLMSMSLVDLEVLAKSGTPRDRKHAAKILPVVKNQHLLLCTLLICNAAAMETLPIFLDGLVTAWGAILISVTLILLFGEIIPQSVCSRHGLAIGATVAPFVRVLVWICSPVAWPISKLLDFLLGHGRVALFRRAELKH

SEQ ID NO: 15521 - protein, 339 aa, Photobacterium sp. SKA34
MTATNRQLLLASRPVGAPTPENFHLKETKIPTPQQGELLLKAVYLSLDPYMRGRMSDKKSYAEPVGINEVMVGGTVCQVTASHHPDFQVGEWVLAYSGWQDYAVSNGEGLIKLGMNPTHPSYALGVMGMPGFTAYMGLLDIGQPKQDDTIVVAAATGAVGSMVGQIGKIKGCRVVGIAGGNEKCQYAKETLGFDECIDHHATDFAQQLADACTDGIDIYYENVGGKVFDAVLPLLNTGSRIPLCGLISQYNATSLPDGPDRMNMLMGQLLVKRIKMQGFIIFDDYAHRYDEFAQQMSQWLAEGKIHYREDRVEGLDQAPQAFIGLLEGKNFGKVVVKVN

SEQ ID NO: 15522 - protein, 253 aa, Thermotoga maritima MSB8
MKFCIIGYPVRHSISPRLYNEYFKRAGMNHSYGMEEIPPESFDTEIRRILEEYDGFNATIPHKERVMRYVEPSEDAQRIKAVNCVFRGKGYNTDWVGVVKSLEGVEVKEPVVVVGAGGAARAVIYALLQMGVKDIWVVNRTIERAKALDFPVKIFSLDQLDEVVKKAKSLFNTTSVGMKGEELPVSDDSLKNLSLVYDVIYFDTPLVVKARKLGVKHIIKGNLMFYYQAMENLKIWGIYDEEVFKEVFGEVLK

SEQ ID NO: 15523 - protein, 459 aa, Burkholderia vietnamiensis G4
MTQQQRSFDNIVAREQGLRHALTSGQMAMIAIGGAIGTGLFLGSGFAIGLAGPSVLVSYAIGALIALLLMGALAEMTVAHPTAGSFGAYAEHYVGPLAGFLVRYAYWFAVVFAIGTEISAIAVFMKYWFPAVPGWYWVIGFSALLIAVNLASVTLYGSVEYAFSLLKIAAIIVFIVLGAYLVWSAPPASGIGFANYTGHGGFMPKGPWGTWVAVIVAIFSYMSIEAVAIAAGEARDPQHAVTRAFRSTVFRLVLFYLLTLALMLAIVPWTQAGTDESPFVKVMAATHVPYAAGVINFVLLIAALSAMNSQLYVTTRMMFSLSRARLAPAVFGRVGDNGVPRAALWISTSGVAVAAVLVALSPGTAFTVMMAIAMFGALFTWLMIFVTHLRFRARYSGPALAFRMWAHPFGSLLGAALVGAILLTTAFTHEFRMTMVVGVVFVVLLTLAYALHYRHQHAR

SEQ ID NO: 15524 - protein, 253 aa, Datura innoxia
LQSIQCAIAGKNLYMRFSCSTGDAMGMNMVSKGVQNVLDYLQNEYPDMDVIGISGNFCSDKKPAAVNWIEGRGKSVVCEAIIKEEVVKKVLKTEVAALVELNMLKNLTGSAMAGALGGFNAHASNIVSAIYLATGQDPAQNVESSHCITMMEPVNDGKDLHVSVTMPSIEVGTVGGGTQLASQSACLNLLGVKGANREAPGSNARLLATIVAGSVLAGELSLMSAISAGQLVKSHMKYNRSSKDITQVSNPSS

SEQ ID NO: 15525 - protein, 505 aa, Oryza sativa (japonica cultivar-group)
MEREAWLLCAALAAAMVYYYYYYLACTTRRAQRRLPPGPTPLPVIGNVLSLSGDMHHELARLAREQYGPVMTLKLGLFTAVVVSSPDAAREAFTKHDRRLAARTVPDISRARGLTGRSMIWLPSSDPRWKTLRSAVATHFFSPRSLAAARGVRERKVRDIVNYFAGHAAEVIDVGEAVYGGVINIVSNAFFSADVVDVGKESAHGLRETLEDIILAIAKPNVSDLFPFLRRLDLQGWRRWAEKRYDKVFGILDDKINSRLADADADASTKKHGDFLDSLLELMSAGKIACDDVTTVMFDAFGAGTDTISNTVVWAMAELLRNPSIMAKVRAEMEDVLAGKKTIEENDTEKLPYLRAVIKEAMRLHPVAPILLPHRAAEDGVEIGGYAVPKGSTVIFNVWTIMRDPAAWERPEEFMPERFLQRAEVDFRGKDFEFIPFGAGRRLCPGLPMTERVVPFILASLLHAFEWRLPVGVAAETLDLSEKFTTVNVLVTPLKAIPILASHQI

SEQ ID NO: 15526 - protein, 507 aa, Brassica napus
  misc_feature (443)..(443): Xaa can be any naturally occurring amino acid
MTMINSLRRMARSSQVTLQSRYAASSSSSQYTSGSRIFTTEASPQKQTIVGSKGHDMLAPFTAGWQSADLHPLIIAKSEGSYVYDDHGKKYLDSLAGLWCTALGGNEARLVSAAVEQLKTSPFYHSFWNRTTKPSLDLAKDLLAMFTANKMAKAFFTNRGSEANDTQVKLVWYYNNALGRPEKKKFIARKKSYHGSTLISASLSGLPALHQNFDLPAPFVLHTDCPHYWRFHLPGETEEEFSTRLAKNLEDLIIKEGPETIGAFIAEPVMGAGGVIPPPATYFEKIQAVVKKYDILFIADEVICAFGRLGTMFGCDKYNIKPDLVSLAKALSSAYMPIGAILMSQEVADVIYSQSNKLGAFSHGFTYSGHPVSCAVAIEALKIYKERNIPEHVAKVAPRFQDGLKAFAKTSPIIGEIRGTGLILGTEFTDNKSPNEPFPPEWXVGAYFGAECQKRGMSVRVAGDGIMMSPPLIISPEEIDELIAIYGGSIGKLRKRRVKELKAQQKK

SEQ ID NO: 15527 - protein, 596 aa, Oryza sativa (japonica cultivar-group)
MEMSGAGAGGVPTKLEHDDAAAVAAEREPCGGGAPRREEKERWRRVLVVGCLVALLLFAFFVLGRESASEVLQIASSKLSAMNGGFTTKNPSHGGGAAKHADELLGGLLAPGMDRRSCRSRYQAAHYYKHFPYAPSPHLLDKLRAYEARHRRCAPGTPLYNRSVEQLRSGRSAGGVECNYVVWLPFDGLGNRMLSMVSGFLYALLTDRVLLVDLPHDSSDLFCEPFPGATWLLPPDFPVANLFGLGPRPEQSYTTLLNKKKITAVVNNDDDPASKNATAALPPPPAYVYLSLGYQMADKLFFCGDDQRALAKVNWLLLYSDLYFVPSLYSVAEFNGELRRLFPAKESACHLLARYLLHPTNAVWGMVTRYYNSYLAQASRRIGVQIRMFNFASIPVDDLYNQILTCSRQEHVLPETTTDNDNDDDLATAYDSNSSNGSGGGNYSAILIASLYPDYYERIRATYYEHATRGRVRVGVFQPTHEERQATQRLFHNQKALAEILLLGFSDELVTSGMSTFGYVGSSLAGVRPTILMPAHGHRVPAPPCRRAVSMEPCNLTPPRVGEAECREMAAVVDKEDVARHVKVCEDFDRGVKFFD

SEQ ID NO: 15528 - protein, 121 aa, Oryza sativa (japonica cultivar-group)
MSSPHVLVVDDTHVDRHVISMALMRHNVRVTAVESVMQALVFLDSEHDVNMIVSDYCMPEMTGYDLLMEVKKSPRLVHLPVIIASSDNIPERIRKCFDGGAKDYILKPVKIADVPRILNYI

SEQ ID NO: 15529 - protein, 384 aa, Arabidopsis thaliana
MVAEAEVVFQQSLPAVLEIELFDGVSSAVKSPVSSPKLGFTQSTASVSGSLTTSPVQADIFPEGDCDPSVLDYIPTIRSGSFADIGPKRNMEDEHIRIDDLSSQVGSLFELPKPSAFYAVFDGHGGPEAAAYVRENAIRFFFEDEQFPQTSEVSSVYVEEVETSLRNAFLQADLALAEDCSISDSCGTTALTALICGRLLMVANAGDCRAVLCRKGRAIDMSEDHKPINLLERRRVEESGGFITNDGYLNEVLAVTRALGDWDLKLPHGSQSPLISEPEIKQITLTEDDEFLVIGCDGIWDVLTSQEAVSIVRRGLNRHNDPTRCARELVMEALGRNSFDNLTAVVVCFMTMDRGDKPVVPLEKRRCFSLSPEAFCSLRNLLDG

SEQ ID NO: 15530 - protein, 474 aa, Pseudomonas aeruginosa
MQTKLLINGALVAGEGESHAVYNPSQGNVLVRITEASGAQVHAAVQSADAAFDAWSQTPPKDRAALLLKLAERIDAQAHVFARLEADNCGKPFNAVLLDELPAVSDVFRFFAGAVRCLQGSAAGEYVAGHTSMIRRDAVGVVASIAPWNYPLLMAAWKLGPALAGGNTVVLKPSEHTPLSTLKLGELLAEIFPAGVVNIVHGRGASVGEPLTSHAQVRMVSLTGSVRTGSRIIEGTAESVKRMHMELGGKAPVLIFDDADIDAAVEGIRAFGFYNAGQDCTAACRLYVQKGVYQEFVRKLGEAVSSIRCGLPDDPATEMGPLITKEHLERVEGFVNRARELPHIEVVTGGKRAEGAGFFFEPTVLAGATQEDEVMRREIFGPVVTVSSFEDEAQALAWANDSDYGLASSVWTADVGRAHRLAARLQYGCTWVNTHFMLVSEMPHGGVKLSGYGKDLSMYGLEDYTVVRHVMFKH

SEQ ID NO: 15531 - protein, 320 aa, Lactococcus lactis subsp. lactis Il1403
MSKKIVTLAGDGIGPEIMSAGLSVLKAVSKKIDFEYELEAKDFGGIAIDKHGHPLPEETLQAVKNADAILLAAIGHPKYNNAKVRPEQGLLALRKELGLYANVRPLKIYPALKKLSPIRNVENVDFLMIRELTGGIYFGQHELADDKARDVNDYSADEIRRILHFAFKSAQSRPRKLLTSVDKQNVLATSKLWRKMADEIADEYPDVRLEHQLVDSCAMLLITNPQQFDVIVTENLFGDILSDEASSLAGSLGVMPSSSHGFNGLALYEPIHGSAPDIAGKGIANPVSMILSIAMMLRESFGQEDGATMIEKAVTQTFTD

SEQ ID NO: 15532 - protein, 665 aa, Photorhabdus luminescens subsp. laumondii TTO1
MIDVQINEVPLKEHSPSINDCLDEQKLLYDMLLSREFDNRSAIVTRQGRAWFHVSAAGHEGLAVLPQLMEKNDVLVPYYRDRALVLARGMSIVEMTRELMGKATSHSAGRTMSNHFCSKEHNIFSVVSLTGTQCIPAAGAAWASVLDNKNGLVVCGVGDAATRQGEFYEAVSFAVEKRLPVVFVVSDNKLGISTSTEKMAPYRLGIFNECLIRRVDARKPETLFTVAQEVFNKARFERTPCILVCRMDRLDSHSNSDSHKLYRTPDELEVLQDPIENYVAYLKEKGAITEQALAEQKERIKADVAEIFERVYHEEEPDPASVSTYLCNREGTPTVHVEMEAEETQVKAVNQVLDEALSQHPNVLIFGEDIEDPKGGVFGFTRGLSTRYPDRVINAPLSEATIIGSSVGLSASGWRPIVELQFIDFVGLGLNQLQSQLGTLSWRTVGKWRCPVVIYAPYGAYLPGGGIWHSQSSDGILAHIPGINVLVPTTPADTVALFRTALSLDMPSLILIPKHLMRERHERRLVSPVSLGQANIVRAGKDITLVAWGNTTQLATMAALQAEKDNIDIEVIELRSLVPWDKQRIAESLRKTGRLIVVQEDTRTASVGASIIADILDENDNFFSLLAPPRLVTREDIHIPFNPCLEKAVLPGTDDILASVYAVMS

SEQ ID NO: 15533 - protein, 508 aa, Pseudomonas aeruginosa
MSSHTALPIEPLDVLIIGAGVSGIGAAAYLRRHQPHKVFAILESRERMGGTWDLFRYPGIRSDSDLYTFGFDFKPWTKAKSLADAADILEYLREAVAEYQLDPFIQYRQKVVSANWQSDKGLWAVCVEDGHTAETRTIECRWLFSAGGYYRYDQGFSPRFEGAEQFKGQIIHPQHWPERLDYRGKHVVVIGSGATAVTLIPAMADEVASITMLQRTPSYIVNQPANDSVAAFLRKILPAQTAYSLTRYKNAKITLVFWRFCQRFPGLARKLLIWLTRRELPKGYPVDVHFNPPYKPWDQRLCSVPEGDLFKAISAGKASVVTDHIERFTESGVLLKSGTELKADIIITATGLNVQLFGGIALHKDGEPVVLSQTLAYKGTMLSGVPNFAFAVGYTNSSWTLKVCLLCDHFCRLLGFMDSQGHNVCEPKAPDGVETRPLLDFGAGYVQRALDGMPRQGPREPWVMSMDYFRDIKLLRRGKVADECLRFSTVPDAYLHRSVALQTQGGGR

SEQ ID NO: 15534 - protein, 340 aa, Zea mays
MLKRSAWKRLRPKSASAAPKTSRWRRKTTSQNTSRHCRLGHAAGPAAAAATDTAPAAAGGLGFPLPWQEEVEEEDMAAIGGWGGPSTNLSRDQGNGRPESPAMKCRSDAPGGGDGHRDRVPAPAATGVGGSPPGERSKKQRTQEPSSSSSVDGECSSSTSSSQALPPPLPEQLPQDAGVGEQPPPGPEAAGGEQARVPDLGEDLVFEVLMRAEARTLAAAACVSRGWRLLARDERLWEAACVREWACTGFSEQMLRSVVLPLGGFRRLHEMYIRPVQRRAAGAPRGQQRRQLPVRMGRDQVQVSLSLLSTSFFLKMPNAPPPPPKDKDKDGDKNGGGQCG

SEQ ID NO: 15535 - protein, 411 aa, Coprinopsis cinerea okayama7#130
MSLTVLRSLRGSHQTRAWASFARVRYMSADSSTSSLAELDASRVEIVRTTKPGVPPPSSTLKFGHTFTDHMLTIPWNVISGWGTPKIQPYAPLALDPSCTVLHYAQTIFEGLKAYRQEDGKVTLFRPDMNMKRMNTSAQRIALPTFNGEQLLELVKQLIRIDKDWIPKEPGHSLYVRPTLIGTQRAIGVGPPNEALLFVILSPVGPYYPNGFKPVSLYGTTEYVRAAPGGTGAYKLGVNYAPGILPQREAAQLGYAQNLWLHGPEHYLTEVGTMNLFVVFRDPTTNELELVTPPLDGMILPGITRDSVLSLARQHADGKYSVKDLPAKIKVSERPVTMQEVKEASEKGTLVEMFGAGTAAVISPVDRIGYMGGDVHIPTGPDGMGPVSRPIWKELVGRQTGEIPSDWSVEI

SEQ ID NO: 15536 - protein, 220 aa, Zea mays
  misc_feature (72)..(72): Xaa can be any naturally occurring amino acid
SLQHVLWLNSFFCISVLQKTEASSSSNHAVASGPAKVWQPGVDALEDGEELQFDPEAYNYLRGFGIGWSCLXAEKASLNYIGVFKLSNINGKKREPIPASAVDGDTDVDSDSSSDEEDEEINEDTKPILHLKKVAHAGCVNRIRSMTQKPHICATWGDTRHVQVWDLSSFLNSLAESGASAPKEDDIIHKHLPMKVFSGHKDEGYVFKHNKVGTGGGKGV

SEQ ID NO: 15537 - protein, 226 aa, Oryza sativa (japonica cultivar-group)
MAAMASLYRRVLPSPPAVEFASEEGKRLFSEALESGTLQGFFNLISVFQTQSEPAFCGLASLSVVLNALAIDPGRQWKGPWRWFDESMLDCCEPLDKVKAEGITFAKLACLAHCAGANSGSFRADQSTIHDFRHHLVRSASSQDCHLIASYHRKPFKQVVFVNPSLLHFKVLITNQFIIALHFRLEPAISLQSAATMPAKTWRLSWMSPASNTLLTGFHSHCFGKP

SEQ ID NO: 15538 - protein, 263 aa, Oryza sativa (japonica cultivar-group)
MAKYCMEDVPDLLKDESVDNVPALLSRLVKSLPANAGNLIKWVIEVRRQEEGGSGLSKEEEERLILKEMILQQVRDTELFRLVRELQFTKQPCCSCSYSSDDDSFTRIAASVCCQGAALLTGNLSSKDGFCCRETCFKCVQVDGDGPKTVVTGTAVSGVNEQSVDMLLPISTLETSVCNSNSSNEVVKYPSRTDILTVLLLALHPSTWVGIKDERLKAEFQSLISTDILHDDLKREILHLRRQLHYVRSCKEEEYGDPVPQSH

SEQ ID NO: 15539 - protein, 130 aa, Oryza sativa
MEIQQQKGVGNSEVVKVAKEESWDLFINQASNEGRTVVAHFGASWCVTSLSMNYKFDELAQTHPEILFLYVDVDDIQSVSSKLGVKAMPTFLLIKDKEVVNKIVGANPDKVKKMVDATAESIGDTCSILI

SEQ ID NO: 15540 - protein, 879 aa, Listeria monocytogenes str. 1/2a F6854
MRKFVYQFSEGSKEMKNLLGGKGANLAEMTNIGLPVPPGFIISTDACNDYTANNKHLSEAIFDEVKIHLAELEKQTGKIFGFAENPLLVSVRSGAPFSMPGMMDTVLNLGLNDQAAEGLANLTGDARSAYDSYRRFIQMFGDVVFEIPSYHFEQALSRIKKANDYRLDTELTATDLSELIDAYKLIFSQATGTDFPQDPLEQLRLAIIAVFDSWMNPRAVIYRRLHDIDASFGTAVNIQAMVFGNTGETSGTGITFTRNPSTGEKKVFGEFLLNAQGEDVVAGIRTPEPISALEERMPTVYKELLHTCELLENHYLDMQDIEFTIEKGKLYVLQTRSGKRTAKAAIQTAVDFVQEGKITREEAIMRVETKQLNQLLHPTFLESALKNGQVIATGLPASPGAATGQIFFEAKEAVQAAERGIPVILVRNETSPEDIEGMARSNAILTAHGGMTSHAAVVARGMGKCCIAGCAELTINEQEKTLLLSNGEALHEGDYLSLDGSTGKVYLGEIALTEAQIGGHFNDLMAWADAEKKLMIRVNADTPADFKKALLFGAEGIGLCRTEHMFFDEKRIPYVRQMILAESLSERESVLAILKEMQKADFSELFRIADGRAVNIRLLDPPLHEFLPKMKQEIEQLAGAMNRTVPQITNRINELREANPMLGHRGCRLAITFPEIYRMQAEAIIESAIIVHNEGIDVHPEIMIPLITTKNELSYIKKELQQAVQAIFDKEQVVIPYDIGTMIEIPRACVTADEIAEEAAFFSFGTNDLTQLTYGFSRDDATKFLADYYEKDILPKDPFVSIDKNGVGALVEMAVTRGRMTSEHLKMGVCGEHGGDPESIQFFHQLGLTYVSCSPYRVPIARLAAAQAALAEKHLIPTI

SEQ ID NO: 15541 - protein, 236 aa, Zea mays
EAIDTQHYYGLWNGARERIAAHLGHAVKLEIEPGRFLVAESGVLVSQVRAVKQMGSRHFVLVDAGFSDLMRPSMYGSYHHISLLPADGSAPGDAHVESVVAGPLCESGDVFTQLEGGKVETRALPAAQVGDYLVFHDTGAYGASMSSNYNSRPLIPEVLFEQGVPRTAGAGAELMRIVPLSSVPHHASQITDWLWQAFGDGTSRAFYDSIVRSSLSGAAFPVTFVALDEDDVPHGT

SEQ ID NO: 15542 - protein, 414 aa, Nocardioides sp.
MTGGQVAALIGGGMAGVHAAEVLRRDGFDGRVLLVSAEQHLPYDRPPLSKALLRGELALADCLLRPPEWYEEQGIEVLLGVSVDALDPGRRTLRLSTGEQVEFDRALLATGARPRWPLGLAPGCGPVFALRTVDDCLAIRSRLRSGASVVVVGGGFVGAELASSAASLGCRVTMLEAADAPFQRVLGRTVGELFGRFYATGGIRLVTGVQVTGTSVGPEGARLTAGDGRFWDADVVVVGVGVVPNTELAVDAGLRVSDGVEVDAYCTTSAPHVFAAGDVANRPDPVLGRRVRIEHWQNAQHQGTAAGRAMLGIREPFDGVPWFWSDQFGLNLQVAGFPDRADRVVVRGRLEGDRFAAFYLAGPTLVAALGVGCAGEVHLSRRLIAARAHVDPQRLTDEHSDLRDALLASDVPTA

SEQ ID NO: 15543 - protein, 142 aa, Synechococcus sp. CC9311
MESQESQESSLFEQAMARYQAGAPAADLIDDFVAITEAAPRQSSGWTCLAWLLLLCDKPDDALRSARLAVKLNSQDPQARINLTLAMLETKAKGVRDQIAVVQQVLAVAPEMGDELRESINDGFKRRPDWPALLKVKSWLEL

SEQ ID NO: 15544 - protein, 408 aa, Zea mays
MATSHKDSIDDAGQDEIILVRKQTKTGQVVSLVVALEERAGAMAAAEIKIGQVDDVQELHRTGLQTVPDRYIRDGDDRPDGDNVCAVAHIPVIDVTELQHDDVGLDKLRLACEEWGFFQVVNHGIAHELLDEMERLAREFFMLPLEEKEKYPMAPGGIQGYGHAFVFSEDQKLDWCNMLALGVEPASIRQPRLWPTAPAGFGETLEAYSAEVGELCRRLLARIAETLGLAPATFADMFGEAVQAVRMNFYPPCPRPDLVMGLSAHSDGSAVTVLQQDVGCAGLQVRGKGGAWVPVHPVPHALVVNIGDTLEVLTNGRYKSVEHRAVANGEQDRLSVVTFYAPAYDVELGPLPEFVTDEAPCRYRRFNHGEYSRHYVTSRLEGKKTLEFAKIDPLAGEHDGTAPEETST

SEQ ID NO: 15545 - protein, 444 aa, Arabidopsis thaliana
MVRDIVDDPLDEDDIALVKTYGLVPYSAPIKKVEKEIKELTEKINDLCGIKESDTGLAPLSKQMMQEGQPLQVGYVSCFRYIPIDLLMDIFSRVPAKSIARFRCVSKLWESILCRPDFKELFMTMSSIRPPLLLFTFQDDDGNLFFFSSPHPQIPCNENTSLVPTRYHVQHTTDSFSEIGSPLCGFICRRGKRNLDTMVICNPVTGESVSLPKVELKSINTETRPYLGYDPVRKQLKVLCIKSDDIPNTCDEHQVLTLENGNHLWRTIQCKPHYPKSDGICIDGILYYTAGFDMRARVSMVVCFDVRSEKFSFINIHVFMLMNDSCTLINYKGKLGALQFTCLSPKRLRFWVLVNAEKNIWTKCIYALPPLWNNLVQHTELAIVGMTDGGEVVLSQYCLIYAFYIYYFNLESKSLTRVQIQDVEMFKRTRVYTSLGYVENFKLM

SEQ ID NO: 15546 - protein, 411 aa, Arabidopsis thaliana
MNALAATNRNFKLASRLLGLDSKLEKSLLIPFREIKVECTIPKDDGTLASFVGFRVQHDNARGPMKGGIRYHPEVEPDEVNALAQLMTWKTAVAKIPYGGAKGGIGCDPSELSLSELERLTRVFTQKIHDLIGIHTDVPAPDMGTGPQTMAWILDEYSKFHGHSPAVVTGKPIDLGGSLGRDAATGRGVLFATEALLNEHGKTISGQRFAIQGFGNVGSWAAKLISDKGGKIVAVSDVTGAIKNNNGIDILSLLEHAEENRGIKGFDGADSIDPDSILVEDCDILVPAALGGVINRENANEIKAKFIIEGANHPTDPEADEILKKKGVMILPDIYANSGGVTVSYFEWVQNIQGFMWDEEKVNRELKTYMTRGFKDLKEMCQTHSCDLRMGAFTLGINRVAQATTIRGWGS

SEQ ID NO: 15547 - protein, 188 aa, Pyrococcus furiosus DSM 3638
MIIIMDNGGQYVHRIWRTLRYLGVEAKIIPNTTPLDEIKAMKPKGIIFSGGPSLENTGNCEKILEHYEEFNVPILGICLGHQLIAKFFGGEVGRGEKAEYSLVEIEIIDENDIFKGLPRKVRVWESHMDEVKKLPPKFKLLARSDTCPVEAMKHEELPIYGVQFHPEVAHTEHGADILRNFAKICGEL

SEQ ID NO: 15548 - protein, 431 aa, Synechococcus sp. CC9311
MKRVLAIILGGGAGTRLQPLTKMRAKPAVPLAGKYRLIDIPISNCINSSINKMYVLTQFNSASLNRHLSQTYNLNAGFGQGFVEVLAAQQTLDSPSWFEGTADAVRQYQTLFREWDVDEYLILSGDQLYRMDYSRFVEHHRSTGADLTVAALPVDAAQAEAFGLMRTDEVGNIKEFREKPKGDSLKAMAVDTSRFGLSVESSKERPYLASMGIYVFSRKTLFDLLDANPGHKDFGKEVIPEALSRGDNLKSYVFDDYWEDIGTIGAFYEANLALTQQPTPPFSFYDEAFPIYTRPRYLPPSKFVDSQITDSIISEGSIIKACSIHHSVLGVRSRVENNVVLQDSLLMGADFFESQGERETLRARGGIPVGVGEGTTVKGAILDKNARIGKNVTIVNKDRVEEADRPDQGFYIRNGIIVVVKNASIADDTVI

SEQ ID NO: 15549 - protein, 313 aa, Pyrococcus furiosus DSM 3638
MKRWVKVWEKFIEEKIREIRETVGDSKAIIALSGGVDSSTAAVLAHRAIGDRLHAVFVNTGFLRKGEPEFVIKTFRDEFGMNLHYVDAQDRFFAALKGVTDPEEKRKIIGRVFIEVFEEVAKDIGAEYLIQGTIAPDWIESQGKIKSHHNVGGLPEKLNLKIIEPLRDLYKDEVRQLAKELGLPEKIYNRMPFPGPGLAVRVIGEVTPEKIRIVREANAIVEEEIEKAGLRPWQAFAVLLGVKTVGVQGDIRAYKETIAVRIVESVDGMTANAMNVPWEVLQRIAFRITSEIPEVGRVLYDITNKPPATIEFE

SEQ ID NO: 15550 - protein, 126 aa, Lactococcus lactis subsp. lactis Il1403
MKIIATLDAPAAIGPYVQGKIVNGLLYASGQIPLNPLNGEIVGDSIETQTEQVMKNISAILKEAHSDFDLVIKTTCFLKNIEDFSRFNAIYSKFFDKEFPARSAVGVAGLPKNVLIEIEVIAEVKS

SEQ ID NO: 15551 - protein, 398 aa, Bacillus subtilis subsp. subtilis str. 168
MKFEQSHVLKELPKQFFASLVQKVNRKLAEGHDVINLGQGNPDQPTPEHIVEEMKRAVADPENHKYSSFRGSYRLKSAAAAFYKREYGIDLDPETEVAVLFGGKAGLVELPQCLLNPGDTILVPDPGYPDYWSGVTLAKAKMEMMPLVKDRAFLPDYSSITAEIREQAKLMYLNYPNNPTGAVATSEFFEDTVRFAAENGICVVHDFAYGAVGFDGCKPLSFLQTEGAKDIGIEIYTLSKTYNMAGWRVGFAVGNASVIEAINLYQDHMFVSLFRATQEAAAEALLADQTCVAEQNARYESRRNAWITACREIGWDVTAPAGSFFAWLPVPEGYTSEQFSDLLLEKANVAVAAGNGFGEYGEGYVRVGLLTSEERLKEAAYRIGKLNLFTQKSIDKTL

SEQ ID NO: 15552 - protein, 867 aa, Aspergillus nidulans FGSC A4
MATPFLVSYDPASASGGLSLQQIAYFGRVLIKATDLAQAETFIRQNFRLLDIYVDATGISATGDLVDILNAGAAKIFISLDQLNALSEEQSVPSSRLVVYTSSNDQVEAFQKWVVKHIEREEAGLCTDSAVVHSISVKLGLNPEAQLLYRTYSGDVTEDAVKDTMKQGGVSIVPAAALTISREESSGKIQAGSLIAARGVKDQGNGLYATTVTDERGTCLGFVWSSDESIAEALRTGTGVYQSRKRGLWYKGQSSGDVQELIRIGFDCDSDCLVFIVKQIGRGFCHLGTASCFGPYTGLSRLQKTLQARKADAPAGSYTARLFNEPKLTQAKIMEEADELCRAETKEDIAFEAADLLYFALTRCVAAGVSLEDVERNLDLKSLKVKRRKGDAKGPWAEKAGLAEKPAEAKPAPKPEEPKEDTSRIEMTRVATASTPAEKVQEYLKRPSQKSNDAIVGLVKPIIQDVREQGDAGVLKYTHKFEKATSLTSPVLKAPFPAELMKLSPEVQEAIDVSISNIARFHSAQKGSNDALSMETMPGVVCSRFSRPIERVGCYIPGGTAVLPSTAMMLGVPAMVAGCKKIVFASPPRADGSITPEIVYVAHKVGAESIVLAGGAQAVAAMAYGTESVSKVDKILGPGNQFVTAAKMLVSNDTSAGVSIDMPAGPSEVLVIADKAANPAFVASDLLSQAEHGVDSQVILIAIDLNEQELKAIEDEVDRHARALPRMDIVRGSLAHSVTFVVRDLDEAMALSNDYAPEHLILQIQNAEAAVEKVQNAGSVFIGQWTPESVGDYSAGVNHSLPTYGYAKQYSGVNLGSFLKHITSSNLTADGLLRLSKTVETLAAVEGLDAHKRAVSIRVAAMKQEQL

SEQ ID NO: 15553 - protein, 438 aa, Streptomyces avermitilis MA-4680
MACVSYPYEAPVSQTLFERAAAVTPGGVNSPVRAFRAVGGTPRFMVSGNGPYLTDADGRTYVDLVCSWGPMILGHSHPEVIAAVQEAVARGTSFGTPGEGEVALAEEIVARVEPVEQVRLVSSGTEATMSAIRLARGFTRRAKVIKFAGCYHGHVDSLLAAAGSGLATFALPDTPGVTGAQAGDTIVLPYNDLDAVREAFRAHPGEIACVITEASPGNMGVVPPAPGFNQGLKDACAENGALYISDEVMTGFRTSKAGWYGVDGVRPDLMTFGKVMGGGFPAAAFGGRRDVMAHLAPAGPVYQAGTLSGNPVATAAGLAQLRLLDDAAYAKVDAVSAEIRTLVTDALTKEGVAHRLQNASNMFSVFFTDRPVNNYEDAKGQESFRFTAFFHSLLAQGVYLPPSSFESWFVSTAHDEQAVQRIADALPAAARAAAEATA

SEQ ID NO: 15554 - protein, 146 aa, Pseudomonas fluorescens PfO-1
MKTVAQLLKLKDPKNQEVHQIKPDHMVLEALMKMAEKNVGALLVVEDDNVVGIISERDYARKLVLHGRSSVGTPVRDIMVANVITVDTHQTVDTCLGIMSDKRLRHLPVVENGKLIGLLSIGDLVKEAIAEQAELIKQLEQYIRGE

SEQ ID NO: 15555 - protein, 412 aa, Shigella flexneri 2a str. 2457T
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKCYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENHDRIRQAIRGIKAMFRADGLLPVSSKHIHENAE

SEQ ID NO: 15556 - protein, 464 aa, Salmonella enterica subsp. enterica serovar Typhi str. CT18
MKNASTASGASVSDAASKNEPTLQRGLQNRHIQLIALGGAIGTGLFLGIGPAIQMAGPAVLLGYGVAGIIAFLIMRQLGEMVVEEPVSGSFAHFAWKYWGPFAGFLSGWNYWVMFVLVGMAELTAAGIYMQYWLPDVPTWVWAAVFFIIINAVNLVNVRLYGETEFWFALIKVLAIIGMIGFGLWLLFSGHGGEHASIDNLWRYNGFFATGWHGLLLSLAVIMFSFGGLELIGITAAEARDPQKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSHRGVPVNSLMLSGAITSLVVLINYLLPQKAFSLLMALVVATLLLNWIMICLAHLRFRAAMRRKGRETQFKALFYPAGNYLCIAFLALILVLMCTMDDMRLSAILLPVWIVFLFIAFTVLRRKAH

SEQ ID NO: 15557 - protein, 456 aa, Pseudomonas fluorescens PfO-1
MTTSRETRDYQAADAAHHIHAFVDQKALNDEGPRVMVRGDRLHLWDNDGRRYLDGMSGLWCTNLGYGRKDLNAAASRQLEQLPYYNMFFHTTHPQVIELSELLFSLLPGHYSHAIYTNSGSEANEVLIRTVRRYWQVLGKPEKKIMIGRWNGYHGSTLAATALGGMKFMHEMGGMIPDIAHIDEPYFFAHEGNLTPAEFGLRAAQQLEAKILELGADKVAGFIAEPFQGAGGMIFPPESYWPEIQRICRQYDVLLCADEVIGGFGRTGEWFAHEYFGFEPDTLSIAKGLTSGYIPMGGLILSKKMADVLVEQGGVFAHGLTYSGHPVAAAVAIANLKALRDEGVVTRVKDDIGPYLQQCLREVFGNHPLVGDIQGTGMVAALQLAEDKATRKRFANENDIAWRCRTIGFEEGVIIRSTLGRMIMAPALIASREEIDELVGKTLKALDRTAQEYGRL

SEQ ID NO: 15558 - protein, 497 aa, Pseudomonas fluorescens PfO-1
MFELADWQRKAAELSYPYQAVIDGKLRAAQSGQTFAAINPATGQLLANVAACGEEDVDAAVQNARQVFEAGTWAGRSPTERKQVLLRLADLILAHREELALLDSLNMGKPVMDAYNIDVPGAAGVFRWYAESLDKLYDQVAPSASNVLATITREALGVVAAVVPWNFPLDMAAWKLAPALAAGNSVILKPAEQSPFSALRLAELALEAGLPAGVLNVLPGLGEQTGKALGLHPDVDCLVFTGSTQVGKYFMQYSAQSNLKQVWLECGGKSANLVFADCQDLDLAAQKAAFGIFFNQGEVCSANSRLLVERSIHDEFVERLKAQAERWQPGDPLDPASAAGAIVDTRQTESILRFIHQAEREGATRVCGGRQLSFNGSDNFVQPTIFTDVQPHMTLFREEVFGPVLAVIPFDDEAHALHLANDSVYGLAASLWTDDLHRAHRVARQLRAGTVSVNSVDALDVTVPFGGGKQSGFGRDLSLHSFDKYTQLKTTWFQLRS

SEQ ID NO: 15559 - protein, 360 aa, Trichodesmium erythraeum IMS101
MINCRITLLPGDGIGPEIMAVAVDVLKVVGKQFNLEFEFQEAPIGGVAIDATGEPLPKETLEMCRNSNAVLLAAIGGYKWDNLPRHQRPETGLLGLRAGLGLFANLRPAKIFPQLIDASTLKREIVEGVDIMVVRELTGGVYFGTPKGVFETETKEKRGVNTMAYSESEIDRIAKVGFETAQKRGGKLCSVDKANVLEVSQFWRDRINLVAQEYQDVELSHLYVDNAAMQLVRFPKQFDTIVTGNLFGDILSDAAAMLTGSIGMLPSASLGASGPGVFEPVHGSAPDIAGQDKANPLAQVLSVAMMLRYALEQPVVADKIEQAVLQVLEQGYRTGDIMSEGMKLVGCKEMGEVLLKILSL

SEQ ID NO: 15560 - protein, 373 aa, Aspergillus oryzae
MPAKLIDRYDHVPVTKENLDWAELVTLDLSQYDQPGGKEDLVKQLDHAVRHVGFFYVKNFNISQDEIDRQFALGREFYALPLEEKLKYHSASDLEKGEYNGYRPAGHRALGNGVKDNVQVYNIPKFDGYHQRQQPPILGDHLEEIEAFSRKCHTEVVEKLLRLFAILLELPDEDQLVKDHQYDVKGEDHLRYMHYAARGAEENKIVGGMYVPGHTDLGTVTLLFRQPVAALQILNSQGQWKWVRPQDGTITVNTCDALTALTGGLIKSSIHRVHVPPADQAHVDRLGVLYFARPNNHVVLDPIQNSPLLNRLGLTQNVFTELGQHLTTEQWVKVRQTQQQRRTRDAKISEDGKYTYQPKDLEIIPGLHAKVYN

SEQ ID NO: 15561 - protein, 225 aa, Zea mays
  misc_feature (79)..(79): Xaa can be any naturally occurring amino acid
  misc_feature (206)..(206): Xaa can be any naturally occurring amino acid
MSTAGKTITCKAAVAWEAGKPLSIEDIEVAPPKANEVRIQIYYTGVCHTDAYTLSGKDPEGAFPIVLGHEGAGIVESIXGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCXGLSVVQGAAARKAGKIIRC

SEQ ID NO: 15562 - protein, 156 aa, Oryza sativa (indica cultivar-group)
MMMTEVANHSKRNHNESYFTGKAAVTSSSEEFGSMTSKKPRNTNPRDAPVSPKEKKDKIGERVAALQQLVSPFGKTDTASVLQEASGYIKFLHQQLEVLSSPYMRAPPVPGAAPEDPDHYSLRNRGLCLVPVDQTLQLTQSNGADLWAPANTTRRR

SEQ ID NO: 15563 - protein, 572 aa, Aspergillus oryzae
MAGGMASQGISAKRAELAGGRVGWRGLVSSKKAFGIALFASLGGLVYGYNQGMFAQILTMRSFIDATQGYAEHTGTAQGMLTSILELGAWLGTLANGYLADALGRRVTVVVAVVVFCVGVIVQACTTNPDFVYAGRFVTGLGVGNLSMIVPLYNAELAPPEIRGSLVAVQQLAITFGIMVSFWIGYGTNFIGGTGEGQSIAAWEIPVCIQILPALVLAVGMMLFMPQSPRHLMNQGREEECLQTVARLRDASVDDMLVRIEFLEMKALRMFEEETARKKYPQYQDGSFKSRFMIGVHDYMSLITDKSLFKRTTVACLIMVFQQWNGINAPQIFKDLELGGTTTSLLATGVAGIFEFVFTIPAVLWVDNIGRKKILIAGGIGMAVCHFIVAGIIGSYQHTFAEHKAPGWVAVVFVWIFIINFAYSWGPVAWIVVSEVYPLSMRAKGVSIGGSSNWLNNFAVGLSTSPFLSASNYGTFIFFGCITTIGVFWVWFLVPETKGRTLEEMDELFGSGGMAAEDEARKRRIEREIGLLALLAGGGWSAGGNLGKALPGTSIGVTASEGPGAGHEIRWV

SEQ ID NO: 15564 - protein, 560 aa, Listeria monocytogenes str. 1/2a F6854
MSNKVKSDIEIASKAEILPVTTIAEHLGLDADALELYGKYKAKLSYDTIHSLKDKEPGKLVLVTAINPTPAGEGKSTVTVGLGDALSKKDKKTVIALREPSLGPTMGIKGGATGGGYAQVIPMEDINLHFTGDFHAITAANNALSAFIDNHMQQGNDLDIDGRRIVWKRVVDLNDRALRKVVVGLGGPIQGVPREDGFDITVASEIMAIICLASDLKDLKKRLSEIVIGYNYKKEPITVGEMGYEGALTLLLKDALKPNLVQTLEHTPAIVHGGPFANIAHGCNSVSATSTALRLGEYVVTEAGFGADLGAEKFLDIKVPALGKAPDCVVIVATIRALKMHGGALKTELSEENVDALAKGFTNLQKHTESIQAFGIPYVVAINKFITDSDAEVAKLEALCEEHGIPFSLTEVWEKGGDGGLELADKVIAAVESGEADYKRIYDDAWSIEEKLEAIVTKVYGGIGVELSSKAQKQIVEFKKYGWDRYPICMAKTQYSLSDDPTLLGRPTDFVIHIREFIPKLGAGFVVALTGDVMTMPGLPKKPAALNMDVDENGNAQGLF

SEQ ID NO: 15565 - protein, 548 aa, Ralstonia metallidurans CH34
MENLIVSARSAYAYPLLIKQLLINAMSLYGDQEISYRGELRYTYREFRERVGKLANSLSALGVHHGSTVAVMDWDSHRYLECYFGVPMMGATLFTVNVRLSPQQILYTLNDAGADVVLVHPDFVPVIDQIRDKLTCKPRFVLMADGQTVPDTAIPFAGEYEALVGAASPEFEFPEFDERTKAATFYTTGTTGDPKGVCYSHRDIVLHTLTATASLCSPREGQRMHREDVYMPITPMFHVMAWGIPYVAITLGLRTVLPGRYAPEMLLKLRAQEKVSFSHCVPTILQMLLHAAEAGGQDLSGWKIIIGGSALPPSLCEAALERGIDIFAGYGMSETGPIVALAQLPPGYQPASREEEVRLRCSTGRPVPLADFRVVGTDMRELPRDGQSQGEIVLRAPYLTRSYFRKPSASEELWADGYLHTQDVAVVHENGFVQIVDRLKDVIKTGGEWVSSIEIENLVTRVPGVRECAVIGVPDARWGERPMAFVVRQPDSEVGAEDIRAELMNHVSAQRLSKFAVPEADRIAFVAEIPKTSVGKIDKKLLRGNKAA

SEQ ID NO: 15566 - protein, 209 aa, Saccharophagus degradans 2-40
MNDLDNLFQSNKDWAEAIKAEDPHFFEKLSAQQFPEYLWIGCSDSRVPANQIVGLMPGEMFVHRNIANCVVHTDLNCLSVIHYAVSVLKVKHIIVTGHYGCGGVAAALTNQQFGLVDHWIRNIRDVYQKQKAELENITDEKERLNRLCELNVKQQALNVTALPAVQNAWKEGRELTVHGWIYSLEDGLLKKLTDSIGSIEQVAEQFRVI

SEQ ID NO: 15567 - protein, 285 aa, Oryza sativa (japonica cultivar-group)
MDSTASGSGRPRPRPPPLLPPSSSGPPTSRGKGCLEPWSHSYTWEEDFSATDDDDDEEIEDQLHHKALQDHSKLKTKAKDDKKKKKKDNNTVVVNKEQKKCPFSVKIEEIPPEEDNTAGCVAIRKAFALGNGKAKKKELSPQDAALLIQLNYRAHLAHRSQVLRCLRDLAVAKAKLKEIRSLFYNISYRHRMAHDHEERQRFTEKIIVLLLTVDALEGPDYMVRTAKKSMLDELEGMLEIVDPQPPGKQRSLTRRKFDLPEGGPITDEKMAGVNNAVKVIQKGKK

SEQ ID NO: 15568 - protein, 667 aa, Pyrococcus furiosus DSM 3638
MSIGVRMSVKVVCPYCGFGCNLLVDTITKKVRPYRGEPNRGKLCPKGLFALEHVYSKDRLRYPLKREGSDFKRISWERAISEIAEKIREIIENYGPSSIAFIASSKITNEENYLLQKIARLLGTNNIDNCARLCHESSVHALKLTLGAGIQTNPYSDLEKFKALMIWGYNPAETHPVVMQYIMNAKKNGAKIIVVDVRETTTMKFGDYKVIIRPGTDITLANAIMNVIIENRWYNKDFIEKRTVGFSEIRMGVKKYTPEYAEKITGVPARLIKEIAEAFAKAGSGAILWGMGVTQQIAGVENVLALINIALLLGYFGEKGGLYPMRGQNNVQGAAYMGTLSEFLPGYVPLSDSEFRKKVAKLWGVEDLPTERGLYLTEYWDAILNGDLKVLYIVGENPAISDANVLKVRKALTKLELLVVQDIFLTRTARYAHYVLPAAAFCEKEGSYMNSERRIQWSHKACEPLGESKPDWEILTMLANALGLRGFNYKRVEEITEEYFKLFPELENRSVEELKNSEGIVIPSPRLYTDRFLTPGGRARFISVEQIMPWEEPNGEYPLILTTVRLITHYNTGEMTMRSPSLTKMIGEPFVLISREDAQEYGIKEGDYVVVETRRGNLTLKAKISNIQRGVIAIPFHFEANVLTNDALNKAGTPELKFSAARIRKVS

SEQ ID NO: 15569 - protein, 162 aa, Malassezia dermatis
MSNVFFDITKNGAPLGTIKFKLFDDVVPKTAANFRALCTGEKGFGYAGSHFHRVIPDFMLQGGDFTAGNGTGGKSIYGAKFADENFQLKHNKPGLLSMANAGPNTNGSQFFITTVVTSWLDGKHVVFGEVVEGMDVVKAIEAEGSGSGKTRSRIEIAKCGVC

SEQ ID NO: 15570 - protein, 598 aa, Wolbachia endosymbiont of Drosophila ananassae
MNNIRNFAIIAHIDHGKSTLADRLIEECNGLEAREMINQILDSMDIERERGITIKAQTVKLNYTANDGNQYCLNLMDTPGHVDFSYEVSRSLAACEGSLLVVDSSQGVEAQTLANVYKAIDNNHEIIVVLNKVDLPAADPEKVKLQVEEVIGIDASESVLISAKTGLGIKDVLEAIVAKLPAPQGDVNAPLQAILVDSWYDTYLGVVILVRVKNGVLKKGMKIVMMSNNATYQIDNIGIFTPKKVMTGELSAGEVGFITASMKEVADCKVGDTITEEKRPCSEALPGFKEVHPVVFCSIFPHKTDDFKYLREALEKLHLNDASFTFEAETSNALGYGFRCGFLGMLHLEVIQERLEREFDLDLTATAPSVIYRVTTRSGEILNIHNPSDMPDPTKIEIVEEPWITATIMVPDQYLGEILSLCEERRGEQEDLSYIGNTTTALLRYKLPLSEVVFDFYDRLKSISKGYASLDWEISSYLVSQIDKLSFLINGEPVDALACIVHKSRAEKRGREICARLKDLIPRQQYKIAIQAAVGGKIIARETINPYRKDVTAKLYGGDVTRRMKLLEKQKKGKKRLHSIGNVNIPQNAFIQALKISD

SEQ ID NO: 15571 - protein, 160 aa, Salinibacter ruber DSM 13855
MNPRDGLLDTRVKDIIQSKSALADDGNVLTTSPTATVFECIGRMVDRDVGSIVVMEGDAIAGLFTERNYMQSIALEGRSSDETEVQEVMTEDVATVRPDKPLEECLRLMTRLRCRHLPVVDEGGDLIGIVSIGDGVKQIIQTAQRETSRLRQYVTGTYAE

SEQ ID NO: 15572 - protein, 162 aa, Malassezia globosa
MSNVFFDITKNGAPLGTIKFKLFDDVVPKTAANFRALCTGEKGFGYAGSHFHRVIPDFMLQGGDFTAGNGTGGKSIYGQKFADENFQLKHSKPGLLSMANAGPNTNGSQFFITTVVTSWLDGKHVVFGEVVDGMNVVKAIEAEGTSSGKPRSRIEIAKCGVC

SEQ ID NO: 15573 - protein, 554 aa, Haemophilus influenzae R2866
MKGNTMKNINPTHTQAWKFLEAHKAELSNTTIQDLFKQEKNRFDDYSLTFNNQILVDFSKNNINQTTLSLLRQLAQECSLDSAKEAMFTGEKINRTENRAVLHTALRNRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNNMFEFWDWVGGRYSLWSAIGLSIALSIGFENFEALLNGAHEMDKHFRSTPIEKNIPTTLALVGLWNTNFLGAQTEAILPYDQYLHRFAAYFQQGNMESNGKYVDRDGNVINNYQTGPIIWGEPGTNGQHAFYQLIHQGTTLIPCDFIAPAQSHNPLADHHNKLLSNFFAQTEALAFGKTKEEVEAEFVKAGKSLDDVKNIVPFKVFTGNKPTNSILVQKITPFTLGALIAMYEHKIFVQGVIFNIFSFDQWGVELGKQLANRILPELTDSEKVASHDSSTNGLINQFKAWR

SEQ ID NO: 15574 - protein, 162 aa, Malassezia japonica
MSNVFFDITKNGAPFGTIKFKLFDDVVPKTAANFRALATGEKGFGYEGSSFHRVIPDFMLQGGDFTAGNGTGGKSIYGAKFADENFNLKHNKPGLLSMANAGPNTNGSQFFITTVVTNWLDGKHVVFGEVVDGMDIVKAIEAEGTGSGKPRSQITIAKCGVC

SEQ ID NO: 15575 - protein, 162 aa, Malassezia nana
MSNVFFDITKNGAPLGTIKFKLFDDVVPKTAANFRALCTGEKGFGYAGSHFHRVIPDFMLQGGDFTAGNGTGGKSIYGAKFADENFQLKHNKPGLLSMANAGPNTNGSQFFITTVVTSWLDGKHVVFGEVIEGMDVVKAIEAEGSGSGKTRSRIEIAKCGVC

SEQ ID NO: 15576 - protein, 324 aa, Streptomyces avermitilis MA-4680
MSDARTPRIPTVDLRPWLSGDPDARARIARTVDDALRTAGFLLVTGHGVDPSLRTRIRVAARAFFTLPAETKQRYAARVGGRGWLGPGAEANGYSEGTETPPDLKESLTFATHEPFEDPETNAEWYAPNVWPAEAPELREPCEEYLAEMAGLEDRLLTLLGEALGLEPDFFTKHMTHPTYGFNINWYPGTEVTGDPAPGQFRIGPHTDFGTVTILDRQAGKGGLQVYTDDGGWADAPFDPAAFTINIGDLMARWTGDRWRSGRHRVLPPPADAPAEELMSLVYFGECTPGTLVESVPAPVGRVAYEPVDSHTYLREKLNSITVD

SEQ ID NO: 15577 - protein, 175 aa, Triticum aestivum
MPPTVMASSPTSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCDTPGKA

SEQ ID NO: 15578 - protein, 412 aa, Shigella flexneri 2a str. 2457T
MTNYRVESSSGRAARKMRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELIFSQPNLAQLGKGMVIPSLPTSEAVFLAAGVLGATIMPHVIYLHSSLTQHLHGGSRQQRYSATKWDVAIAMTIAGFVNLVMMATAAAAFHFSGHTGVADLDEAYLTLQPLLSHAAATVFGLSLVAAGLSSTVVGTLAGQVVMQGFIRFHIPLWVRRTVTMLPSFIVILMGLDPTRILVMSQVLLSFGIALALVPLLIFTSDSKLMGDLVNSKRVKQTGWVIVVLVVALNIWLLVGTALGL

SEQ ID NO: 15579 - protein, 430 aa, Zea mays
  misc_feature (383)..(383): Xaa can be any naturally occurring amino acid
  misc_feature (392)..(392): Xaa can be any naturally occurring amino acid
MIYTAIDTFYLTDEQLRDSPSRKDGIDEATETALRVYGCDLIQESGILLRLPQAVMATAQVLFHRFYCKKSFVRFSAKRVAASCVWLAGKLEESPRKSRHIIFVFHRMECRRENLPIEFLDVFSKKYSELRHDLIRTERHLLKEMGFICHVEHPHKFISNYLATLEAPPELTQEAWNLANDSLRTTLCVRFKSEVVACGVVYAAARRHRVPLPEDPPWWTVFDADEAGIQEVCRVLAHLYSLPKAQYIPVYKDNDSFTVKRISDLQASKESPARAVASDKGTPVPSSSSQEKDPVAKTILNKVKEKSDDEGKPLPAEFDGKENPVANSKNDKSDSGVDRSRERERERERSRGRERDARGRDSDHDSRGRDSDRERDRRRRSRXEVQMTHWSXNLNAGHSDKEKSRRHSSRDRADYYNSHSSREKDRHRHH

SEQ ID NO: 15580 - protein, 115 aa, Alteromonadales bacterium TW-7
MALERTFSIVKPDAVAKNHIGAIYNRFETAGLKIVAAKMVHLSQEKAEGFYAEHSERPFFGALVSFMTSGPVMVTVLEGENAVLKNREIMGATNPAEALAGTLRADYADSIDENA

SEQ ID NO: 15581 - protein, 201 aa, Triticum aestivum
  misc_feature (101)..(101): Xaa can be any naturally occurring amino acid
  misc_feature (142)..(142): Xaa can be any naturally occurring amino acid
  misc_feature (150)..(150): Xaa can be any naturally occurring amino acid
  misc_feature (156)..(156): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREXHKCVSRGTTTGATGTMWKLPNVRGATDATQVINEVEEVKKXEYPDAYVXRIIGFXDNMRQVQCVSFIAFKPPGCKESGKGLNSSTHTGQHIKCHCRFCQL

SEQ ID NO: 15582 - protein, 254 aa, Anabaena sp.
  misc_feature (11)..(11): Xaa can be any naturally occurring amino acid
  misc_feature (32)..(32): Xaa can be any naturally occurring amino acid
  misc_feature (70)..(70): Xaa can be any naturally occurring amino acid
  misc_feature (88)..(88): Xaa can be any naturally occurring amino acid
  misc_feature (134)..(134): Xaa can be any naturally occurring amino acid
  misc_feature (211)..(211): Xaa can be any naturally occurring amino acid
  misc_feature (232)..(232): Xaa can be any naturally occurring amino acid
FCLTLRRRYTXGHHHHHHHHHHSSGHIEGRHXKLEQTLTLSPNLIGFNSNEGEKLLLTSRSREDFFPLSXQFVTQVNQAYCGVASIIXVLNSLGINAPETAQYSPYRVFTQDNFFSNEKTKAVIAPEVVARQGXTLDELGRLIASYGVKVKVNHASDTNIEDFRKQVAENLKQDGNFVIVNYLRKEIGQERGGHISPLAAYNEQTDRFLIXDVSRYKYPPVWVKTTDLWKAXNTVDSVSQKTRGFVFVSKTQDD

SEQ ID NO: 15583 - protein, 254 aa, Anabaena sp.
  misc_feature (11)..(11): Xaa can be any naturally occurring amino acid
  misc_feature (32)..(32): Xaa can be any naturally occurring amino acid
  misc_feature (70)..(70): Xaa can be any naturally occurring amino acid
  misc_feature (88)..(88): Xaa can be any naturally occurring amino acid
  misc_feature (134)..(134): Xaa can be any naturally occurring amino acid
  misc_feature (211)..(211): Xaa can be any naturally occurring amino acid
  misc_feature (232)..(232): Xaa can be any naturally occurring amino acid
FCLTLRRRYTXGHHHHHHHHHHSSGHIEGRHXKLEQTLTLSPNLIGFNSNEGEKLLLTSRSREDFFPLSXQFVTQVNQAYCGVASIIXVLNSLGINAPETAQYSPYRVFTQDNFFSNEKTKAVIAPEVVAKQGXTLDELGRLIASYGVKVKVNHASDTNIEDFRKQVAENLKQDGNFVIVNYLRKEIGQERGGHISPLAAYNEQTDRFLIXDVSRYKYPPVWVKTTDLWKAXNTVDSVSQKTRGFVFVSKTQDD

SEQ ID NO: 15584 - protein, 88 aa, Brassica napus
MGLIKNTVHYCCVSRDNQILYAYNGGDQSNESLAGLCLEKTPPFHAWYFESIGKRRFGFLTGDGFVYFAIVDEVLGKVSVLKFLEHLR

SEQ ID NO: 15585 - protein, 368 aa, Magnaporthe grisea 70-15
MVLHNPNNWHWVNKDVAPWAKQWFQDNLTKLEVQDGDVTAKVSKVVSMDGDVDVSQRKGKVITIFDVKLVLEYSGNIADGDEVTGTITIPEVAHDTEENEFVFEIDIYSDSKEKQPVKDAVRSKLVPKLRSEFVKLAPALIAEHGKDIQHAPGSNPSSGFSTPKVHAPSGAAAKATTSTTAQTNSTGSVVNTTTVTDQEEFRTTAAELYQTFTDPQRLAAFTREAPRVFEGAKKGGKFQLFGGNVEGEFLDLQEPTKIVQSWRLRQWPAGHFSKLEIEFDQNDREGVTTMRVNWSGVPIGQEEVTKQNWLEYYVRSIKKTFGLANSVQLRNHSLKPLFSSRWAEGDEGVCAGGGGKAFEGMLQPLTAP

SEQ ID NO: 15586 - protein, 665 aa, Chlamydophila abortus S26/3
MVNREVDIDILEKISGTLKQLSIEIIQKAGSGHPGLPLGCAELAAYLYSYVLRHNPKDPLWIDRDRFVLSAGHGSALLYACLHLAGYDVSLEDLQQFRQLHSRTPGHPEFGETEGVEATTGPLGQGLGNAVGMALSMKMLGVRFNRPEHEIFNGKVYCLAGDGCMMEGVSHEVCSFAGTLGLDNLVVIYDYNNIVLDGFLGEVSSEDVKKRFESYGWEIYEVDGYDFLGIHEIFVKVKQSQQRPVLIIAHTVIGHGSPKEGSHKAHGSPLGEAGVEQTKRFWHLPEEKFFISPVVKSFFSNKLHEDRKVQEEWQDNFRVWSRLFPDLYQEFLSLKSPLSSEQLEIILDGVVMPDNIAGRAASNKIIQDLAKNIPSLIGGSADLSSSDGTWITDAKDMNSHDFSGRNIKYGVREFGMGAIMNGLAYSQVFRPFGGTFLVFSDYLRNAIRLAALAKLPVIYQFTHDSIFVGEDGPTHQPIEQIMSLRAIPGLQVIRPGDANEVKGAWHAALRYAGPTALILSRQNLPTLAQTHRPFKEGVGRGAYIVLKETQGKPDYTLFATGSELHLALAVAQELIHLDKKVRVISFPCWELFEQQDFEYRESVIGGDSGLRVSIEAGSALGWYKYIGANGLAIAMDRFGYSGAPADVAEACGFTADCILQRILSQ

SEQ ID NO: 15587 - protein, 427 aa, Pseudomonas fluorescens PfO-1
MSRSETLFANAQKHIPGGVNSPVRAFKSVGGTPLFFKHAEGAYVTDEDDKRYVDYVGSWGPMILGHSHPDVLDAVRNQLQHGLSYGAPTAMETEMADLVCSLVPSLEMVRMVSSGTEATMSAIRLARGFTGRDSIIKFEGCYHGHSDSLLVKAGSGALTQGVPSSAGVPAAFAKHTLTLPFNDIDAVEKMLAEVGQDVACIIVEPVAGNMNCVPPAPGFLEGLRSLCDKHGVVLIFDEVMTGFRVALGGAQAYYGVTPDLTTFGKIIGGGMPVGCFGGKRLIMERIAPLGPVYQAGTLSGNPLAMAAGLTTLRLISRPGFHAELTDYTTRLLDGLQQRADAAGIPFVTTQAGGMFGLYFSGADDIVTFEDVMASDAALFGRFFHLMLEGGVYLAPSAFEAGFTSIAHGEAELKLTLDAAERAFAKLK

SEQ ID NO: 15588 - protein, 422 aa, Chlamydophila abortus S26/3
MKKAIIIGAGISGLSTAWWLHRKFPNSELIIIDKADRPGGLIYSDYQKNFSLDLGPKSFLVRGEGHYTLELIRDLQLEEALIVSDKTAKKRFIRYKGKTRKVSPWTLIKEGLPFAIIKDLFASRYTKDSSVYDFLSRHSTVHLIHNILNPVVTAVRAGHSHLLSAHMAFPSLSQREAKTGSILRSYLKEPSKKKTPGAPYLVSLRPNLGILIDTLVKKLPVTWKLSSPVTKIECFPSKVVVSTTQETFSGDLAIYTGATSLLPSLIDIPGMQQLANKTLHWDLSCATLGWSRDIPTIPKGYGMLFSDEPPLLGIVYNSRVFPNQMPGKTVLSLLLENRWHQEEAYAFSLAAISEYLGISTQPDVFSLFSPEDGLPQHGVGFVEMKNRILPAIPHNLKIVGQNFSGPGLNRCVASAYQTVAAI

SEQ ID NO: 15589 - protein, 413 aa, Oryza sativa (japonica cultivar-group)
MTEGNIARWVKKEGDKVSPGEVLCEVETDKATVEMECMEEGYLAKIIHGDGAKEIKVGEIIAVTVEEEEDIGKFKDYKAPSSAESAAPAESKPQSEPTEPKKEKEQPKAPEPKATKTEESFLSEDRTFSSPIARKLAEDNNVPLSSIKGTGPDGRILKADIEDYLASVAKGAKKETAAAPGLGYVDLPNTQIRKVTANRLLHSKQTIPHYYLTVDTRVDKLIKLRSELNPLQDTSGGKKISINDLVIKAAALALRNVPECNSSWMNDFIRQYHNVNINVAVQTEDGLFVPVIRDADKKGLATIADEVKQLAQRARDNSLKPEDYEGGTFTVSNLGGPFGIKQFCAIVNPPQSAILAIGSAEKRVIPGAEGQFEVGSFMSATLSCDHRVIDGAIGAEWMKAFKGYIENPTTMLL

SEQ ID NO: 15590 - protein, 527 aa, Mycobacterium avium subsp. paratuberculosis K-10
MAFRPVSAAAASAGAILGGRTHPRAGGVSMARDHAHAALIIGAGFTGLGAAIRLAEAGVDDIVILERADRVGGTWRDTTYPGASCDVPSLLYSYSFVKNPTWSRTYSPAPEIYRHLEDMADRFDIRRRIRFGHEVSGLAFDEDAGVWTATTKNRKKFRARTVVLASGPLSDVSFPDIRGLDSYRGHKIHSARWDHDYDFAGKRVAVIGTGASAIQIIPELVKQAGFVKVFQRTPCWVLPRLDVATPPAVQALFAKVPAAQELARQALYWGHEASATALVWDTPLTSLVARLGKAHLRAQVKDPWLRRQLTPDFRPGCKRMLVSSDYYPALQRDNCKLIDWPIATLSPAGIRTSDGIEHHLDCIVFATGYDVHLTGPPFPVTGLGGRSLAAEWAGGAQAYKSINVHGYPNLFVMTGPNSGPGHNSLLVYIEGQLDYAVRGITTILNDDLRYLDVREEVQRRHNEAIQRRLTKTTWMSGCRSWYLTKDGFNGSMYPGFATQYLRQMSDFRYQDYQAVARRARTPAASSA

SEQ ID NO: 15591 - protein, 443 aa, Thermotoga maritima MSB8
MRYDVVVVGGGPAGLVAAFTTKRFFGDKKILVVKKTEKEMVPCGIPYIFHTLGSVENDYMGIEDRFKGAGIDLLIDEVVDGNPDEKKLFTKSGKEISYDKLIIATGSSPNIPKIPGVDLKGVFTVPKEADYLKLLHEKVKDANDVVIIGGGFIGVEVADEIKKSGKNVTLVEIMDSLLPVSFDPDFGELARKELESDNVKVLTGRKVTEILGTEKVEGVKLDSGETIPADVVVLATGYKPNSELARKLGLKVTELGFIETDEYMRTSKPDIFAAGDCVQHKDFLTGKPSRLMLASAAVFDARIAASNLYGLKVIRTNKGSLNAYSTVIGSKAFGSVGITERIAKEEGFEVVVGKAEAPDRHPGKFEDTSKLVVKLIFSEDSKILLGAQVCGGKSVGEIVNLISLGIQKGITANDLFTMQIGTHPLLTSAPTVYPLAKAAEMVL

SEQ ID NO: 15592 - protein, 449 aa, Thermotoga maritima MSB8
MYDAVIIGGGPGGYVCAIKLAQLGKKVALVEKDALGGTCTNRGCIPTKAMLTVSHLMDEMKEKASKYGLKVSGVEYDVAAIMKHVQKSVMMSRKGIEYLLKKNGVEVFKGTAVVENKNTVVVQETGEKLEAKNLVLAHGSVPSVFSPFDIDGVWTSDDVFNLKEFPKSLVIVGGGVIGVEFATFFGSFGVDVTIVEIAEHILPYEDSDVAEEVKKALKRKGVKILEKTKISSLSKVDDGFEVALENGETLKAEKVLLAAGRKPNIPEDVKALGVKIEKGVVTDSRMRTNVENVYAIGDIRSGIMLAHVAMYEGIVAAKNIAGEEEEMDYSAVPSIIFSSPEVASVGVREKDVNPEEVVISKFPVSANGRARTMLENIGFAKVIADKKDGTVLGMSIVSPSATDMIMEGVIAVKFRMKAEDLEKAIHPHPTLTETILGALEGVSGKPIHL

SEQ ID NO: 15593 - protein, 154 aa, Methanosarcina barkeri str. Fusaro
MKVKDVMNPNVVFCKPDDTVRETARILKENNVSGAPVLEGEELVGIISEADLLKLLILPEKGELWLPSPFEVIEVPIRELLGWEETKKMLSDVGSTKIEEIMIRNVHTISSEASIEEASEHMIRHRINRLPVTEDNRVVGIITRGDIIKGLAKL

SEQ ID NO: 15594 - protein, 162 aa, Malassezia restricta
MSNVFFDITKNGAPLGTIKFKLFDDVVPKTAANFRALCTGEKGFGYAGSHFHRVIPDFMLQGGDFTAGNGTGGKSIYGAKFADENFQLKHSKPGLLSMANAGPNTNGSQFFITTVVTSWLDGKHVVFGEVVDGMDVVKAIEAEGTGSGKPRSRIEIAKCGVC

SEQ ID NO: 15595 - protein, 162 aa, Malassezia slooffiae
MSNVFFDITKNGAPLGTIKFKLFDDVVPKTAENFRALCTGEKGFGYAGSSFHRVIPDFMLQGGDFTAGNGTGGKSIYGAKFPDENLALKHNKPGLLSMANAGPNTNGSQFFITTVPTSWLDGKHVVFGEVTDGMDVVKAIEREGSGSGKPKSVITIAKCGVC

SEQ ID NO: 15596 - protein, 141 aa, Malassezia yamatoensis
MSNVFFDITKNGSPLGTIKFKLFDDVVPKTAANFRALATGEKGFGYEGSNFHRVIPDFMLQGGDFTAGNGTGGKSIYGQKFADENFNLKHNKPGLLSMANAGPNTNGSQFFITTVVTPWLDGKHVVFGEVVDGMDVVKAIE

SEQ ID NO: 15597 - protein, 194 aa, Thermus thermophilus HB8
MREATVERATAETWVWLRLGLDGPTGGKVDTGLPFLDHMLLQLQRHGRFLLEVEARGDLEVDVHHLVEDVGIALGMALKEALGDGVGLERYAEAFAPMDETLVLCVLDLSGRPHLEFRPEAWPVVGEAGGVNHYHLREFLRGLVNHGRLTLHLRLLSGREAHHVVEASFKALARALHKATRRTGEGVPSTKGVL

SEQ ID NO: 15598 - protein, 347 aa, Triticum aestivum
CHASERSEAELAEPIIRLLPVALGLLYLGKQESVEATAEVSKTFDEKIRKYCDVTLMSLAYAGTGNVLKVQKLLGICSQHLEKGETHQGPAVLGIALIAMSEELGAEMAVRSLERLLQYGEQNIRRAVPLALGILCISNPKVNVMDTLSRLSHDADADVSMAAIISLGLIGAGTNNARIAGMLRNLSSYYYKEAAHLFCVRIAQGLVHLGKGLLTLSPYHSDRFLLSPMALGGIVTVLHACLDMKSTILGKYHYILYIIVLAMQPRMLLTVDEDLKPLPVPVRVGQAVDVVGQAGRPKTITGFQTHTTPVLLAAGERAELATDKYIPLTSTLEGFVILKKNPEYHEE

SEQ ID NO: 15599 - protein, 308 aa, Salmonella typhimurium LT2
MLELQEASRLPERLGDDFVRAANIIIHCEGKVIVSGIGKSGHIGKKIAATLASTGTPAFFVHPAEALHGDLGMIESRDVMLFISYSGGAKELDLIIPRLEDKSVALLAMTGKLHSPLGRAAKAVLDISVEREACPMHLAPTSSTVNTLMMGDALAMAVMQARGFNEEDFARSHPAGALGARLLNNVHHLMRQGDAIPQVMLATSVMDAMLELSRTGLGLVAVCDEQHVVKGVFTDGDLRRWLVGGGALTTPVSEAMTPNGITLQAQSRAIDAKELLMKRKITAAPVVDENGKLTGAINLQDFYQAGII

SEQ ID NO: 15600 - protein, 143 aa, Triticum aestivum
  misc_feature (30)..(30): Xaa can be any naturally occurring amino acid
  misc_feature (122)..(122): Xaa can be any naturally occurring amino acid
KPLSRPNQTPHRTRTRTAHRRPRRRREKKXEMEAAAAAAGVQLGTSKPQIATQAEMAEARLPIPYRDQCAHLLIPLNKCRVAEFYLPWKCEPERHSYEKCQYELVMERMLQMQKIRRRRRRXAKVKGSVTIGVPLAPSTAKLA

SEQ ID NO: 15601 - protein, 664 aa, Listeria monocytogenes str. 1/2a F6854
MFDNTDSLAVNTIRTLSMDAIQKANSGHPGLPMGAAPMAYALWSRVLNTNPKNSHWFNRDRFVLSAGHGSMLLYSLLHLSGFKLELEDLKNFRQWESKTPGHPEYRYTDGVDATTGPLGQGIAMAVGMAMAERHLEAKYNKDGFPVVDHYTYALCGDGDLMEGVASEAASYAGHQQLGRLVVLYDSNDISLDGDLDKSFSENVKQRFEAYGWEHLLVKDGNDTAEILAAIEKAKQNTSQPTMIEVKTVIGFGAPNAGTSKVHGAPLGDEGILEAKKAYGWNYEEKFFVPEEVTARFKETIGERGEKAETAWNELFASYKAEYPELAKQLEDSLNNKLPADWDADFPVYDDSKALASRASSGEVINALAGKIPTIFGGSADLAGSNNTTIKTDGEFTKATPAERNIWFGVREFAMGAALNGMALHGGLQVYGGTFFVFSDYVRAAIRLSAIQHLPVTYVMTHDSIAVGEDGPTHEPVEQLASLRAMPGLSVIRPADGNEVVEAWKLAITSTSTPHVLVLTRQGLPTLPNSAKLTAEGVKKGAYVISPAKGEVPEAIILASGSEVNLAIEAQKELQAQGTDVSVVSVPSFDLFEQQSAEYKESVLPNAVRKRVAVEMGASFGWERYVGLDGKVIGIDKFGASAPGETVIKNYGFTVENVVNTVKSL

SEQ ID NO: 15602 - protein, 284 aa, Brassica napus
RISDFGLSALAEQIRPDGLLHTLCGTPAYVAPEVLAKKGYDGAKIDVWSCGVILFVLNAGYLPFNDHNLMVMYRKIYKGEFRIPKWTSPDLRRLLTRLLDTNPLSRITIEEIIRDPWFRQGYDDRMSKFHLEDSDMKLPANEMRMNAFHIISGSPGFNLSGLFSGKFDRVERFVSGWAAARVVEKLEEMAAAENLTVASKEAWGMKIQGEGGSFAMVVEINQLTDELVMIEVRQRQRAGGDIWSDTLRPFLVEIAHKPDDTVAGLQTTHYQEGASSLRDVNTTT

SEQ ID NO: 15603 - protein, 361 aa, Oryza sativa
MDRDDERLGRALAAFGGGGGGGGGGVWELVDAALACAARDRPDELRARRDGIVERLYAAGGGGGGNCGAAAATTPSPRGAAVAEGEDDDDEAAAAADGLEIKILAIKDFLEDEDQFAQRNRRNLTRAARFWFASSQSEDELLSLLQSLADMDITYKALQETDIGRHVNGLRKHPSGEVRLLVKQLIRKWKEIVDDWVRLHNSSGDASNSIITDGNSPEKIQGKNQQSSQVSEFKYSPSPSRHNNSSSERVSNGIASIAATKHRASPAPAHHNARQINNTHHSTTSSSAPAWRMVKEQKDSHLDLERLDSARKRLQENYQEAQNAKKQRTIQVMDINEIPKPKNRNAFIRKGNGGGFPARHR

SEQ ID NO: 15604 - protein, 339 aa, Ostreococcus tauri
MRSPGATNAAFGLVVLAGARSSDVFARSNRARVSSLVASTPAPIDARSLRALEPRARARKPEKRSSSSRASTARSSTKKTNARDDGLEAAAAATSARVDVDQVRKAVSALATHLEKVANEKPSSALFDDEAETYHALISLRRTPKETTSARLIAVPIPHPLLDLSTAELCLIVKDHQGEGHKEAKQRVAEMAQCGVAKVLGISKLKANYKAHEQKRKLCDSYDMFLADDRVIPILPKLLGKNFFKKKKQPVAVDLTKKDWVAQVKRAVSATYMHIAGGTCVNVKVGKSTMGEDEIVENIMAAIAGAVHKIPRRWGNVQSIYIKTPDSVALPIFAAPPDE

SEQ ID NO: 15605 - protein, 412 aa, Caulobacter crescentus CB15
MSAEVNQNACVVIVGAGHAGGSVAAFLRQYGHEGRIVLIGDEPLLPYQRPPLSKAWLKGEADADSLSLKPAGWYADNNVMLRLGGVAERINRSDKTVALASGEVIPYDFLVLATGARARELPIPGADLAGVLALRTAADAELLKNALGPDKRLAVVGGGYVGLEAAASARALGSHAMVIERESRVLARVACETLSHFFQDYHGKHGVAFELNAGVAAFEGHDGHVTGVRFNDGRVVACDVALVGVGAVPNDELAKDAGLSTANGVVVDLEARTDDPSIFAIGDVTHRPLPLYDRQFRLESVPNALEQAKQAASAILGRPGPAPETPWFWSDQYDLKLQIAGLPFDADRQVVRGDVAAAKFAVFHLKGDLVQAVEAVNAPPEFMAGKQLIAKRTPVDANKLADPSVSMKEVAA

SEQ ID NO: 15606 - protein, 694 aa, Oryza sativa (japonica cultivar-group)
MSEGEEEEGRQVQEVVAHVYDVASSGSSEGGGGGTAILHVNRFFKDAIGLGGIFHTAIQVYGDEEWSFGYCENGTGVFSCPPCKNPMYTYPWVNRFANAGDAALEVAENTAEKLKQAKKDIAGACKAATTYLTGASSSSPSNADDSGGSTNSSLFEGTWLRSIIGISMKPSRSLMCSDSSDSSDDEKSEDERESDCQQPSVSVVGRRSPGPVGEKQKQVAAFISSLIRKKKKKRRRASHLAQTKQRDRTGRGGKGRRSSTSWGAALSGSLVSIMAGLAATATGLVTAGAPAQDAVMDYLLPATVPLLLLGADLRRVVSTTGDLLKAFLIGSVATTIGTTIAFLLVPMKSLGQDSWKIAAALMGSYIGGAVNYVAISEALGVSPSVLAAGVAADNIISALYFMTLFSLAAKIPAEPKTAQGTQLGIQGCTLPCVTALVVALATAFPRLLGKLAPSGETIALILMQVFFTVVGANGNLVDAVTKAPSVFAFALVQVTIHLGIVLAAGKLMGFERKPLLIASNANVGGPTTAAAMATAKGWSSLIVPGILVGMFGISIATFVGIGGTEGTGGGGSWQWQGASVDEAGGVEEVGRKAELGEEEVLVGGVFDAASDEVEVEVEEASEADGAGGDGRRVRQQLAVLHWVEHQVVVINSLALAMAAPSWRVVMGEGFLDVLRTALLLRHWRSVLGAGPHHK

SEQ ID NO: 15607 - protein, 655 aa, Glycine max
  misc_feature (246)..(246): Xaa can be any naturally occurring amino acid
ATAVTLCLVLPERGSIDALDGGMIEMVLDPDLNKTGDIWHICIEDLPRSNVLYGYRIDGPRDWGKGHRFDSSIVLVDPYAKLVEVSSLGPDPPMKLSKFLGTYDFDSLPFDWGENYKLPNISEKDLVIYEMNVRAFTSDESSGLDSNIRGSYLGMIEKIPHLLELGINAVELLPVFEFDELEFQRRPNPRDHMINTWGYSTINFFAPMSRYASAGGGSVNASREFKQMVKSLHSAGIEVILDVVYXNHTNEADDAFPYTTSFRGIDNKVYYMLDNNGQLLNFSGCGNTLNCNHPVVMELILDSLRHWVTEYHVDGFRFDLASVLCRGIDGSPINAPPLIRAIAKDAVLSRCKIIAEPWDCGGLYLVGSFPNWDRWAEWNGKYRDDVRKFIKGDSGVKGSFATRVAGSSDLYRVNNRRPYHSINFVIAHDGFTLRDLVSYNFKHNKANGEGGKDGSNDNFSWNCGFEGETDDASIRALRSRQMKNFHLALMISQGTPMMLMGDEYGHTRYGNNNSYGHDTAINNFLWDQLDARKSDHFRFFSKVIKYRHAHEVFSRENFLNTNDITWHEDNWENPDSKFLAFTLHDRSGGDIYVAFNSHDYFVKVLLPTPPKKRNWFRVADTNLKSPDDFVLDGVPSVGNTYNIAPYSSILLEAKF

SEQ ID NO: 15608 - protein, 259 aa, Oryza sativa (japonica cultivar-group)
MEVMVHSSTFLLPKLHQPANSPAKKYALVVLNQNLPRFVPRLWTHAKLRICADGGANRIFDEMFQMTNDPDYESTRKRYIPEIIEGDMDSIRPEVKQFYSSQGSKISDKSHNQETTDLHKCISRIHRCTPDHEKTNLCVLVTGALGGRFDHEAANINILYLFSDMRIVLLSDDCLIRLLPKTHKHEIYIESSVEGPHCGLFPVGAPSGSTTTTGLKWNLSEAKMRFGSMISTSNIVHAEKVTVQSDADLLWTISLRNLT

SEQ ID NO: 15609 - protein, 264 aa, Oryza sativa (japonica cultivar-group)
MAMATTSSKNERWSLAGATALVTGGSKGIGRAIVEELASLGATVHTCARTEAPLNRCREELTAKGLAVTVSVCDVSLRADREALAGTVRELFGGKLSILVNCAGMSFLKPAVELTPDDCSQVMGMNFESCFHLSQLAYPLLKASQRGCIINISSIASVVAFCSLPNAVYSAAKGAMNQVTRNLAAEWANDGIRVNCVAPGFIRTPLLSEFVEGNELGRAEFSRVPMGRLGEPEDIASLVAFLSMPASSYITGQVICADGGRCLS

SEQ ID NO: 15610 - protein, 520 aa, Magnetospirillum magnetotacticum MS-1
MSNASPRRPRPVVLCILDGWGWREDSADNAITQADTPNWDRFLASYPHSLLQSSGLQVGLPDGQMGNSEVGHMNLGAGRVVMQDLPRIDTAVADGSLAANPELTKAIAAVKARGGAMHLMGLLSPGGVHSHQDHLAALARTIADAGVTVQVHAFLDGRDTPPSSAKGFMERFLAAVKGHDVHLATVSGRYYAMDRDKRWDRVSLAWNAMVEAKGVAGADPLAAIAASYADSKTDEFMLPAVIGSYAGMKDGDGLLMGNFRADRAREILDCLVNPAFDGFARARQVSFAARLGLTEYSKDLNAFLGTLFGPETLDNILGEVLSRAGLKQLRIAETEKYAHVTFFFNGGREMVFPGEERILVPSPKVATYDLQPEMSAAEVTDKLIAAIEGGTFDVIVVNYANGDMVGHTGFMKAAIAAAQTVDACLGRLETAVKTAGGTMLVTADHGNAEQMKDPVTGEPHTAHTTGPVPAVLVAPPAGIDGIGDGRLADVAPTLLALLGLPQPAEMGGQSLLRQSLRAAG

SEQ ID NO: 15611 - protein, 160 aa, Alnus firma
MNTLEGRGFTEEQEAVVVKSWNAMKPNAGELGLKFFLKIFEIAPSAQKLFSFLRDSNVSLERNPKLKSHAMSVFLMTCESAVQLRKAGKVTVRESSLKKLGAVHFKHGVVDEHYEVTKFALLETIKEAVPEMWSPEMKIAWGEAYDQLVAAIKSAMKPSS

SEQ ID NO: 15612 - protein, 813 aa, Aspergillus nidulans FGSC A4
MAIPRPSTPPEAPLEVTEISERSQSSRWLSRDDRIRILTLRDAGFTYQQISSQLGFTYRQVQYTCQNEQSTPRKPPGQRPKLSEEDMDNIITFISSSQRTRRLSYKRVIEELNLPCGETALARALKKRGYSRCKALRKPPLSDDTKRVRLAWALEHVNWTIEQWNRILWSDETWVTPGFHTRIWVTRRAGEELDETCIRLSTPKKRGWMFWGSFYGDTKGPCLFWEKEWGSINVESYCERIVPIIDGYLRLNRQQGNYLCLMHDGAPGHASKDTIAELHERSIYPISWPAFSPDLNPIEMVWNWMKDWIQERYPDDRQLSYDALREINPKESYPYSPVLPSDFLWGFATASYQIEGAVDEDGRGPSIWDTFCKKPGKIAGGANGDVACDSYHRTHEDIDLLKQCQAKAYRFSISWSRVIPLGGRNDPINEKGLQFYVKFVDDLLAAGITPLVTLFHWDLPEELDKRYGGLLNKEEFVADYANYARIIFNALSPKVKYWITFNEPWCSSVLGYNVGQFAPGRTSDRSKNPEGDGSTEPWIVGHNILVAHGTAVKIYREEFKARDGGEIGITLNGDWAEPWDPENPADVEAAPRKIEFAISWFADPIYFGRYPESMIKQLGNRLPEWTPEEVALVKGSNDFYGMNHYCANFIRAKTSEPDPTDVAGNLELLLQNKAGEWVGPETQSPWLRPSPTGFRKLLKWLSDRYNRPKIYVTENGTSLKGENDLPLEQLLKDDFRVKYFEDYIHAMAEAYTYDNVNVRAYMAWSLMDNFEWAEGYETRFGVTYVDYENNQKRYPKASAKAMSEIFAKYIQNE

SEQ ID NO: 15613 - protein, 265 aa, Glycine max
MAIPYPHFIATEKAAMDAGLLHPSSPSSVILTQDDLKKIAAYKAVEYVESGMVLGLGTGSTAKHAVDRIGELLRQGKLKDIVGIPTSTKTHDQALSLGIPLSDLDSHPTVDLAIDGADEVDPFLNLVKGRGGSLLREKMVEGACKKFIVIVDESKLVNYLGGSGLAMPVEVIQFCWRFTAARLQKLFQEAGCVAKLRTFAEKDEPYVTDNGNFIVDLYFERSIGDLKAASDAILQLAGVVEHGMFLDMATTVIVAGELGLTVKNK

SEQ ID NO: 15614 - protein, 396 aa, Staphylococcus epidermidis ATCC 12228
MAKKIVSDLDLKGKVVLERADFNVPIKDGEITNDNRIVQALPTIEYIIEQGGKLVLFSHLGKVKEESDKEGLSLKPVAENLSKKLGKEVIFVPETRGEKLETAIENLNEGDVLLVENTRFEDLDGKKESKNDPELGKYWASLGDVFVNDAFGTAHREHASNVGISTHLETAAGYLMEKEIKFIGGVVNDPQKPVVAILGGAKVSDKINVIKNLVNIADKILIGGGMAYTFIKAQGKEIGLSLLEEDKIDFAKDLLENNGDQIVLPVDCKIAKEFSNDAKITEVSINEIPSDQEAMDIGPKTVELFNKELQGAHTVVWNGPMGVFEFSNFAKGTIGVCESIAKLEDATTIIGGGDSAAAAISLGFEDDFTHISTGGGASLEYLEGKELPGIKAINDK

SEQ ID NO: 15615 - protein, 301 aa, Aspergillus flavus
  misc_feature (1)..(1): Xaa can be any naturally occurring amino acid
XAVKAARYGKDNVRVYKVHKDEKTGVQTVYEMTVCVLLEGEIETSYTKADNSVIVATDSIKNTIYITAKQNPVTPPELFGSILGTHFIEKYNHIHAAHVNIVCHRWTRMDIDGKPHPHSFIRDSEEKRNVQVDVVEGKGIDIKSSLSGLTVLKSTNSQFWGFLRDEYTTLKETWDRILSTDVDATWQWKNFSGLQEVRSHVPKFDATWATAREVTLKTFAEDNSASVQATMYKMAEQILARQQLIETVEYSLPNKHYFEIDLSWHKGLQNTGKNAEVFAPQSDPNGLIKCTVGRSSLKSKL

SEQ ID NO: 15616 - protein, 253 aa, Staphylococcus epidermidis ATCC 12228
MRTPIIAGNWKMNKTVQEAKDFVNELPTLPDPKEVESVICAPTIQLDALVTAVKDGKAKGLKIGAQNAYFEESGAYTGETSPVALSELGVKYVVIGHSERRDYFHETDEEVNKKAHAIFNHGMTPIICVGESDEEREAGKANKIVGNQVKKAVEGLSDDQLKEVVIAYEPIWAIGTGKSSTSEDANEMCAHVRQTLADLSSQEVADATRIQYGGSVKPNNIKEYMAQSDIDGALVGGASLKVEDFVQLLEGAK

SEQ ID NO: 15617 - protein, 505 aa, Staphylococcus epidermidis ATCC 12228
MAKQPTALIILDGFANRESEHGNAVKQAHKPNFDRYYEKYPTTQIEASGLDVGLPEGQMGNSEVGHMNIGAGRIVYQSLTRINKSIEDGEFFDNTVLNNAVKHVKDNGSALHVFGLLSDGGVHSHYKHLFAILELAKKQGIDKVYVHAFLDGRDVDQKSALKYIEETEDKFKELGVGQFASVSGRYYAMDRDKRWDREERAYNAIRNFEGPTFTSAKAGVEANYKNDVTDEFVEPFIVEGQNDGVNDGDAVIFYNFRPDRAAQLSEIFTNKAFDGFKVEQVDNLFYATFTKYNDNVDAEIVFEKVDLNNTIGEVAQDNGLKQLRIAETEKYPHVTYFMSGGRNEEFEGERRRLIDSPKVATYDLKPEMSAYEVKDALLEELDKGDLDLILLNFANPDMVGHSGMLEPTIKAIEAVDECLGEVVDKIIDMGGHAIITADHGNSDQVLTDDDQPMTTHTTNPVPVIVTKEGVTLRETGRLGDLAPTLLDLLNVKQPSEMTGESLIKH

SEQ ID NO: 15618 - protein, 424 aa, Arabidopsis thaliana
MKSKEIDFSSKDIINNLPEPNLLCHILSFLPLRDSALTSLLSKKWRDLFAFRPNLDFDGLVNGHHREDSNRMFIDFLNRVLDRGELPSKVFMSESLVSLRIESQNVTAIDVEDVFLPKLKTLYLDTISIGKAGIGSDNVYFDFTNRSVSSKTFKRLKLCCIDYDQNPDTVSFDTPNLVYLEYSDYVAVKYPRVKFCSLVEASLNLQMTYDQCAQASYGFLVGNATDFLMGVSNVQILHLSDKSLEVLTFCCETIPVFNRLIHLTIKTHRHGEVGWESLPALLKNCPNLETLVFQGLHHKDTIKCEEVVGCLCKYFEDIPTCLSSSPVKVVKVLKFGETFFNYDDMKKQLEQDKHFLETMPNLEQMILYYNTPYDNDVLEVSKQLQILPRVASTKCKIQVISDNLSLSFSFSTSGLTFFNSTFPV

SEQ ID NO: 15619 - protein, 434 aa, Staphylococcus epidermidis ATCC 12228
MPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFEGIKSFYNLDK

SEQ ID NO: 15620 - protein, 386 aa, Salmonella enterica subsp. enterica serovar Typhi str. CT18
MRNNPLIPKSKLPNLGTTIFTQMSALAQKHQAINLSQGFPDFDGPSYLHERLAYHVAQGANQYAPMTGAQALREAIADKTAEIYGYRPDDVSDITVTAGATEALYAAITALVRAGDEVICFDPSYDSYAPAVALSGGVLKRIALTPPHFRVDWQAFSALLSERTRLVILNTPHNPTATVWRQADIEALWQAIGEREIYVLSDEVYEHICFAAEGHASVLAHPQLRERAVAVSSFGKTFHMTGWKIGYCVAPAAISAEIRKVHQYLTFCVNTPAQLALADMLRAAPEHYRALPDFYRKKRDVLVNALAQSRLKVLPCEGTYFLLIDYSAVSTLNDVEFCQWLTEEVGVAAIPLSVFCAAPFPHQLIRLCFAKQESTLLAAAERLCKL

SEQ ID NO: 15621 - protein, 590 aa, Coprinopsis cinerea okayama7#130
MAIPEASTDGTQNEGESPDNSDKPAHIVNQFQNKLSLAKSNGMDGPRPNGNPINQDPNANFPLPPPDSLMTGTKQPGLTRAALEKLAAVQLDSAVSTSSSSDQNHTNGKPSSHKSSPMKLSISPATAVENPSGFPSPTPASPTDSYWDASAPPSRAPSRPGSRAPSMSAGFSGGKILGWTAPTASRERRGSKPETPAPARKPASVHSDKGEGHKFNLKDLLGGGTKLNRKSSQRSTSSRRSDSDAGDGRAKSTGGESAVSLTQKYGVCQKVAIGKGATSVVRLAHKWDRSEEKLYAIKEFRKRRKNESEKEYVKKLTSEFCISSTLHHPNVVETVDLIQDENLHWCEVMEFCPGGDLYAAIKRGGMSPSEVECCFKQLLNGVKYLHGQGVAHRDLKPENLFFDAKGYLKIGDYGASTVYRLPWETTVHMSSGLCGSEPYIAPEHSEPDLILLLSTSALLSSSPNMRVAAYDARLVDIWACGIVYYCLHFQELPWRAAQPATDQLYAAYAKACASSSDSSECPATIQNLSPKQCRPLIRKMLEPLPSRRYTIEDVISHPWVQSIEVCHEVSEPKHVHVSAREMGSVYADKT

SEQ ID NO: 15622 - protein, 85 aa, Cyanidioschyzon merolae strain 10D
MCASEIQVGDQVRFGLLITEGEKQRVQYSQGIVIARTSKTVTIRSLLSGVGVERILYLDSPLLAELKVVQHNRVRRAKLYYLRRQ

SEQ ID NO: 15623 - protein, 425 aa, Thermotoga maritima MSB8
MRYVIVGSGPAGLNAIEAIREVDKEGEILLITAEKYVGYSRPLITYLLGRKVTEEKMYYRTEDYLREMRVDIKPATRVEKVIPEEKTVVTDSGEEIRYDKLLIATGGKPFVPNIEGLTGKKGVFTFTTWEDEEKVEKYIEENDVKEAVVLGGGLIGLKTTEALMELGVKVTIVELADRILSVTFDRKASEIITEALKKEGCSVITNDTVVKVNGDDTVSSVVLKSGKEIPTKLLVIAIGVKPNVEFLKDSGIEINRGIVVNEKMETNVEGVYAAGDCTEFYDLIDGQRKTIAIWPVAVAQGRVAGYNMAGKNVRYPGGIPMNSVELAGIPTISVGHSNVEDGGYEILTFEEGNTYKKMVLKDNRLVGAILVNDIDRAGIYTGLILQKLDVSSFKDRLLDENFGLVYLPKEFRKKMLEGEIKIWLE

SEQ ID NO: 15624 - protein, 251 aa, Glycine max
MQAVSLSPLSFRDSSDEFAGKFEHDFMAKLKINEEKVENENEEKHNEDEIEEEEEEEEEEEEEEFSFVLTNSDGSPISADDAFDNGQIRPIFPIFNQDLLFSDDYDGGEGLRQPIKVFVEHKDEFLSEAAPAEGAYCEWNPKAAVKSNSTGFSKLWRFRDVKLRSNSDGKDAFVFLNHAAPAKPAEKARSVVVKKGKTTTTTAAASAHEKHYIMSRARKESDKRKSYLPYKQNMLGFFANANGLSRNVHPY

SEQ ID NO: 15625 - protein, 899 aa, Ostreococcus tauri
MTTIEEAVEIALEWSRSVFASTSSRRESIVAVDERCIGRVLAKDVKAHVPHPPFAASVMDGYAVNARETIEQTEEQNIEFTVLASEVSRAGPVSTGRLKRAMKALECAYVTTGAALPRGCDCVIPSEQCDVHSNGTVVFVERAALVAGKWTRVSGSDVAGQGETLVRRGEQLTVFDIGVLKYAVDEIAIFNRPRVRILSTGDELVASVRDVHDKFGCIIDTNSPMLGAMCMDSGSEVICRDVTQDDLERTTTFFRSALADEGCDALITSGGASVGDRDFIEAVITSLGGEIHFRRLAMKPGKPTTFATLSRSDGLPPLLVFALPGNPVSAAVTFSLVVAPCIQVLSGSISEPKLRRIHCVLNETLTLDPERPEYHRAVLEWNGATHPSLPIAHSTGRQISSRLLSMRGADVLVELPKGPGVVEKGAIASALVLSDFRRANFHMEKIATPKRDVGHAPFATFTTRNDARVYVLGANGRVLDLKRSVGLEENVRSSCRRSGSSNDVADVLSAPLSMYSNNEIHVAVTDDLPSQALFESIEKTAKRLRIAMSNTSITHRTFARVGLAGNPSDAYGGKVVAASISNFCAEAILTPMVASKRVSFVLGPYDANDYDSFDDMASHVSSHGVDGGVRLLKALCENVKRYCVETKQMIDFSCGFELSYASTIPEQLGLSGSSGIIIAALRCLMQHYGVKMSIDEQASIALRVEHDVGINAGPMDRVQQVYGGCMFMDFSCPKECDSSTLIVHGEYTRLNADLLPPMYLVWRGESASHSGKVHSGLKERWTNRHTNEDSEVAVSMGRLASLAEEIFELFKKGKKIDVNELADRMNENFQLRRTLMGDKVISEANLRMVRMCQEVGGGGAKLAGSGGSCVAVCKNEATAQALRRACTESGYAYEQLKFV

SEQ ID NO: 15626 - protein, 308 aa, Photobacterium sp. SKA34
MRQLTTLLDQWLNSFNKVMDETIASGIPFTVPTVREGLAAITRELVTDIPNIALIENLTIKDKVPIRIYHPQPETALPVLVFFHGGGHMSGNVEVYDPICRKLAQYSQFIVVSVEYPLAPEHPYPAAIEDGYLVLQSLFQTLIRAEISFIPQLSIAGDSAGGAICATLARIAQFDDDVEIAKQVLIYPSLDYTLSFPSVNQNGIGYLLQQPRIEWYFSNYFQHNEDRRKASPVWGPYSMALPESLVITAEFCPLKDEGIAYVEALKKQGVESEHIHFEQMIHAFLNMENIVKKECEQTYTTIGVFLNK

SEQ ID NO: 15627 - protein, 256 aa, Oryza sativa (japonica cultivar-group)
MAMETMATTTTKRMSVAEVSLVEAVLFDIDGTMCVSDPFHHRAFSELLQALGYNSGVPITPEFGMAHMAGRSNHQIGSFLFPDWPQHRLDAFFADKEALFARYAAEGLREVAGLTDLCRWAAARGLKRAAVTNAPRANADLMISILGLSDFFQVIVAAADDCDLPKPSPEPYLRALSLLGASPRHTLVFEDSVVGVQAGVAAGMPVIAVAEEAREAKVVAAGASLVIRDYKDHKLWAALDKLQAAAAAQSNGQLGA

SEQ ID NO: 15628 - protein, 405 aa, Methanosarcina barkeri str. Fusaro
MKAIILAAGEGLRCRPLTLTRSKVMLPIANRPILEHVIGSLEKNGITDIILIVGYKKERIMDYFEDGLNFGVKIKYVEQKAQLGTAHAIEQAKKWIEPEDSEFLVLNGDNLVEPKTIADLLNNYEGDASLLTVQMEETAGYGVVLKEKKRVTRILEKRPGDLSRIVNTGIYIFTPQVFETIEKTPISENGEYAITDTLQLMIDEGKIVTSVSTKSKWIDAVHSWDLLKANAIVLNSARNLKLEGEVEEGVFLSGKVAVGKNTRIRSGTYIVGPVVIGENCDIGPNVVILPSTTIGDNVSIRSFTEIQNSIIMNDCRIYSHGRISNSIIGSNNTIGSGFFVEEKEGLSIIMNGTIHRAPRLGTIFGDDNRIGNSVLVKAGVTIAVDCQVESGNTIYRDLSRHSVVL

SEQ ID NO: 15629 - protein, 1366 aa, Ipomoea batatas
MRILSWNCRGIANSRVRRFVKDLLSTTKADALCLLEIRSSKAEKMIALASRLGLTNHFIVNPLGFAGGLLLLWKPALNLSVISHNSQAIHTLASHRLGNCFITFAYIRPNTFAKCRFWEYCKQLANSIQSPWMVVGDLNDIATSDEQWGSSSLNYTSLQNFVDAYSDCGLLDPGSSGPNFTWCRFIGNRVVQRRRLDRVLWNVSAQLTFPEAKVSVLPRLCSDHNPILFLDEAGNPPVRSLRPVRFEAAWLTSEDYKHIWKEATEREGSNLEDIIATVTQKSLLWNRNVFGNIFNRKRKIENRILGIQRAWNYNTSVRLQDLEKRLLSELNEVLVQEETLWFQKARTDWIRNGDRNTTFYHRSALIKRNRNRVRFLKLQGAWTDDADLLTEHIINFFSTLFCRVDRDSQPPRQGLPMDFQIPRDQASTLLRRASLEEVKKAVFGMKKYGSPGPDGIPAVFYQQFWGEVGPAMTDMVNHAFENGSTYISQLQAFMTLIPKKDTPETAADFRPITLLNASFKVISKVLVNRLRPIMSNIIGPHQNSFLPGRSTMDNVILTQEVVHSMNNPRRKKKQMILKVDLQKAYDSVSWDYLEETLEDFGFPRRLIDLILFSLQESSLAILWNGGRLPPFKPGRGLRQGDPLAPYLFNLVMERLAHDIQTRVNARTWKPVHITRGGTGISHLFFADDLMLFGEASEHQAQIMFDCLDSFSNASGLKVNFSKSLLFCSSNVNAGLKRAIGSILQVPVAESLGTYLGIPMLKERVSRNTFNAVIDKMRTKLSSWKASSLNMAGRRVLVQASLATVPTYTMQVMALPVSTCNEIDKTCRNFLWGHDTNTRKLHSVNWAEICKPRNEGGLGLRMARDFNRAFLTKMAWQIFSNIDKLWVKVLREKYVKNADFLHLQSQSNCSWGWRSIMKGKDVLAGAIKWNVGNGRKINFWNDWWVGDGPLASNTDCINQPHMTDIKVEDLITSQRRWDTGALHNILPTNMIDMVRATPIAINSEQEDFLSWPHSTTGMVTVSSAYSLIAGHDGDDRSHDWIWRATCTEKIKLFMWKIVKNGLMVNVERKRRGLADAASCPVCGEEDETLDHLFRRCLLAEACWDSAVPPLTFQTSNHLHMHSWMKAACSSQQKDGYSTNWSLIFPYILWNLWKARNRLVFDNNITAPSDILNRSFMESSEARCLLAKRTGLQTAFQTWVVWSPPAAGFTKLNSDGACKSHSHLASAGGLLRNENGLWVAGYTCNIGTANSFLAELWGLREGLLLAKNRGFTKLIAETDSEAVVQVLRKDGPVTPDASILVKDCKLLLDHFQEIKVTHILREGNQCADFLANLGQSSSWGTTILERPPDDLRIFLQRDAIGLASSRRR

SEQ ID NO: 15630 - protein, 436 aa, Thermoplasma acidophilum
MCVLMPHFLYLRSLISGRRYINKDHRYPCRRLGFMGIYDIFDDESARSISGMSIDEMAKKYGTPVIIYSRARIVSNIRRIREAYENRVRMLYSVKANDNPRIIEIMHQESIGSDSASPMEIMMSIFSGIPPEDILYSPNNASEYDLNFALDRGIAINFNTFTQYRKMREKPERISFRINPGFGMGEFAGTTTGGARTKFGIDPDAAILAYRKAREDGIREFGIHMMIGSNNRDHVKIAEAYSNFFRIADRIGREAGVSFQFADVGGGLGIPYVQGENELDIAALGSAVLKEFDRYHFGDLVLEPGRYLVGDAGIIVGTVNDVHNGFAGTDIGMNLNIRPALYGARHTIIPVGERVEGEKITVTGQICENTDRIGDTAWRLSEGDRIMVLDAGAYVYSMSSRYNGRPRPPEIMIMEDGKDVMIRRREDFSDFIATVV

SEQ ID NO: 15631 - protein, 261 aa, Oryza sativa
  misc_feature (57)..(57): Xaa can be any naturally occurring amino acid
  misc_feature (140)..(140): Xaa can be any naturally occurring amino acid
TSSSPHRNSTEHIASKKRRRRRSEGDKETARHAVHPGVQPWHPAPAPAPAPPGASRXGMAVGCAAEAAVAAAGVAGTRCGAHDGEVPMEVARHHEHAEPGSGRCCSAVVQHVAAPAAAVWSVVRRFDQPQAYKRFVRSCXRLLAGDGGVGTLREVRVVSGLPAASSRERLEILDDESHVLSFRVVGGEHRLKNYLSVTTVHPSPSAPTAATVVVESYVVDVPPGNTPEDTRVFVDTIVKCNLQSLAKTAEKLAAGARAAGS

SEQ ID NO: 15632 - protein, 412 aa, Salmonella enterica subsp. enterica serovar Typhi str. CT18
MKALTYHGPHHVKVENVPDPGIEQPDDIILRVTATAICGSDLHLYRGKIPQVKHGDIFGHEFMGEVVETGHDVKNIRKGDRVVIPFVIACGDCFFCRLQQYSACENTNDGHGAAMNKKQIPPPAALFGYSHLYGGVPGGQAEYVRVPKGNVGPFKVPPLLSDDKALFLSDILPTAWQAAKNAQIQQRSSVAVFGAGPVGLLTIACARLLGAEQIFVVDHHAWRLRFAEERYGAIPINFDDENDPAEKIIEQTAGHRGVDAVIDAVGFEAKGSMTETVLTNLKLEGSSGKALRQCIAAVGRGGVVSVPGVYAGFIHGFLFGDAFDKGLTFKMGQTHVHAWLGELLPLIEKGLLKPEEIVTHYMPFEEAARGYEIFEKREEECRKVILVPGAMSAQAAQKQATGVINPMPGGVV

SEQ ID NO: 15633 - protein, 766 aa, Caulobacter crescentus CB15
MGNADMSDAERKTFTDAEALAFHRYPTPGKIAIVPTKPMATQRDLSLAYSPGVAVPVHAIAADPDMAYEYTSKGNLVAVISNGTAILGLGDLGALASKPVMEGKSVLFKRFGDVDSIDIEVTTKDPDEIITVVKNIGVTFGGINLEDIKSPECFRIETELQELLDIPVFHDDQHGTAIICAAGLINACHITGKKIEDVKVVLNGPGAAGIASLELIKAMGVRAENCIAVDSKGVLYRGRTEGMNQWKSAHAVETDKRTLAEAVVGADVLLGLSAKGAFTPEMIASMAPNPVIFAMANPDPEITPEEVKRVRKDAIMGTGRSDYPNQVNNVLGFPYIFRGALDVRARRVNHEMKIACAQALAMLAREDVPDEVAAAYHGRQLKFGPDYIIPSAFDPRLIWYVPPFVAQAAMDTGVARKPIADMDAYRAGLAQRLDPTAGFLQKISGSVLANPKRIVFAEGEDPSVIRAAYAYQSGGFGKAILCGRENLVHENMKLVGLDPDTAGLEIINARLSDRNPDYVDALYARLQRQGYLKRDVQRLINQDRNSFAASMVTLGEADGMVTGVTRSFDQALEEVLRVVDPAPGGRIMGMSVVLAKGRTIFVADTNVTELPEAEELVEIACEAARAVRRLGFKPRVAFMSYSTFGNPMGLRSEKVREAVAMLDEMEVDFEYEGEMPPELALDPEKRANYPFMRLTDSANILIMPAIHAASISTKLVQSLGGATVIGPVLLGLSKSVQIAPLSASVSKILNMAMMAAYDQPVDDGEG

SEQ ID NO: 15634 - protein, 248 aa, Streptomyces avermitilis MA-4680
MSDANANGNGVNPEKDLGASNLPGQRGEGGEEIRLQRGMFGANNGGDTSGYGGLVRSIRLPGPAARPYGGWFDEVADELEGALEEQGLVPGNAIEKTVVDRDELTFHIEREYLLRVAQTLRDDPALRFELCTGVSAVHYLEDKGRELHAVYHLRSITHNRLIRLEVSAPDADPHIPSLVSVYPTNDWHERETYDFFGLIFDGHPALTRIMMPDDWQGFPQRKDYPLGGIPVEYKGAQIPAPDQRRSYS

SEQ ID NO: 15635 - protein, 110 aa, Saccharophagus degradans 2-40
MDIIETIKKQIEENSIILYMKGSPNAPQCGFSAKASQAVMACGQRFAYVDILSNPDIRANLPKYANWPTFPQLWVNGELVGGCDIIVQMHESGELKPIIDAAAPKEEASE

SEQ ID NO: 15636 - protein, 201 aa, Brassica napus
LLRSHKLVQVSLFQKPIVKIKLNDLMAATNEFSSGNIDVSSRTGVSYKADLPDGSALAVKRLSACGVGEKQFKSEMSKLGELRHPNLVPLLGYCVVEDERLLVYKHMPNGTLFSQLHSGGLCDAGLDWPTRLMIGVGAARGLAWLHHGCQPPYLHQFISSNVILLDDDFDARITDYGLAKLVGTRDSNDSSFNNGDLGELG

SEQ ID NO: 15637 - protein, 452 aa, Medicago sativa subsp. falcata
MKEVAPGTQDQKQPLRANSKRALSDVTYLPHKKRAILQDVTNNCGENTKRSCLNPTEIQAKKRKVAKPAQPNVSNEVPSAAELPPFIADSKPVSSMEMRLRSSEDFRCLDDLEDNAPFRMSSNQCGTNNNLLQSQTSRISARPSSSQKKASQIVAAKKANISELLDVSKHPDVADIDADFEDPQLCSHYAADIYDHLRVAELSRRPYPNFMETVQQDITPSMRAILVDWLVEVSEGYKLQANTLYLAVYLIDWFLSKNCIEKERLQLLGITCMLIASKYEEINAPRIEDFCFITDNTYTKEEVVKLESLVLKSSSYQLFAPTTKTFLRRFLRAAQASYKRPSIELEYLTNYLAELTLLNYGFLNFLPSMIAASAVFLARWTLDQSSHPWNPTLEHYASYKASDLKATVLALQDLQLNSNDDCPLTAIRKKYTQDKLNCVAALSSPKLLETLF

SEQ ID NO: 15638 - protein, 443 aa, Streptomyces avermitilis MA-4680
MSTSHASAASARETTEGTVYTVTGGDWDEVVQSAAKSDDERIVVNMGPQHPSTHGVLRLILEIDGETVTEARCGIGYLHTGIEKNLEYRTWTQGTTFVTRMDYLTPFFNETAYCLAVEKLLGIENEIPDRASIIRVLLMELNRMSSHLVCIATGGMELGATTIMIYGFRDRELILDIYELITGLRMNHAYIRPGGLAQDLPPGAVDQIREFVKKMKKNLPEYDKLATGNPIFKARMQDVGYLDLAGCMALGATGPILRSAGLPHDLRKSQPYCGYETYDFDVPTADTCDSYGRFLIRLEEMRQSLRIVEQCLDRLAPGPVMVADKKIAWPAQLALGPDGLGNSLDHIKKIMGTSMEALIHHFKLVTEGFRVPPGQTYSAVESPKGELGVHAVSDGGTRPYRVHFRDPSFTNLQAMAAMCEGGQVADVIVAVASIDPVMGGVDR

SEQ ID NO: 15639 - protein, 90 aa, Zea mays
MPEYMYMYIIKREEEEVFEDQLRGIVCYRDEDGEMVCEGYDEGPRLGMRLPEKASFPWPVGVRITDFIQLATLQVFDDDVDVLQLTGDQN

SEQ ID NO: 15640 - protein, 1135 aa, Silicibacter sp. TM1040
MTRDMRLRDRIDAGTYLDQANMRDALVALAALSEADRSAICASATQLVKDIRGHSSPGLMEVFLAEYGLSTDEGVALMCLAEALLRVPDADTIDALIEDKIAPSDWGKHMGKSTSSLVNASTWALMLTGKVLDEEKSPVGALRGAIKRLGEPVIRTAVGRAMKEMGRQFVLGETIESAMKRASNMEAKGYTYSYDMLGEAARTEADASRYHLAYSRAISAIASACTSTDIRENPGISVKLSALHPRYEIAKEESVMQQLVPRLKALALLAKAAKMGLNIDAEEADRLSLSLEVIEEVISDPALKGWDGFGVVVQAYGPRTGLAIDALYEMAEKYDRRFMVRLVKGAYWDTEIKRAQVEGMDGFPVFTSKALTDVSYIANARKLLSRTDRIYPQFATHNAHTVSAILHMAEEGQAYEFQRLHGMGETLHQMVMDQNKTRCRIYAPVGAHRDLLAYLVRRLLENGANSSFVNQIVDEDVPPQVVAADPFQEVDDLTTDIPTGPNLFQPERINSKGFDLRHAPTLAAIEKARAPFREATWDAVPLIAGEAQPEARVAVTNPSDLSEIGSVSQSSAEDVELALASANTWDAPAEERAAALNKAADLYEAHYGELFALLAREAGKTQMDAVAELREAVDFLRYYASRIPDAAPAGIFTCISPWNFPLAIFTGQVSAALATGNAVLAKPADQTPLVAFRAVELLHEAGVPRDVLQFLPGRGSKVGAAITGDARINGVAFTGSTATAMRIRSAMAEHCAPGTPLIAETGGLNAMIVDSTALPEQAVQAVVESAFQSAGQRCSALRCLYLQEDVAEDVLTMLKGAMELLDLDDPWHLATDSGPVIDEGSRAKILAHIDEARAEGRVLKEMQAPQSGTFVAPTMISINGISDLKEEIFGPVLHVATFKSRELDAVIDAINATGYGLTFGLQTRIDDRVQHVCDRIHAGNIYVNRNQIGAIVGSQPFGGEGLSGTGPKAGGPNYLARFCAPDRRQVDAAWKDTMGEIPAARGQAGHPETTSLPGPTGESNRLTVSARPPLLCAGPGAEAVSEQAKLVASLGGIAIEADGMVDLHRLAHMDGISGVLWWGDADTGREIEQSLAKREGPIVPLIPGAPDRARVLAERHVCVDTTAAGGNAALLGGNA

SEQ ID NO: 15641 - protein, 1898 aa, Ipomoea batatas
MSSAAPAAPVVPPQDVTMTEEASPPRAAKKIRTTKRSFAEAVTDQSSFNTDERPQSDEYDWAFENPVVESDSEMDNQDDSDDRPVVKFSKALRQELCREWRMALIVKYLGKNLTANVLNQRAPSLWQLKGRVQIIDIGFGCFVMRFDDKKDYLHVLLDGPWRIFDNYLITQRWVPDFKPRTAKFQKMAVWVRLSELSMEYFRDDTIKAILENIGKPLGLDRTTMARERGRFARAAVEIDLDKPLVSEIWVMGDVQKVEYEGLHVVCFGCGVVGHREQACPLARPTAPETMATGSNTETAADTAEPQPAEGPADAVTQPAERRRYGPWMIVTRKQQATTNNPPRQQATNKPNQNNRNISQQHQRNTTTVNPTTNRFAALAEQQTTVSRNTRPKGKGKTSGEPAGSSKGKSPTPISQSVPAQQSFNPGSAPLANTSTRPSPSYSSGKRGGRGGSSRGRERASNRGASRGQPSTGAPAGHVGQIGGNSVFQFGSTPFIASCSSDGTGSPTNPAPSTSVTPGGGRWPNPPFRGCFLMRILSWNCRGIANSRVRRFVKDLLSTTKADALCLLEIRSSKAEKMIALASRLGLTNHFIVNPLGFAGGLLLLWKPALNLSVISHNSQAIHTLASHRLGNCFITFAYIRPNTFAKCGFWEYCKQLANSIQSPWMVVGDLNDIATSDEQWGSSSLNYTSLQNFVDAYSDCGLLDPGSSGPNFTWCRFIGNRVVQRRRLDRVLWNVSAQLTFPEAKVSVLPRLCSDHNPILFLDEAGNPPDRSLRPVRFEAAWLTSEDYKHIWKEATEREGSNLEDIIATATQKSLLWNRNVFGNIFNRKRKIENRILGIQRAWNYNTSVRLQDLEKRLLSELNEVLVQEETLWFQKARTDWIRNGDRNTTFYHRSALIKRNRNRVRFLKLQGAWTDDADLLTEHIINFFSTLFCRVDRDSQPPRQGLPMDFQIPRDQASTLLRRASLEEVKKAVFGMKKYGSPGPDGIPAVFYQQFWGEVGPAMTDMVNHAFENGSTYISQLQAFMTLIPKKDTPETAADFRPITLPNVSFKVISKVLVNRLRPIMSNIIGPHQNSFLPGRSTMDNVILTQEVVHSMNNPRRKKKQMILKVDLQKAYDSVSWDYLEETLEDFGFPRRLIDLILFSLQESSLAILWNGGRPPPFKPGRGLRQGDPLVPYLFNLVMERLAHDIQTRVNARTWKPVHITRGGTGISHLFFADDLMLFGEASEHQAQIMFDCLDSFSDASGLKVNFSKSLLFCSSNVNAGLKRAIGSILQVPVAESLGTYLGIPMLKERVSRNTFNAVIDKMRTKLSSWKASSLNMAGRRVLVQASLATVPTYTMQVMALPVSTCNEIDKTCRNFLWGHDTNTRKLHSVNWAEICKPRNEGGLGLRMARDFNRAFLTKMAWQIFSNIDKLWVKVLREKYVKNADFLHLQSQSNCSWGWRSIMKGKDVLAGAIKWNVGNGRKINFWNDWWVGDGPLASNTDCINQPHMTDIKVEDLTTSQRRWDTGALHNILPINMIDMVRATPIAINSEQEDFPSWPHSTTGMVTVSSAYSLIAGHDGDGRSHDWIWRATCTEKIKLFMWKIVKNGLMVNVERKRRGLADAASCPVCGEEDETLDHLFRRCLLAEACWDSAVPPLTFQTSNHLHMHSWMKAACSSQQKDGYGTNWSLIFPYILWNLWKARNRLVFDNNITAPSDILNRSFMESSEARCLLAKRTGLQTAFQTWVVWSPPAAGFTKLNSDGACKSHSHLASAGGLLRNENGLWVAGYTCNIGTANSFLAELWGLREGLLLAKNRGFTKLIAETDSEAVVQVLRKDGPVTPDASILVKDCKLLLDHFQEIKVTHILREGNQCADFLANLGQSSSWGTTILERPPDDLRIFLQRDAIGLASSRRR

SEQ ID NO: 15642 - protein, 388 aa, Saccharophagus degradans 2-40
MSVSALMNTYGERKTTLTKGDGPYLWDSEGRRYLDALSGIAVCGLGYNYPSVTQAISEQAKTLIHCSNLFLIEPQQELGKLLVQASGMDKVFFSNSGAEANEAAIKLARKYAQDKGITAPHIITCDKSFHGRTMATLSATGNPKVKAGFFPMVEGFSHVPYNDIEAIKQAATENTIAIMVEPIQGEGGVNVPADDYLTNLRALCDENGWLLILDEIQTGNGRTGAYFAYQHTNIHPDVVTTAKGLGNGVPIGACLAKGKAAEVFQPGNHGSTFGGNPLACSAAVATFKALVNDGIMKSGAATGNSMIAKFKERFANNPKVVEVKGQGMMMGIQLSQDCPTLVERAKEKNLLLNVTAGNTIRLLPPLILTEEQAQTVVDTVVQLVEEIE

SEQ ID NO: 15643 - protein, 1366 aa, Ipomoea batatas
MRILSWNCRGIANSRVRRFVKDLLSTTKADALCLLEIRSSKAEKMIALASRLGLTNHFIVNPLGFAGGLLLLWKPALNLSVISHNSQAIHTLASHRLGNCFITFAYIRPNTFAKCRFWEYCKQLANSIQSPWMVVGDLNDIATSDEQWGSSSLNYTSLQNFVDAYSDCGLLDPGSSGPNFTWCRFIGNRVVQRRRLDRVLWNVSAQLTFPEAKVSVLPRLCSDHNPILFLDEAGNPPVRSLRPVRFEAAWLTSEDYKHIWKEATEREGSNLEDIIATVTQKSLLWNRNVFGNIFNRKRKIENRILGIQRAWNYNTSVRLQDLEKRLLSELNEVLVQEETLWFQKARTDWIRNGDRNTTFYHRSALIKRNRNRVRFLKLQGAWTDDADLLTEHIINFFSTLFCRVDRDSQPPRQGLPMDFQIPRDQASTLLRRASLEEVKKAVFGMKKYGSPGPDGIPAVFYQQFWGEVGPAMTDMVNHAFENGSTYISQLQAFMTLIPKKDTPETAADFRPITLLNVSFKVISKVLVNRLRPIMSNIIGPHQNSFLPGRSTMDNVILTQEVVHSMNNPRRKKKQMILKVDLQKAYDSVSWDYLEETLEDFGFPRRLIDLILFSLQESSLAILWNGGRLPPFKPGRGLRQGDPLAPYLFNLVMERLAHDIQTRVNARTWKPVHITRGGTGISHLFFADDLMLFGEASEHQAQIMFDCLDSFSNASGLKVNFSKSLLFCSSNVNAGLKRAIGSILQVPVAESLGTYLGIPMLKERVSRNTFNAVIDKMRTKLSSWKASSLNMAGRRVLVQASLATVPTYTMQVMALPVSTCNEIDKTCRNFLWGHDTNTRKLHSVNWAEICKPRNEGGLGLRMARDFNRAFLTKMAWQIFSNIDKLWVKVLREKYVKNADFLHLQSQSNCSWGWRSIMKGKDVLAGAIKWNVGNGRKINFWNDWWVGDGPLASNTDCINQPHMTDIKVEDLITSQRRWDTGALHNILPTNMIDMVRATPIAINSEQEDFLSWPHSTTGMVTVSSAYSLIAGHDGDDRSHDWIWRATCTEKIKLFMWKIVKNGLMVNVERKRRGLADAASCPVCGEEDETLDHLFRRCLLAEACWDSAVPPLTFQTSNHLHMHSWMKAACSSQQKDGYGTNWSLIFPYILWNLWKARNRLVFDNNITAPSDILNRSFMESSEARCLLAKRTGLQTAFQTWVVWSPPAAGFTKLNSDGACKSHSHLASAGGLLRNENGLWVAGYICNIGTANSFLAELWGLREGLLLAKNRGFTKLIAETDSEAVVQVLRKDGPVTPDASILVKDCKLLLDHFQEIKVTHILREGNQCADFLANLGQSSSWGTTILERPPDDLRIFLQRDAIGLASSRRR

SEQ ID NO: 15644 - protein, 425 aa, Triticum aestivum
  misc_feature (215)..(215): Xaa can be any naturally occurring amino acid
  misc_feature (232)..(232): Xaa can be any naturally occurring amino acid
NKFVQKSIPLPVRNSRDIVDPRVRPARAPAMDRLISSPLHLTRAPASSSAASRPRAGGHHHLLPAAAAPRSFAPLHGLGLHPLAPLLPRPPLPLLAAASAFSRADAVNPAPPEQDDEAADASAQAPPNGFTRFFQKVASAAAVALVAALVVAAVGSSSMVPPALASALHGHSHTAVVTAGRSIFKSELLGSAWTGFLAGCLHTLSGPDHLAALAXPLSIGRSPVESAAVGAXLWGCGHDAGQVMFGLLFLGLKDRLHIEVLRTWGTRVVGLTLLVIGAIGIREATQAAPCVAAALEGGTSAHQHGGNNSNALEKALLGAGGKKKEISFATFATGIVHGLQPDALMIILPALAMPSRAAGGAFLGMFLVGTVLSMASYTVLIGTCTEALKERVPRITEKLTWAASLVAISMGVAIIVSESFGVSLY

SEQ ID NO: 15645 - protein, 200 aa, Streptomyces avermitilis MA-4680
MAEEPKETGPGFQNPVAGFGVTFKAMFKKRLTEQYPEQQKTTAPRFHGRHQLNRHPDGLEKCVGCELCAWACPADAIYVEGADNTDEERYSPGERYGRVYQINYARCILCGLCIEACPTRALTMTNEFELADSSRANLIYTKEQLLAGLDDNMVDSPHAIYPGMDEQDYYRGLVTEAAPGTERQVAVSKGEKPQDEGVEA

SEQ ID NO: 15646 - protein, 98 aa, Phanerochaete chrysosporium
  misc_feature (15)..(15): Xaa can be any naturally occurring amino acid
PNPILSTPGIFSQLXVETLFYVFYFHPGTYQQYLAAKELKRQSWRFHVKYLTWFQRHSEPQAITEEYEQGVYVYFDWEGSWCQRKKSDFRFEYRYLSE

SEQ ID NO: 15647 - protein, 295 aa, Oryza sativa (japonica cultivar-group)
MAGKEIYHKMKDKVKDAFSSSGPETGKGKTKLSGKRVKHGYHLVKGKSNHPMEDYLVAEYRQEGEHDLGLFAIFDGHLGHTVPDFLRSHLFDNILKQPEFLSNPQAAIRNAYQLTDAKILESAAELGRGGSTAVTAILISSENSVNLVVANVGDSRAVISKSGVAKQLSVDHEPNKERHSIEKKGGFVSNLPGDVPRVDGQLAVARAFGDRSLKKHLSSEPDVVEEPIDENTDFLILASDGLWKIIHIQVMSNQEAVDEIKDFKDAQAAAKHLTEQAVNRKSKDDISCIVVKFLC

SEQ ID NO: 15648 - protein, 419 aa, Lactococcus lactis subsp. lactis Il1403
MKTPFVTKEQLEQITKEFPTPFHLYDEKGIRQKARDLHKAFAWNKGFKEFFAVKATPTPAILKILHEEGCGVDCASYVELLLSEKCGFDGSEMMFSSNDTPAEEFQFANQLGATINLDAYEDIEFLKNLTDFIFPETMSLRYNPGGVFAMGTKIMDNPEESKFGMTKAQLIQGIKDLQKLGVKKFGMHSFLASNTVTNDYYPELANKLFKLALEIREETGITLDFINLSGGIGVNYRPDEEANDIAKIGQGVHEAYDEVLRANGIENLKIYTELGRFMLAPHGHLITKVLHIKETYRKYVGVDASAVNLMRPAFYDAYHHITVAGKEKDEATEIYDITGSLCENNDKFAKERAFPKIEIGDLLVIHDTGAHGFSMGYQYNAKLRSSEVLLQEDGKTRLIRRAEKPADYFATLDGFDFTI

SEQ ID NO: 15649 - protein, 624 aa, Arabidopsis thaliana
MDDMNLIQQAQRHQLVVSNLGEEIDLEIGPGEDDAAFANNSLIGGPPREPSTGEHDETKHMVLVSDLPSEDQDISKGTPAKRKKKVVKRWREEWADTYKWAYVDMKDGTARIFCSICREYGRKHRRNPYGNEGSRNMQMSALEEHNNSLLHKEALRLQTASKDKIVVDKPIYVKTVMSKSAGSIVEGALKRDPNEIEFVQSVQESVHALERVIAKNSHYVNIMERLLEPERMIVFRVPWIDDRGETHVNRGFRVQFNQALGPCRGGIRFHPSMNLSIAKFLGFQQTLKNALSPYKLGGASGGSDFDPKGKSDNEIMRFCQSFMNEMYRYMGPDKDLPSEEVGVGTREMGYLFGQYRRLAGQFQGSFTGPRIYWAASSLRTEASGYGVVYFARLILADMNKEIKGLRCVVSGCGKIAMHVVEKLIACGAHPVTVSDSKGYLVDDDGFDYMKLAFLRDIKSQQRSLRDYSKTYARAKYFDELKPWNERCDVAFPCASQNEVDQADAINLVNAGCRLLVEGSNMPCTAEAVDVFRKANVLIAPAIAAGAGGVAAGEIEVLRESNSMQWSAEDFESRLQEALKQTYEKALKAANDFGYQKESPEALLHGATIAAFLNIAQAMTDQGCV

SEQ ID NO: 15650 - protein, 155 aa, Zea mays
  misc_feature (76)..(76): Xaa can be any naturally occurring amino acid
GNKPHDLASLKGKLDPEAKENLGMALGYPLGSLTQEGLSEIMGKIVLMKDLKKPNPKKEVLFHKGNPVPAKTFLPXKNHLELKLPFHLLNLFPNPLLTSSKEKNLPDRKIFKVERLPWKGPTPVPDENNNKEEDIDSINNFENNKKAFLDLNLLH

SEQ ID NO: 15651 - protein, 344 aa, Oenococcus oeni PSU-1
MEKAKAENFDWPNLGFNYYDLPYSFHAEYKDGKWDEGKLTSDSTIKMSEAANVLHYGQEAFEGLKAYRRKDGGVNLFRPDMNAKRLHNSAERLLMAPFPEDRFVEAVKMVVKANQNFVPPYGSGATLYIRPFIIGTGEVIGVHPADKFQFHILVTPVGPYYKGGMKPTEYVTSPYDRAAHGGTGQSKVSGNYAASLLPGSLAHKNGYSDVVYLDPRLHENIEELGGANFFGITKDGKFKTPKSPSILPSITKKSLLQIADSFGMEPEETTISIYDLDQFSEAGAMGTAAVISPVGSITHNGNKHVFYSETEVGSYTQKLYDRLSGIQDGDQKGPDGWQVDVPLK

SEQ ID NO: 15652 - protein, 183 aa, Oryza sativa
MSSMESSCLPATTESIAKAQEAKDASESISILYRVLQDPSSSAEALRTKELAITNLTNYLTKENRAEELRNLLTQLRPFFSLIPKAKTAKIVRGIIDAVAKIIGTSELQISLCKEMVEWTHAEKRTFLRQRVEARLAALLLENQEYTDALTLLTDLIKEVRRLDDKLLLVDIDLLESKLHFSL

SEQ ID NO: 15653 - protein, 378 aa, Nostoc punctiforme PCC 73102
MMVCEYKPGLEGIPAAQSSISYVDGQKGILEYRGIRIEELAEKSTFLETAYLLIWGELPSKEELEGFEHEVRYHRRIKYRIRDMMKCFPESGHPMDALQASAAALGLFYSLRDLHNPAYIRDSVVRLIATIPTMVAAFQLMRKGNDPVRPRDDLDYSSNFLYMLDEKEPDPLMARIFDICLILQVEHTMNASTFSARVTASTLTDPYAVVASAVGTLGGPLHGGANEEVIQMLEKIGSVENVRPYIEHCLETKSKIMGFGHRVYKVKDPRAIILQGLAEKLFEKFGYDKFYDIAQEMERVVGEKLGSKGIYPNIDFYSGLVYRKMGIPTDLFTPIFAIARVAGWLAHWKEQLAENRIFRPTQVYNGLHEVTYTPIDQR

SEQ ID NO: 15654 - protein, 150 aa, Pseudomonas aeruginosa
MALQRTFSIIKPDAVSKNVIGEILTRFEKAGLRVVASKMVQLSEREAGGFYAEHKERPFFKDLVSFMTSGPVVVQVMEGEDAILRNRELMGATDPKKADAGTIRADFAVSIDENAVHGSDSEASAAREIAYFFSSTEVCEALPDSANERG

SEQ ID NO: 15655 - protein, 185 aa, Brassica napus
MAKSSGETKFTLKLVVDEENNKVVFAEACRDFVDVLFSLLTLPMGTIVRLLENHRKSETVPIGCFSNLYKSVVDMGTDDFETEACKQMLLYPRSLWDVHCRRLKLNLHPTDGIKLFVCSTFTICKMCSYFSTSRCGCGMLMNVEIPCNGITVDKNIQDGVFVKGRSSFIITDDLKVGVRSTDLVL

SEQ ID NO: 15656 - protein, 547 aa, Kineococcus radiotolerans SRS30216
MVTPDAPETQVETTPDTRPAEVEAERAHRPVLVVDYGAQYAQLIARRVREADTYSEIVPSSTPVAEILAKDPAAVILSGGPSSVYAEGAPQVDPALFEAGVPVLGICYGFQAMAKALGGEVARTGQREYGGTAAALPNAAESTLLRDQPAEQPVWMSHGDSVSRAPEGFRVTASTDGTPVAAFEDDERRLYGVQWHPEVKHSTHGQDVLVNFLRHGAGIDPDWTTGNVIEEQVARIKAQIGDGKVICALSGGVDSAVAGALVQRAVGDQLTCVFVDHGLLRAGEAEQVEKDFVAATGVKLHVVDAVQRFADALDGVSDPEQKRKIIGREFIRVFEQAARDVVAKEGTDGGEVRFLVQGTLYPDVVESGGGTGAATIKSHHNVGGLPDDLAFELVEPLRALFKDEVRAVGVQLGLPEAMVYRQPFPGPGLAIRIVGAVTPERLEILRAADAIARAELTAAGLDRDIWQCPVVLLADVRSVGVQGDGRTYGHPVVLRPVSSEDAMTADWTRLPYDVLARISTRITNEVPEVNRVVLDVTSKPPGTIEWE

SEQ ID NO: 15657 - protein, 331 aa, Debaryomyces hansenii CBS767
MDLFKRTSALLPILANSHLASNISTESYTDVFHSLQNLSQGDTSVSQLNILEKLWASWYIYMNNDILATGILFFATHELMYFGRCLPWLIIDRISFFNKWKIQDEKIPSDKEQWECFKSVLKLHLLVEALPIWLFHPLCATLNISIDVPFPSYLVMFLQICLFFVCEDFWHYWAHRLFHYGWLYKYIHKQHHRYAAPFGLTAEYAHPVEVMSLGFGTVGFPIIYAYITKCKPSLDLPSLHLFTLSFWITLRLFQAVDSHSGYDFPWSLHNVLPFWAGADHHDDHHHYFIGNYASSFRWIDYFMSTESGEIAKANREKRMRRRAEIQAKKSQ

SEQ ID NO: 15658 - protein, 340 aa, Triticum aestivum
  misc_feature (202)..(202): Xaa can be any naturally occurring amino acid
AYLGDSLEQVCTKKQAGTGPEFPGYRRPTRPAPFAAASSSSSTSARRYRRFGVVAMASAGQKVYAPGVAVSEGNGGLPKISLKSPHGSEAEIYLFGACVTSWKVPNGKDLLFVRPDAVFNGQKPISGGIPHCFPQFGPGPMQQHGFARNVNWSITDSEVTEGDPTVTLELKDDSYSRSMWDFSFQALYKVVLHSTSLSTTLXKIINTDDKPFSFTSALHTYFSASIAGVSVKGLKGSKTLNKDPDPKNPLEGKEERDEVTFPGFVDCVYLGAPSELTLDNGLGDKIVISNTNWSDAVLWNPHLQMEACYKDFVCVENAKIETVQLGPKESWVAEQKIELI

SEQ ID NO: 15659 - protein, 376 aa, Symbiodinium sp. CS-156
MGDEEVAALVVDNGSGMCKAGFAGDDAPRAVFPSIVGRPKMPGIMVGMDQKDSYVGDEAQSKRGVLTLKYPIEHGIVTNWDDMEKIWHHTFYNELRVAPEEHPVLLTEAPLNPKANRERMTQIMFETFNVPAMYVAIQAVLSLYASGRTTGIVMDSGDGVSHTVPIYEGYALPHAILRLDLAGRDLTEYMMKILTERGYSFTTTAEREIVRDVKEKLCYIALDFDSEMKAASESSDKEKTYELPDGNIITVGSERFRCPEVLFQPSFVGKEASGIHDTTFQSIMKCDVDIRKDLYANVVLSGGTTMFQGIGERMTKELTALAPSTMKIKVVAPPERKYSVWIGGSILSSLSTFQQMWISKGEYDESGPTIVHRKCF

SEQ ID NO: 15660 - protein, 340 aa, Lactococcus lactis subsp. lactis Il1403
MAINLDWENLGFSYRNLPFRYIARFKDGKWSAGELTGDNQLHISESSPALHYGQQGFEGLKAYRTKDGSIQLFRPDQNAARLQNTARRLCMAEVPTEMFIDAVKQVVKANEDFVPPYGTGATLYLRPLLIGVGDVIGVKPADEYIFTVFAMPVGSYFKGGLAPSKFVISRDYDRAAPLGTGGAKVGGNYAASLQAEVGAKASGYADAIYLDPSTHTKIEEVGAANFFGITADNEFITPLSPSILPSITKYSLLYLAEHRLGLKAIEGEVYAKDLGKFVEAGACGTAAIISPIGRIDDGEDSYIFHSETEVGPTVKRLYDELVGIQFGDVEAPEGWIVKVD

SEQ ID NO: 15661 - protein, 466 aa, Lactococcus lactis subsp. lactis Il1403
MLYGKENRDEAEFLEPIFGSESEQVDLPKYKLAQQSIEPRVAYQLVQDEMLDEGNARLNLATFCQTYMEPEAVKLMSQTLEKNAIDKSEYPRTTEIENRCVNMIADLWNASEKEKFMGTSTIGSSEACMLGGMAMKFSWRKRAEKLGLDINAKKPNLVISSGYQVCWEKFCIYWDIEMREVPMDKEHMSINLDKVMDYVDEYTIGVVGIMGITYTGRYDDIKALDNLIEEYNKQTDYKVYIHVDAASGGLYAPFVEPELEWDFRLKNVISINTSGHKYGLVYPGVGWVLWRDKKYLPEELIFKVSYLGGELPTMAINFSHSASQLIGQYYNFVRYGFDGYKAIHERTHKVAMFLAKEIEKTGMFEIMNDGSQLPIVCYKLKEDSNRGWNLYDLADRLLMKGWQVPAYPLPKNLENEIIQRLVIRADFGMNMAFNYVQDMQEAIEALNKAHILYHEEPENKTYGFTH

SEQ ID NO: 15662 - protein, 808 aa, Sulfitobacter sp. EE-36
MKQKLVVIGAGMASGRVLEHLLEQDRDAYDITLFNAEARGNYNRIMLSPVLSGEKTYADIVTHDAGWYAENDITCRFGEKVLEIDRAAKTVTGENGTVSYDKLVLGTGSNPFMIPLPGHDLEGVIAYRDLEDTERMMGLGEGSKCVVIGGGLLGLEAAAGMAARGVDVTVVHIMGHLMERQLDEAAGYLLRRALTDKGITVKCAANSKEILGENGKVRALLLDDGTELPCDLLVMAVGIRPNVALGQGAGLAVGKGIHVDDQMVTSDADVLAVGECVEHNGALFGLVAPLYDQAKVAAQTLLGQSSTFVPKELSTKLKVTGCDLFSAGDFADGEGREDIVFRDPARGVYRRLVIKNNVVIGAVMYGDTADSNWFFGLIRDKTDIADMRDTLIFGPAYQGGTPLDPLAAVAALPRDAEICGCNGICKGQIEDAIAAGVSDLGAIKATTKASASCGTCTGLVEQVLAVTLGDDFVLPAAASICGCTDMTHEDVRRMIKSQRLTSMPAVWQECGWKTPDGCHVCRPALNFYLLADWPLEYRDDPQSRFINERKHANIQKDGTYSVVPRMWGGITTPDELRAIADAADKYMVPTVKVTGGQRIDLLGVKSEDLPDIWADLNAAGMVSGHAYSKGLRTVKTCVGTDHCRFGTQDSTGLGIQLEKELWGAWTPHKLKLGVSGCPRNCAEATCKDIGVICVDSGYQISIGGAAGMDVRETELLIQVPTEQEAINVIKAVTQLYRENAKYLDRIYKWMAKVGLDWIKERVAAEGDALVDRFELSQTIYRKDPWAEHVTQQAERYKPLATLSLEAAE

SEQ ID NO: 15663 - protein, 487 aa, Brucella melitensis 16M
MLALKDPSLLKSQCLVNGRWIDAADGTTIKVTNPADGSVIGTVPSLSVATIKEAIDASAKALSGWAAKTAKERAGILRKWFDLIIANADDIALIMTSEQGKPLAEARGEVLYAASFIEWFAEEAKRVYGDTIPAPQNGQRLTVIRQPVGVTAAITPWNFPAAMITRKAAPALAAGCTMIVRPADLTPLTALALGILAEKAGIPAGVLQIVTGKAREIGAELTSNDTVRKLSFTGSTEVGRLLMAQCAPTIKRISLELGGNAPFIVFDDADLDAAVDGAMVSKYRNAGQTCVCANRIYVQRGVYDKFAEKLAAKVKELKVGNGTEPGVVIGPMIEEKAITKVKAHIEDAVSKGAKLITGGKELGGLFFEPGILTGVTSDMLVAKEETFGPLAPLFAFDTEEEVIAQANDTIFGLAAYFYTENFSRAIRVSEALEYGMVGHNTGLISNEVAPFGGVKQSGLGREGSKYGIEEYLETKYICSAYKRGAKK

SEQ ID NO: 15664 - protein, 429 aa, Zea mays
  misc_feature (111)..(111): Xaa can be any naturally occurring amino acid
MAAAAASSVARRAASRGGQFIARAFASGVGGGGEKAKRVLVPVAAGTEPIEAATTADVLNRAGARVTVATADPPGDDGLLVQAAYGVKLVADGRVADLQGEPFDLIALPGXGMPGSVGLRDCKALEKMVKTHAEDGGLYGAICAAPAVTLAYWGMLKGLKATCYPSFMEKFTAEVIPVDSRVVVDRNAITSQGPGTAVEFALALVEKLYGKEKMEEVAGPLYLRPQHGVEYTIEELNSVEWKCGSTPQVLVPVANGSEEIEAVNLIDVLRRAGANVIVASVEEKLQIVTRRHKFNLIADMMLDEAIKMQFDLIVMPGGLQGAQKFASTKQLVDLLKKQAESNKPYGAICASPAHVLEPHGLLKGKKATAFPPMSHLLTDQSACEHRVVVDGNLITSRAPGTATEFGLAIVEKLFGRDKAVSIAKELIFM

SEQ ID NO: 15665 - protein, 842 aa, Sulfitobacter sp. EE-36
MLAAADGTIKGDPDHPANFGRLCSKGAALGETIDLDGRLLHPQINGVRADWDAALDMVAQRFSDAIAQHGPESVAFYASGQMLIEDYYVANKLMKGFIGAANIDTNSRLCMASSVAGHKRAFGTDTVPGTYEDLEQADLVVLVGSNLAWCHPVLHQRIAAAKQARPHMRIVNVDPRRTATTDLADVHLRIAPDGDVALFNGLLAYLAETGKLDTAYTENHVNGLDAALAAAQASDPADSGLNARELVDFYALWANTPKVVTAYSQGVNQSVCGTDKVNAILNCHLATGRIGNPGMGPFSLTGQPNAMGGREVGGLANMLANHLEIGDEAHRSVVQSFWQSPTICTKPGLKAVDLFEACADGQIKALWVISTNPAVSLPDADGVAAAIANVPFVVTSDIMEKTDTNALADVLLPATGWGEKDGTVTNSERRISRQRAFLPAPGDARPDWKIISDVAKRMGFSGAFSYGSSADVFAEYVALDQAASAFPRDLDLSIFADADYAKMVPTQWPRNGARFFANGQYYHPDGKAQMVAVTSPVSLNSRFTLNTGRNRDQWHTMTRTGKSARLGAHLAEPYVEMNPVDAAALGALPGALIALQNSRGRVLMRALITPRVAQGALFAPMHWTRQRSTAGTVNSVMTPLTDPISGQPALKASAVTAEVFKAKWYGFLASIVEPAPRTTYAAVARTNTGWQAELGGSKSPEDWEAEARLLTGQAEGDLSLQSDVATGGVRIAITQGGRITGLLFVSPNPVVVSRSAIISLIGTDTSALAALAGRNASDRPDPGATVCACFDVGRNTLLAAIAGGASTVAALGDATCAGTNCGSCKPELAALLDQTLQRMAAE

SEQ ID NO: 15666 - protein, 472 aa, Arabidopsis thaliana
MAATLTGSGIALGFSSSAKFSKRASSSSNRRCIKMSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHAKSFLVKAGSGVATLGLPDSPGVPKAATSDTLTAPYNDIAAVEKLFEANKGEIAAIILEPVVGNSGFITPKPEFIEGIRRITKDNGALLILDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 15667 - protein, 258 aa, Triticum aestivum
  misc_feature (207)..(207): Xaa can be any naturally occurring amino acid
  misc_feature (247)..(247): Xaa can be any naturally occurring amino acid
AYLGDTIEQVCTKKQAGTGPEFPGYRRPTRPPTPAPDAGAAAMAVDDSSETDQLDSMSTEDIVRATRLLDNEVRVLKDELQRNNLELENVKDKIKENQEKIKLNKQLPYLVGNIVEILEMNPEDEAEEDGANIDLDSQRKGKCVVLKTSTRQTIFLPVIGLVDPDNLKPGDLVGVNKDSYLILDTLPSEYDSRVKAMEVDEKPTEDXYDIGGPEKEIQELVEAIVLPMTHKEHFQKWGSRPPKGVLXYLDPPGTGEEI

SEQ ID NO: 15668 - protein, 224 aa, Triticum aestivum
  misc_feature (113)..(113): Xaa can be any naturally occurring amino acid
  misc_feature (187)..(187): Xaa can be any naturally occurring amino acid
MAMDDVAVDAGSSSSAMDALADSSSSSSAAPADPSHGWQKVTYAKRSRRKPGGVVPAAAPGPEGGFKPGVFDGLEKRSRERQRTIQAVRNAKSGYYDDDDEARQCRRSTLRFXSSEEGSDSDGASAKDSAQAEAPSKPKKPKVNKDTVTVGDSDVFIDTESLVGYIVEISDWYKNKEGIEIMSIWDXFGRVFANVTPNQPPVAVLSKESPNAQDGWRVPWSPCP

SEQ ID NO: 15669 - protein, 249 aa, Frankia sp. CcI3
MHLGHEEFQRTDGRASTGPADAGPAGAGRAPRIGVGGPVGSGKTALVAALCRALSSSLRIGVVTNDIYTTEDADFLRRAGVLDPERIRAVETGCCPHTAIRDDITANLDMVEDLEADTGPLDLVLVESGGDNLTATFSYGLIDRQIFVVDVAGGDKVPRKGGPGVTGSDLLVINKTDLAPLVGADLDVMARDATAARGARPVVFTSLTADPTAADVTAWVRAQLAELSPRGGSYDASDASNASQPLNRM

SEQ ID NO: 15670 - protein, 448 aa, Ustilago maydis 521
MYVSTPIVHVMTSTAGSVAGRNAVSFAVLARTHQHPYNALPSSSRRAFSTSPFHLKPAVQAKDRPGSPGLKHPDGSYLLFHPIYSEHELDSVKVVHRESKTFGDKVARAMCTAARTVFDMATRYPDHNGKKFPPLKRDVEKTVGLPSHLAKQVERLKEQTKDASVNAVAGSATAAAATTTSQSSTTSPTPTATKVVNQTGADLQELTSNDGAMTLQEMRAKGLSFGPDGWLNRMIFLESIAGVPGMVAATCRHLQSLRLMRRDKGWIHTMLEDAENERMHLLVALHLSGKPGLIARTFVLLAQGVFYNFFFIFYLLSPRVAHRFVGVLEEEAVLTYSLILEDLKEGRLPEWEDVPAPEIAKQYWQLGDEAMLVDVIRAIRADEATHRHINHTFASLNSDDPNPFALREPPAKMRAETYGLERDEALEWAKGKDLENGSDAATAAEKTA

SEQ ID NO: 15671 - protein, 441 aa, Frankia sp. CcI3
MAVRGSRGPVPGDGGPPLVGYTLRYLHDPAQHWRQRYDRYGPVSWERTFGLRVVSLLGPDATGLALRNHEQAFANGPGQQRIAGPFFRRGLSMLDFDEHRHHRRILAGAFAPDRLRGYLAGMNPSIERGVAGWRPGARFQVYPAVKQLTLELATRIFMGERLGPEADRFNAALFACIRAPGAVVRVPAPGLRWSRGLAGRRYLEEFLRLRVPAKRAGSGTDMFSRLCHAEAEDGSRLSDDDVVNHMILMMVAAHDTSTITMTSMSYYLARHPEWQQRCREESLALGTPAVDHADLDRLPSLALVMKEALRLVTPVPILLRATVKDIDVLGVTVPAGTVAALALAFTHQMPEYWPSPERFDPERFADHRREDKVHPYAWQPFGGGPHTCIGLHFAGQQVKAILHQMLLRYRWSLAPGYRISLDRFPLPVPRDGLPVQLEKIT

SEQ ID NO: 15672 - protein, 477 aa, Corynebacterium glutamicum
MAFETPEEIVKFIKFIKVEFVDVRFTDLPGTEQHFSIPAASFDADTIEEGLAFDGSSIRGFTRIDESDMNLLPDLGTATLDPFRKAKTLNVKFFFHDPFTREAFSRDPRNVARKAEQYLASTGIADTCNFGAEAEFYLFDSVRYSTEMNSGFYEVDTEEGWWNRGKETNLDGTPNLGAKNRVKGGYFPVAPYDQTVDVRDDMVRNLAASGFALERFHHEVGGGQQEINYRFNTMLHAADDIQTFKYIIKNTARLHGKAATFMPKPLAGDNGSGMHAHQSLWKDGKPLFHDESGYAGLSDIARYYIGGILHHAGAVLAFTNATLNSYHRLVPGFEAPINLVYSQRNRSAAVRIPITGSNPKAKRIEFRAPDPSGNPYLGFAAMMMAGLDGIKNRIEPHAPVDKDLYELPPEEAASIPQAPTSLEASLKALQEDTDYPHRSDVFTEDLIEAYIQYKYDNEISPVRLRPTPQEFELYFDC

SEQ ID NO: 15673 - protein, 319 aa, Kineococcus radiotolerans SRS30216
MPQQDTTPWTPDAMGRQEGRTVLVTGANSGLGLQVATEFARRGADVLLACRNAERGRAAVAELTAAVRDSGVEPTVEVIPLDVADLASVRRAAGDVLHRRSGIDVLVNNAGVMAPPFGRTVDGFETQVGTNHLGHFAFTGLLLPALLTGGGARVVSVASVAHKFGRLNRQNYQSERSYQKWLAYGQSKLSNLLFAFELQRRAAAVGAGIVSTAAHPGLSDTNLWKNTPLAPGRVGAPLGTALSRAVGQPPAQGAWPLLRAATDPAVVGGEYFGPGGRKEWRGFPVQVQANAAAYDTADAAWLWARSVEWTGVDFRELHA

SEQ ID NO: 15674 - protein, 357 aa, Chrysanthemum x morifolium
MDDNSLHENRFVRDEDERPKVPYNKFSSEIPVISLKGIDDVEESSGGIKSRRAEICEKIIKACEDWGIFQVVDHGVDTKMLSEMTRLAREFFEMPAEEKLRFDMTGGKKGGFIVSSHLQGEAVQDWREIVTYFSYPIKARDYSRWPDKPKEWRAVTEKYSEDLMGLGCKLLEVLSEAMGLEKEALKDACVDMDQKVVLNYYPKCPQPDLTLGLKRHTDPGTITLLLQDQVGGLQATRDGGKTWITVEPIEGAFVVNLGDHGHYLSNGRFKNADHQAVVNSNTSRLSIATFQNPAPNAIVYPLIVNEGEKSIMEEAITFMDMYKKKMSTDLELARLKKLAKAKQQDLEKAKPIESILA

SEQ ID NO: 15675 - protein, 202 aa, Ustilago maydis 521
MWRRRWSVTELVLFTLLLISTIYHLHSRTLRSHPSPPLNSTCPSSTALFKMATEQTYIMIKPDGVQRGIVGEIIKRFENRGYKIAALKMVHASEEHLEKHYKDLKGKKFFPGLIKYMASGPVVCIVFEGKDAVKTGRVLLGATNPLDSAPGTIRGDFAIDVGRNVCHGSDSVESAKAEIALWFGEQNPTIQYTRAVDSWIYE

SEQ ID NO: 15676 - protein, 470 aa, Photobacterium sp. SKA34
MIQFGTGGWRAFIGEEFTQANVRLVAQGLANIMIKESVTENGFIIGYDRRFLSDKAAIWFAEVLAGNNIKCSFINKFVPTPVVMFKAKQTGATYSACITASHNPADYNGIKVFIEGGRDADEIITQKIEQQIAVLTDADVKLVDFEQAQNDKLVEIINPMNEFVDSIIDFIDMEAIKKANLRVLIDPMFGVAKNALQTVLISARCDVDVINDSENPGFGGLMPSPSAATLYRLKHLVAHEGYDIGIGTDGDADRLGIIDEKGNFIHPNEVLLLLYYYMLEYKGWKGSVVRNIATTHLLDKVAEAYGEKSFEVPVGFKHISSQMEADDSLIGGESSGGLTIRGHIKGKDGVFASSLLVEMISSTGKKLSELLYEIYGRFGYAYTAEGDCTFKAADRERLYNKIYIEKSLPDFNYEIEKVSYADGAKVYFKNGGWAIARFSGTEPLLRLFIEMEDQTQAEAVLAQFKAFLAV

SEQ ID NO: 15677 - protein, 517 aa, Arabidopsis thaliana
MDLFSSLPNELLYHILSFLSTKEAALTSVLSKRWRNLFAFVPYLEFDDSVFLHPEERKREKEGILQSFMDFVDRVLDLHGDSLIKTFSLKCKTGVDSDHVDRWICNVLARGVSDLDLFIDFRDLYSLPHEVGVSRTLVVLRVGSESDLYWWQKFLCLPMLKTLVLDSCWLCIGQFQILLLACPALEELDMTNTRWKDSNVTVSSSILKELTIDLHGCCSVVNLKSLSFDAPSLVYFYYCDSLAEDYPQVNLKNLVEAQINLLLTQAQIEQVRALNNEMLVADDVFPGLGNAWKLITGLRNVQQLYLSPDTLEVLSRCCEGMPVFNNLKVLSIWSDMNRGWQAMPVLLRNCPHLETLIIEGLLHYATDKCGDVCDCISRDYKDHSLTSCPVKKLQIYEFRGTIRELEMIKHFLKIFPCLKEMDIYAHENSHTLFKDPTIFERVGKKKKKKKKKKKKKKKKKKKKKKKIRLNFKPVNKTEQFLKRLADKLCFIPQCLEFLDVDSSLGELALLAMDSRPS

SEQ ID NO: 15678 - protein, 1326 aa, Photorhabdus luminescens subsp. laumondii TTO1
MGSTTMGVKLDEATRDRIKAAAQRIDRTPHWLIKQAIFNYLERLENDEQIAELSSNQDVKEEKIIAEETVTDSAHQPFLDFAEHILPQSVKRSAITAAYRLPETQAIPMLLQQAQLPEDQAQATHKLAYSIAEKLRNQKNSMGRSGLVQGLLQEFSLSSQEGVALMCLAEALLRIPDKATRDALIRDKISNGNWHSHLGQSSSMFVNAATWGLLFTGKLVSTHNEAKLSNSLNRIISKSGEPLVRKGVDMAMRLMGEQFVTGETIAQALASARKLEEKGFRYSYDMLGEAALTEEDAQNYMVSYQQAIHAIGKASNGRGIYEGPGISIKLSALHPRYSRAQYERVMNELYPRLLSLTLQARQYDVGINIDAEEADRLEISLDLLEKLCFEPQLAGWNGIGFVIQAYQKRCPFVIDTVIDLAQRSRRRLMVRLVKGAYWDSEIKRAQIDGLEGYPVYTRKVYTDVSYLACARKLLSVPNLIYPQFATHNAHTLAAVYHMAGQNYYPGQYEFQCLHGMGEPLYEQVVGKIADGKLNRPCRIYAPVGTHETLLAYLVRRLLENGANTSFVNRIADTTLPLDELVADPVTKVKKLAETDGQIGLPHPKIPLPHNLYGKDRANSAGLDLANEHRLASLSSALLSSATEEQYSEPRLGGNYHHQGELPAAKPVINPATPSDIVGYVREATEQEVSHALDVATEAGAIWFATPPSERAAILVRAAELMENQMQPLLGILVREAGKTFNNAIAEVREAVDFLHYYAGQIRHDFANDTHRPLGPVVCISPWNFPLAIFTGQIAAALAAGNSVLAKPAEQTPLIAATAVKILHQAGIPLDALQLLPGQGETIGALLVGDERVRGVMFTGSTQVASLLQRNIAGRLDAQGRPTPLVAETGGLNAMIVDSSALTEQVVMDVVASAFDSAGQRCSALRILCIQDDVAERTMTMLKGAMSECRMGNPERLSTDIGPVIDAEAKAGIDRHIQAMRTKGRTIYQAAQDNVVDNQEWDQGTFVKPTLIELESFDELKQEIFGPVLHVVRFKRHELDKLLDQINNSNYGLTLGVHTRIDETIAQVTAKAKVGNLYVNRNMVGAVVGVQPFGGEGLSGTGPKAGGPLYLYRLLSCRPQNAINQTLERQDAEYPLDANVRSALMAPFDALTEWAANQHNEELNQLVQQYKLLAQGGTTRLLPGPTGERNTYTLLPRGQVLCLADNQQDTLIQLAATLSVGCQLLWQNDELHQQLFRQLPDSVRKSIHLVQDWQSEDTAFEAVIYHGDSDQLRQVCGQVAQRKGIIISVQGFARGETNLLLERLLHERSLSINTAAAGGNASLMTIG

SEQ ID NO: 15679 - protein, 222 aa, Caulobacter crescentus CB15
MLEDLKAKNAAWSKSKTAEDPDFFTRLAKQQSPEYLWIGCSDSRVPANEIVGLDPGELFVHRNVANLAPPQDANYLSVLQFAVDVLKVKHIMVVGHYGCGGVAAAIDGKRRGLVDHWLHPIREVYAEHRPELEAIPEKREMIDRLTELNVARQVRNVAADVFVQDAWARGQSLAVHGWVYSLANGLVNDLNVGIASLEDYERTVAETVVPDRPFWKRGQAEG

SEQ ID NO: 15680 - protein, 342 aa, Photorhabdus luminescens subsp. laumondii TTO1
MKALVLEKAGQISIQDWETPEILGENDVEIKIHSVGICGSDVHYYQYGRIGPFIVEKPMILGHEASGVITAVGKNVTHLKIGDRVCMEPGIPNLQSPQSRAGIYNLDPEVRFWATPPIDGCLRERVIHPAAFTFKLPDNVSFAEGAMVEPLAIGMQAATKAEIKPGDIALVIGAGTIGIVTALAALAGGCSDVIICDVFDEKLEIAKQYPGLHPVNSKVLTEKVNALTEGNGVNILFECSGAKPVIATISEHIAPGGIAVLVGMPIDPAPFDVVSAQAKEITFKTIFRYANMYPRTIRLLSSGKLKVTPLLSATYKFKDSVQAYERAAEGRPTDIKIMLEME

SEQ ID NO: 15681 - protein, 245 aa, Arabidopsis thaliana
IVEDRKMTESSLDLQESGWEELRREARKIEGDLDVKLSSYAKLGARFTQGGYVDTGSPTVGSGRSWKSMEMEIQSLLEKLLDINDSMSRCAASAAPTTSVTQKLARHRDILHEYTQEFRRIKGNINSLREHAELLSSVRDDISEYKASGSMSPGVQVLRERASIHGSISHIDDVIGQAQATRAVLGSQRSLFSDVQGKVKNLGDKFPVIRGLLGSIKRKRSRDTLILSAVIAACTLFLIIYWLSK

SEQ ID NO: 15682 - protein, 375 aa, Pichia pastoris
MPTVAVDKEDLYQLLGRSYTTEEFDELCFEFGIELDEDTTNDCAKGERPQLKIEIPANRYDMLCIEGIAQALNEYLGRSSAPAYSLQPAVPQVTMTIKESTSTIRPYAAAAILRGIKFTQRSYDSFIALQDKLHTNLCRNRTLVAMGTHDLDTLEGPFTYEALPPSEITFIPLNQTKAMDGNQLMEFYEKDKNLGKYLHIIKDSPVFPVILDKNRNVASMPPIINSDRSKITLETTNVFLDITGTDKTKVAIVVNQLVAMFSRYCSTPFSIEPVNVVSEHNKETRVFPDIKPRLMQAEISYINSCLGLNLDVDTIIQLLKKMGLQPKQNESKNDLLDVYIPITRPDVLHQCDIMEDASIAYGYNNLVKTQAQSQA

SEQ ID NO: 15683 - protein, 320 aa, Xanthomonas arboricola pv. pruni
VQQHITFPANIIEPALFEEGKMFDGSSIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGAKYDGGNSGYRPGVKGGYFPVPPTDTLHDLRAEMIKTLEQVGIETEVHHHEVATAGQCEIGTKFSSLVQKADELLTMKYIIKNVAYRNGKTATFMPKPIVGDNGSGMHVHQSLTKGGVNLFSGDGYGGLSQMALWYIGGIFKHARAINAFSNSGTNSYKRLVPGFEAPVMLAYSARNRSASCRIP

SEQ ID NO: 15684 - protein, 516 aa, Arabidopsis thaliana
MALVSLLEISIAFFCFLIFRIFLISKKPHRSFLTNWPLLGMLPGLLTVLPRVYDFITEVLEDGNLNYLFIGPFLGGIDMLFTVDPANIHHIMSSNFANYPKGTEFKKLFDVLGDGIFNADSDLWKDLRKSSQSMMNHPDFQRFSLATSLSKLEKGLVPLLDHVAKEKLVVDLQDVFQRFTFDTTFVLATGYDPGCLSVEMPEIEFARALDDAEEAIFYRHFKPEVVWKMQRLIGVGAELKLKRAHAIFDRVCSKCIASKRDEISQGIDSSSSKDLLMSSINVDTTKYKLLNPSDDRFLRDTILSFMLAGRDTTGSALTWFFWLLCNNQEAMTKIRQEINTNLFPRNKTDDGSVSYDSDSFNPQEVKKLVYLHGAVCEALRLYPPVPFNHKSPAKPDVLPSGHKVKANSRILFCLYSLGRMKSVWGEDAMEFKPERWISESGRSVHEPSYKFLSFNAGPRTCLGKEVAMTQMKTVAVKIIQNYDINVVEGHKIKPAPSVILHMKHGLKVTVSKRCLS

SEQ ID NO: 15685 - protein, 217 aa, Oryza sativa
  misc_feature (109)..(109): Xaa can be any naturally occurring amino acid
  misc_feature (117)..(117): Xaa can be any naturally occurring amino acid
AACHDAQRGRRAAEPNLVVSLGEMLIDFVPDVAGVSLAESGGFLKAPGGAPANVACAISKLGGSSAFVGKFGDDEFGHMLVDILKKNGVNAEGCLYYEHARTVLAFVTXLKASVERXFMFYRNPIAIVLVTVAFLNLFLLSLPSVPFFFFFICIHGPGLFFLFLCARVVYYFLGSFFPGTSSCCPFLFLFFCLCIVVFIILFPFFFLLLVRGGSFVC

SEQ ID NO: 15686 - protein, 398 aa, Cryptococcus neoformans var. neoformans JEC21
MLVLLIVFFNSYYTHCSHHSLYSFHCTPPDPAMKQSPLHRPSRPLLALGIEGSANKLGCGIISHSPSPTGGPTLVMVLSNVRHTYITPPGEGFLPSDTARHHREWVVKVIEEAVRKAGVRMGDLDCIAFTKGPGMGTPLQVGALVARTLSLLHNIPLVGVNHCVGHIEMGRQITSSHNPIVLYVSGGNTQVIAYSQQRYRIFGETLDIAIGNCLDRFARVIGLRNDPSPGYNIEKEAKKGKRLVQLPYGTKGMDVSLAGILHSVEAYTKDKRYRSWDQVNDVEEDIITPYDLCFSLQETTFAMLVEITERAMAHVGAKDVLIVGGVGCNLRLQEMMGIMASERGGRVFATDESFCIDNGIMIAQAGLLAFRMGNTMPLEKTGVTQRYRTDAVHVAWRA

SEQ ID NO: 15687 - protein, 149 aa, Zea mays
  misc_feature (66)..(66): Xaa can be any naturally occurring amino acid
  misc_feature (104)..(104): Xaa can be any naturally occurring amino acid
  misc_feature (119)..(119): Xaa can be any naturally occurring amino acid
RIGLSSQLPGAWASRVLAASVPSGGSIDADRHHRSPLMQLQYSITKLVPDPSGLQNVMLRVARNCXLRNVTLWRSSLSWNNDYGEDLLFLSSSGIFKPPLTIRXDITICFPQFGSHRNXEQHGLPTNRLWTIDTNTPPLTLNPSYYSYR

SEQ ID NO: 15688 - protein, 368 aa, Sulfitobacter sp. EE-36
MANPTLLILAGDGIGPEVMGQVVRIIDWFGDKRDLAFDVDHDLVGGAAYDKHGTPLHDDTMAKALAADAVLLGAVGGPKYDALDFSVKPERGLLRLRKEMDLFSNLRPAQCFDALADFSSLKKDLVAGLDIMIVRELTSGVYFGEPRGIFEEGNERVGINTQRYTESEIDRVARSAFELARRRGNKVCSMEKANVMESGILWREVVQKVHDEDYPDVELSHMYADNGAMQLVRAPKQFDVIVTDNLFGDILSDCAAMLTGSLGMLPSASLGAPNADGRPKALYEPVHGSAPDIAGQGKANPIACILSFAMALRYSFDQGDEAARLEKAVEKVLADGARTADLMGPEGGSPISTSEMGDAILAALDASL

SEQ ID NO: 15689 - protein, 491 aa, Pseudomonas sp.
MKQYRNFVDGKWVESSKTFQDVTPIDGSVVAVVHEADRDLVDAAVKAGHRALEGEWGRTTAAQRVDWLRRIANEMERRQQDFLDAEMADTGKPLSMAATIDIPRGIANFRNFADILATAPVDSHRLDLPDGAYALNYAARKPLGVVGVISPWNLPLLLLTWKVAPALACGNAVVVKPSEDTPGTATLLAEVMEAVGIPPGVFNLVHGFGPNSAGEFISQHPDISAITFTGESKTGSTIMRAAAEGVKPVSFELGGKNAAVIFADCDFEKMLDGMMRALFLNSGQVCLCSERVYVERPIFDRFCVALAERIKALKVDWPHETDTQMGPLISSKHRDKVLSYFELARQEGATFLAGGGVPRFGDERDNGAWVEPTVIAGLSDDARVVREEIFGPICHVTPFDSESEVIRRANDTRYGLAATIWTTNLSRAHRVSELMRVGISWVNTWFLRDLRTPFGGAGLSGIGREGGMHSLNFYSELTNVCVRIDKESPDV

SEQ ID NO: 15690 - protein, 166 aa, Brassica napus
  misc_feature (159)..(159): Xaa can be any naturally occurring amino acid
IFPKKHEIDLPQFKLLLFYSSSPLIRSLFAAGGLISFIPSQPDRFDLVSSDKKVDSLGLIFFYETRHVAFGSLRLASSMASGAIRRFQDRVLGPSRTGIPSTTSEIWLLGVCYKISEAESSEEADAGSVSDAFRQDFSSLILITYRRGFEPIGETTYTXDVGWGCM

SEQ ID NO: 15691 - protein, 315 aa, Cyanidioschyzon merolae strain 10D
MKLISELLAQNERHIQRLIQSRHALLSAAAAHLFQAGGKRIRPTFVLLVSQALGGISQSQQRLAEITEMIHTASLLHDDVVDEASKRRGIDTVNTRFSNRIAVLAGDFLFAQSSWYLANLNNLEVVKFISKLISDLAEGEMRQTSTQFSTQFELWAYLEKSFYKTASLFACSAKATCMLSNDHEDNHHHKNMYLLGQHLGIAFQIMDDVLDISGDISQMGKTLSADFVSGNLTAPILFALTQEAGLVTLLERECCYTQDAYQVRQMVWDTYGIEQAKDLAFEHMQAALACLASLAPSEAKDALYDLANQMISRQR

SEQ ID NO: 15692 - protein, 318 aa, Cyanidioschyzon merolae strain 10D
MWQLKLYRDMVLGRKFEDQCAQMYYRGKMFGFVHLYNGQEAVSTGVIQALAEHDYVCSTYRDHVHALSKGVSPKEVMAELFGKQTGCSKGRGGSMHLFSAPHRFLGGFAFIGEGIPIALGAAFSSLYQHNLWGVPMSVTACFFGDGTSNNGQFYECLNMAVLWKLPMIFVVENNQWAIGMAHHRSTSEVEIYEKAKMFGMPALEVDGMDVLAVHEVAKEAVERARSAKGPTLIEALTYRFRGHSLADPDELRAKQQKAIWMARDPITQLSSWLIEQELVTQEQLDKIHREIDIIISDAVQFALSSEEAKDLYQYVYAS

SEQ ID NO: 15693 - protein, 326 aa, Cyanidioschyzon merolae strain 10D
MLHKLFMYEALREAIDEEMARDKRVFVLGEDVGHYGGSYKVTKQLHTKYGDLRVLDTPIAENSFTGMAIGAAMTGLKPVVEGMNLSFLLLAFNQISNNAGMLHYTSGGNWSIPLVIRGPGGIGKQLSAEHSQRIEAYFQAVPGLKIVACSTPYNAKGLLKAAIRDNNPVLFLEHVLLYNLKQEIPKQEYVLPLDKAQVVREGSDVTIITYSRMLHHVMQAVKQLVAQGMNPEVIDLISLKPIDLETLVTSVSKTHKAIIVEECMQTGGIAAEVMAQIYSHAFDELDAPIRRLSSKDVPTPYNGYLEQACLVQPTQIVEAVKTLMST

SEQ ID NO: 15694 - protein, 142 aa, Pseudomonas sp.
MVSKADNSAKLVEGKAKPMGSFPHVKRAGDFLFVSGTSSRRPDNTFVGAEPDDTGRPRPNIELQTREVISNIRDILQSVGADLGDVVEVCSYLVNMNDFAAYNKVYAEFFDATGPARTTVAVHQLPHPQLVIEIKVVAYKPL

SEQ ID NO: 15695 - protein, 396 aa, Rhodopseudomonas palustris CGA009
MLDATKTQRARGLLTASARSDVPPFMVMDVMAAADRIEAAGGHVIHMEVGQPWAPAPRAALAAAHAALDSSRIDYTSALGIPSLRARIAKHYRETYRCDVDPDRIVVTTGSSGAFILSFLALFEPGDRVAVTVPGYPPYRHILNALGCVPVPIETHSETRHALTGEALLAAHRKAPLKGVLVGSPANPTGTMMTREALTELIAVAESEGIRFISDEIYHGLDYAFPAVTAAELSPNAVVINSFSKYFCMTGWRVGWMVLPESLVRPVERLQQNLAISVPTLSQIAAEAAFDGRAEMEAVKRGYEENRAILIEGLPKAGLTEFLPADGAFYLYADVSAFTSDSYDFTKRMLEEARVAATPGIDFDPVRGKSFVRFSYARSADDMREAVRRITAWLGR

SEQ ID NO: 15696 - protein, 226 aa, Arabidopsis thaliana
  misc_feature (28)..(28): Xaa can be any naturally occurring amino acid
MGYWNSKVVPKFKKLFEKNSAKKAAAAXEATKTFDESKETINKEIEEKKTELQPKVVETYEATSAEVKALVRDPKVAGLKKNSAAVQKYLEELVKIEFPGSKAVSEASSSFGAGYVAGPVTFIFEKVSVFLPEEVKTKEIPVEEVKAEEPAKTEEPAKTEGTSGEKEEIVEETKKGETPETAVVEEKKPEVEEKKEEATPAPAVVETPVKEPETTTTAPVAEPPKP

SEQ ID NO: 15697 - protein, 547 aa, Candida intermedia
MSQDSHSSGAATPVNGSILEKEKEDSPVLQVDAPQKGFKDYIVISIFCFMVAFGGFVFGFDTGTISGFVNMSDFKDRFGQHHADGTPYLSDVRVGLMISIFNVGCAVGGIFLCKVADVWGRRIGLMFSMAVYVVGIIIQISSSTKWYQFFIGRLIAGLAVGTVSVVSPLFISEVSPKQIRGTLVCCFQLCITLGIFLGYCTTYGTKTYTDSRQWRIPLGLCFAWAILLVVGMLNMPESPRYLVEKHRIDEAKRSIARSNKIPEEDPFVYTEVQLIQAGIEREALAGQASWKELITGKPKIFRRVIMGIMLQSLQQLTGDNYFFYYGTTIFQAVGLKDSFQTSIILGIVNFASTFVGIYVIERLGRRLCLLTGSAAMFICFIIYSLIGTQHLYKQGYSNETSNTYKASGNAMIFITCLYIFFFASTWAGGVYCIISESYPLRIRSKAMSIATAANWLWGFLISFFTPFITSAIHFYYGFVFTGCLAFSFFYVYFFVYETKGLSLEEVDEMYASGVLPLKSASWVPPNLEHMAHSAGYAGADKATDEQV

SEQ ID NO: 15698 - protein, 175 aa, Glycine max
MPGGSRNPLVVGRVIGEVIDPFEISIPFRVTYGNREVGNGCELKPSQVANQPRVSVGGDDLRNFYTMVLVDPDAPSPSNPNFREYLHWLVTDIPETTGPNFGNEVVSYESPRPTMGIHRLVFVLFRQQFRQRVYAPGWRQNFNTREFAELYNLGLPVAAVFFNCQRESGSGGRTF

SEQ ID NO: 15699 - protein, 208 aa, Saccharomyces cerevisiae
MFSGFSSFGGGNGFVNMPQTFEEFFRCYPIAMMNDRIRKDDANFGGKIFLPPSALSKLSMLNIRYPMLFKLTANETGRVTHGGVLEFIAEEGRVYLPQWMMETLGIQPGSLLQISSTDVPLGQFVKLEPQSVDFLDISDPKAVLENVLRNFSTLTVDDVIEISYNGKTFKIKILEVKPESSSKSICVIETDLVTDFAPPVGYVEPDYK

SEQ ID NO: 15700 - protein, 794 aa, Streptomyces coelicolor
MAELPTSHLAAAVLTDGNRALVAVIAVVALAALVLAGVLVRQVLAAGEGTDSMKKIAAAVQEGANAYLARQLRTLGVFAVVVFFLLMLLPADDWNQRAGRSIFFLIGAAFSAATGYIGMWLAVRSNVRVAAAAREATPAPGEPEKDLALVSHKATKIAFRTGGVVGMFTVGLGLLGACCVVLVYAADAPKVLEGFGLGAALIAMFMRVGGGIFTKAADVGADLVGKVEQGIPEDDPRNAATIADNVGDNVGDCAGMAADLFESYAVTLVAALILGKVAFGDSGLAFPLLVPAIGVLTAMIGIFAVAPRRSDRSGMSAINRGFFISAVISLVLVAVAVFVYLPGKYADLDGVTDAAIAGKSGDPRILALVAVAIGIVLAALIQQLTGYFTETTRRPVKDIGKSSLTGPATVVLAGISLGLESAVYTALLIGLGVYGAFLLGGTSIMLALFAVALAGTGLLTTVGVIVAMDTFGPVSDNAQGIAEMSGDVEGAGAQVLTDLDAVGNTTKAITKGIAIATAVLAAAALFGSYRDAITTGAADVGEKLSGEGAPMTLMMDISQPNNLVGLIAGAAVVFLFSGLAINAVSRSAGAVVYEVRRQFRERPGIMDYSEKPEYGKVVDICTRDALRELATPGLLAVMAPIFIGFTLGVGALGAFLAGAIGAGTLMAVFLANSGGSWDNAKKLVEDGHHGGKGSEAHAATVIGDTVGDPFKDTAGPAINPLLKVMNLVALLIAPAVIKFSYGADKSVVVRVLIAVVAFAVIAAAVYVSKRRGIAMGDEDDADPEPKSADPAVVS

SEQ ID NO: 15701 - protein, 436 aa, Photobacterium sp. SKA34
MSKTSKSADLFAKAQQKIPGGVNSPVRAFAGVGGTPLFIERADGAYIFDADGNAYIDFVGSWGPMILGHNHAAIRDAVIDAAQQGLSFGAPTAMEITMADLVSKLVPSMEMVRMVSSGTEATMSAIRLARGFTGRDKILKFEGCYHGHADCLLVKAGSGALTLGQPSSPGVPADFAKHTLTATYNNLDSVREAFSAHPEEIACIIVEPVAGNMNCIPPVPGFLEGLRDICDEFGALLILDEVMTGFRVSEGGAQGYYNIKPDLTTLGKIIGGGMPVGAFGGRREVMEFVAPTGPVYQAGTLSGNPVAMAAGHACLSVLTENGNEKRLANTTKRLADGFKTLADKHGVPLAVNQVGAMFGFFFTDQETVTCYENVTKCDVERFKRFFNLMLEKGVYLAPSAYEACFTSLAHTDQVIDATLEAADFAFATLAHENSPE

SEQ ID NO: 15702 - protein, 304 aa, Brucella melitensis 16M
MGADPVYGLPGFGDHEGRTPFKRLQVSDIVAIRTPVRITPDRKAFWRKYMSYESPFHLNDAVAIVTGAAAGIGRAIAGTFAKAGASVVVTDLKSEGAEAVAAAIRQAGGKAIGLECNVTDEQHREAVIKAALDQFGKITVLVNNAGGGGPKPFDMPMSDFEWAFKLNLFSLFRLSQLAAPHMQKAGGGAILNISSMAGENTNVRMASYGSSKAAVNHLTRNIAFDVGPMGIRVNAIAPGAIKTDALATVLTPEIERAMLKHTPLGRLGEAQDIANAALFLCSPAAAWISGQVLTVSGGGVQELD

SEQ ID NO: 15703 - protein, 976 aa, Candida albicans SC5314
MTSIYTSDLKNHRRAPPPPNGAAGSGSGSSSGSGSGSGSGSGSGSLTNIVTSSNSLGVTANQTKPIQLNINSSKRQSGWVHVKDDGIFTSFRWNKRFMVINDKTLNFYKQEPYSSDGNSNSNTPDLSFPLYLINNINLKPNSGYSKTSQSFEIVPKNNNKSILISVKTNNDYLDWLDAFTTKCPLVQIGENNSGVSSSHPHLQIQHLTNGSLNGNSSSSPTSGLSSSSVLTGGNSGVSGPINFTHKVHVGFDPASGNFTGLPDTWKSLLQHSKITNEDWKKDPVAVIKVLEFYSDINGGNSAAGTPIGSPMINSKTNNNNNDPNNYSSAKNNVQEANLQEWVKPPAKSTVSQFKPSRAAPKPPTPYHLTQLNGSSHQHTSSSGSLPSSGNNNNNNNSTNNNNTKNVSPLNNLMNKSELIPARRAPPPPTSGTSSDTYSNKNHQDRSGYEQQRQQRTDSSQQQQQQQKQHQYQQKSQQQQQQPLSSHQGGTSHIPKQVPPTLPSSGPPTQAASGKSMPSKIHPDLKIQQGTNNYIKSSGTDANQVDGDAKQFIKPFNLQSKKSQQQLASKQPSPPSSQQQQQKPMTSHGLMGTSHSVTKPLNPVNDPIKPLNLKSSKSKEALNETSGVSKTPSPTDKSNKPTAPASGPAVTKTAKQLKKERERLNDLQIIAKLKTVVNNQDPKPLFRIVEKAGQGASGNVYLAEMIKDNNRKIAIKQMDLDAQPRKELIINEILVMKDSQHKNIVNFLDSYLIGDNELWVIMEYMQGGSLTEIIENNDFKLNEKQIATICFETLKGLQHLHKKHIIHRDIKSDNVLLDAYGNVKITDFGFCAKLTDQRNKRATMVGTPYWMAPEVVKQKEYDEKVDVWSLGIMTIEMIEGEPPYLNEEPLKALYLIATNGTPKLKKPELLSNSIKKFLSICLCVDVRYRASTDELLEHSFIQHKSGKIEELAPLLEWKKQQQKHQQHKQETSDTGFA

SEQ ID NO: 15704 - protein, 306 aa, Hordeum vulgare subsp. spontaneum
MATAGEVIKCKAAVAWEAGKPLSMEEVEVAPPQAMEVRDKILYTALCHTDVYFWEANGQTPVFPRILGHEAGGIVESVGKGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTSNADAMISAFECVHDGWGVAHKEAVFKTHPMNFL

SEQ ID NO: 15705 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLYDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 15706 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVTKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 15707 - protein, 243 aa, Pseudomonas syringae pv. tomato str. DC3000
MTMFSSTLFEGKVALVSGGTSGIGQATAEYLARHGARVVAIGLGADATIIAEGVELDLREVNVTNDDALKGVIQSLDRLDILVPAAGGTLGEKEMEWEAFNQVLSVQLNAVYRLINLAHPLLARQGGSIINIASVFSYFGGGKLVAYSAAKGAIVQITKSLAEAYAPDNIRVNAVAPGWITPPLLAKIDDQPRIDRLLSRTPMRRFGSAEEVAKVIAFLASDAASFVTGVVLPVDGGYLTSAI

SEQ ID NO: 15708 - protein, 876 aa, Oryza sativa (japonica cultivar-group)
MSQTNWEADKMLDVYIYDYFMKRNLQATAKAFQAEGKVSSDPVAIDAPGGFLFEWWSVFWDIFIARTNEKHSDVAASYIETQHMKAREQQQQQQQQPPQQRQQQPQHIQMQQMLLQRAAQQQQQQQQQQQQQQQQQQQQQQQQQQQRRDGTHLLNGTASGLPGNNPLMRQNQSTANVMATKMYEERLKLPSQRDGLDEVSIKQRYGENAGQLLDSNEALLKASASGQSSGQILHGTVGGLSGSLQQVQSRSPQIPGPAQSIKTEMNPILTPRSAGPEGSFIGVQGSNQAGNNLTLKGWPLTGLEQLRSGLLQQKSFVQNQQQLQQQIHFLTPQQQQQLMLQAQQNMASPTSSDVDSRRLRMMLNNRNVGQTNSGGDIIPNIGSPSLSGGDVDILIKKKIAQQQQLLQQQSNSQQHPQLQQPAVSSQQSQSSNQFLQQEKPGIGTMPVDGGMPNSFGGVDQTTKKRKKPGSSSGRANSSGTANTAGPSPSSAPSTPSTHTPGDAMSMPQLQQNGGSAKPLVMFGSDGAGSLTSPANALADVDRLLEDGSLDENVESFLSQDDMDPRDSLGRSMDASKGFGFAEVAKARASATKVTCCHFSSDGKLLATGGHDKKVLLWCTEPALKPTSSLEEHSALITDVRFSPSMSRLATSSFDKTVRVWDADNTSYSLRTFTGHSASVMSLDFHPNKEDMICSCDGDGEVRSWSINNGSCLTFVKVFKGGATQMRFQPQKGKYLAAASEKAIYILDGETQLACRNPLQGHTKNIHSLCWDSTGDNLASVSEDSVRIWSFAPGHDGEFVNELSCSGNKFQSCVFHPSYPYLLVIGCYESLELWDIREKNAMTVHSAHDGLVAALAASSATGKVASVSHDRFVKLWK

SEQ ID NO: 15709 - protein, 538 aa, Oryza sativa (japonica cultivar-group)
MLQAQQNMASPTSSDVDSRRLRMMLNNRNVGQTNSGGDIIPNIGSPSLSGGDVDILIKKKIAQQQQLLQQQSNSQQHPQLQQPAVSSQQSQSSNQFLQQEKPGIGTMPVDGGMPNSFGGVDQTTKKRKKPGSSSGRANSSGTANTAGPSPSSAPSTPSTHTPGDAMSMPQLQQNGGSAKPLVMFGSDGAGSLTSPANALADVDRLLEDGSLDENVESFLSQDDMDPRDSLGRSMDASKGFGFAEVAKARASATKVTCCHFSSDGKLLATGGHDKKVLLWCTEPALKPTSSLEEHSALITDVRFSPSMSRLATSSFDKTVRVWDADNTSYSLRTFTGHSASVMSLDFHPNKEDMICSCDGDGEVRSWSINNGSCLTFVKVFKGGATQMRFQPQKGKYLAAASEKAIYILDGETQLACRNPLQGHTKNIHSLCWDSTGDNLASVSEDSVRIWSFAPGHDGEFVNELSCSGNKFQSCVFHPSYPYLLVIGCYESLELWDIREKNAMTVHSAHDGLVAALAASSATGKVASVSHDRFVKLWK

SEQ ID NO: 15710 - protein, 245 aa, Ehrlichia ruminantium str. Gardel
MFNLLGKKFLITGASGGIGQAITKILHEAGAVLCISGTRESILEKTAAQYSGSIHTLTCDLTNNEQINTLIDSACKIMGGIDGIICNAGITLDKLLLRTSDEDWNKVINTNLTTTFKLNRSACRAMLKNGYGRIINISSIVALTGNPGQASYAASKAGMIAMSKSIAKEFATKNITVNCIAPGFISTPMTDVLSEEQRANIMQHIPMQRMGTPEEIASVVLFLASDASKYITGQTIHVNGGMLMC

SEQ ID NO: 15711 - protein, 272 aa, Gibberella zeae PH-1
MGHEDAVYLAKLAEQAERYEEMVENMKIVAGEDRDLTVEERNLLSVAYKNVIGARRASWRIVTSIEQKEESKGNSSQVTLIKEYRQKIEAELAKICEDILEVLDQHLIPSAKSGESKVFYHKMKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETSAAGQAEAPKEDAPAAATAEDAPAAPAAAEEPKAE

SEQ ID NO: 15712 - protein, 400 aa, Silicibacter sp. TM1040
MSVLSATLSRVKPSPTIAVTNKARELKAAGRDVIGLGAGEPDFDTPQSIKDAAVRAIAEGKTKYTAVDGIPELKQTICEKFKRDNGLDYRPEQVTVNSGGKQTLYNALMATLNPGDEVIIPAPYWVSYPDMVLLAGGTPVPVEASLESSFKLTPDQLEAAITDKTKWFIFNSPSNPTGAGYSRAELKALTDVLMRHPHVWVMTDDMYEHLAYDDFEFCTPAQVEPGLYDRTLTCNGVSKAYAMTGWRIGYAAGPETLIAAMRKVQSQSTSNPCSVSQYAALEALTGPQDFLASNNEIFVRRRNLVVSMLSEIDGLTCPVPEGAFYVYPSIAGLIGKTTPKGVTINSDEDFATALLEEADVAVVFGAAFGLSPNFRVSYATSDDALKEACTRIQRFCASLS

SEQ ID NO: 15713 - protein, 330 aa, Magnetospirillum magnetotacticum MS-1
MDQFDRTPLMTADSEALATARRVLATEARALDSLATSLGDAFLKAVTLIEGAPGRVVVTGMGKSGHVARKIAATMASTGCPAFYVHPAEASHGDLGMVTRDDAVVALSNSGETPELSDVIAYTRRFEIPLIGITSRDGSTLAAASDVALVLPPNPEACPMGLAPTTSTTLMLALGDALAVTLLERKGFTAADFQVFHPGGKLGQRLLKVTDLMHGGDGLPLVGTEASMADVLLVMTAKSLGCAGVIDSGGKLAGVLTDGDLRRHMSPDLLTAKAAEVMTASPRTVPPNLLAAEALRQMNERSITSLFVVESDGRPVGVLHVHDCLRAGLA

SEQ ID NO: 15714 - protein, 502 aa, Agastache rugosa
MDLFLLEKTLLGLFAAIVVAAVVSKLRGKKFKLPPGPIPVPIFGNWLQVGDDLNHRNLTDYAKKFGDIFLLRMGQRNLVVVSSPELAKDVLHTQGVEFGSRTRNVVFDIFTGKGQDMVFTVYGEHWRKMRRIMTVPFFTNKVVQQYRHGWEAEVAAVVEDVKKNPDSATTGIVLRRRLQLMMYNNMYRIMFDRRFESENDPLFVKLRALNGERSRLAQSFEYNYGDFIPILRPLLKGYLRICKEVKDRRLQLFKDYFVDERKKLASTKPMDNDGLKCAIDHILDAQQKGEISEDNVLYIVENINVAAIETTLWSIEWGIAELVNNPEVQRKVREEMDRVLGVGVPVTEPDTHKLPYLQAVIKETLRLRMAIPLLVPHMNLHDAKLGGFDIPAESKVLVNAWWLANNPEQWKKPEEFRPERFLEEESKVEANGNDFRYLPFGVGRRSCPGIILALPILGITLGRLVQNFELLPPPGKSKIDTTEKGGQFSLHILNHSTIVMKP

SEQ ID NO: 15715 - protein, 307 aa, Brassica napus
MSVTTTVEENHRKKPSSSEKEAEKRKQRWAFWGRKWRRLDYFKLTASLFVHSMALLAPFYFSWSALWVTFLFYTIGGLGITVSYHRNLAHRSFKVPKWLEYLLAYCALLAIQGDPIDWVSTHRYHHQFTDSERDPHSPKEGFWFSHLLWIYDSAYLVTKCGRRTNVDDLKRQWFYRFLQKTVLFHILGLGIILFYLGGMSFVTWGMGVGAALEVHVTCLINSLCHVWGTRTWKTNDTSRNVWWLSVFSFGESWHNNHHAFESSARQGLEWWQIDLSWYIVRSLEIVGLAYDVKLPTESQRRRMAIVR

SEQ ID NO: 15716 - protein, 305 aa, Glycine max
MVMKSKLDKYEKLEKLGEGTYGVVYKAQDKTTKDLFALKKIRLESEDEGIPSTAIREIALLKELQHPNVVRIHDVIHTNKKLILVFEYVDTDLKKFMNQFDKGLDAKVIKSLLYQLVRGVAHCHQMKVLHRDLKPQNLLVSQEGVLKLGDFGLARAFGIPVKNYTNEVVTLWYRAPDILLGSKNYSTSVDIWSIGCIFVEMLNQKPLFPGSSEQDQLKKIFKIMGTPDATKWPGITDLPDWKAENFEKYPGESLSKICPKLDADGLDLLDKMLRCNPTERISAKTALSHPFFKDIPENLKKLYNN

SEQ ID NO: 15717 - protein, 615 aa, Xanthomonas campestris pv. campestris str. ATCC 33913
MAVIEIKVPDIGDYSDVPVIEVLVAVGDSVVKDQGLVTLESDKATLEVPSSAAGVVKELKVKIGDNLSEGAVVLLLETEGEAAAAPAAPKAETKAETKAAAPAAAPAAAAPGSKPPVTPSHRAPAEPAASKPALASGKAADIECKMVVLGAGPGGYTAAFRAADLGLDTVLIERYASLGGVCLNVGCIPSKALLHAAAVIDEVAHAGDFGVDFGQPKITLDKLREYKEKVVGKLTGGLASMAKQRKVRTVTGVASFVSPNELEIVGDDGKTQLLRFEHCIIAAGSQAVKLPNFPWDDKRVMDSTDALELHDIPKTLLVVGGGIIGLEMATVYSALGSKVTVVEFMDQLMPGADKDLVKPLADRLKKQGVEVHLKTKATDVSADAKGITVSFEAATEGEKPGLQATAFDRVLVAVGRSPNGKKIGADKAGVTVTERGFIPVDRQMRTNVPHIFAIGDIVGNPMLAHKATHEGKLAAEVAAGEKKEWVARVIPSVAYTNPEIAWVGVTETEAKAKGLKVGVAKFPWAASGRAIGIGRTEGFTKLIFDEETHRIIGGAIVGVHAGDLLAEIGLAIEMGAEAEDIGHTIHAHPTLSESVGMAAEVYDGTITDLYIPKKK

SEQ ID NO: 15718 - protein, 147 aa, Sesbania rostrata
GFTDKQEALVNASYEAFKKNLPGHSVLFYSFILEKEPAAKGLFSFLKDSDGVPQNNPSLQAHAEKVFGLVHDAAAQLRATGVVVLADASLGSVHVQKGVTDPHFVVVKEALLKTLKEAAGATWSDEVSIAWEVAYDGLAAAIKKAMS

SEQ ID NO: 15719 - protein, 491 aa, Sulfitobacter sp. EE-36
MTDAKTDLKSMLKDPSLLETRAYIGGEWVDGDDGTFDVVNPARGDVIAKVANLSRAQVAGAIAQAEKAQKEWASWTGKERAGVMRKWFDLMMENQDDLGAILTAEQGKPLGEAKGEIAYGASFIEFFGEEAKRVYGETIPGHQRDKRITVIKQPIGVAASITPWNFPNAMITRKAAPALAAGCAFVARPAAETPLSAIVMGVLAERAGIPAGVFNVLPSSSSSAVGKEFCENPAVRKLTFTGSTEVGRILLKQAADQVMKCSMELGGNAPFIVFDDADLDAAVEGAILCKFRNNGQTCVCANRIYVQAGVYDAFAEKLKARVEKMKVGDGFEDGVELGPLINGDASDKVKEHVEDAVSKGAEILLGSKEEKMEGNFLAPTIITGVTQDMKVSKEETFGPLAPLFKFDNEDDVIEMANDTIFGLASYFYAKDLSRVYKVAEALEYGIVGVNTGIISTEVAPFGGVKQSGLGREGSHHGIEDYLEMKYICMSV

SEQ ID NO: 15720 - protein, 304 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLGINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAWRTRSRCSRPTP

SEQ ID NO: 15721 - protein, 435 aa, Oryza sativa
MGAGAHTIGIAHCNSFSKRLYNFTGKGGPGDADPSLDAEYAANLRRSKCAAPSDNTTIVEMDPGSFLTFDLGYYRGLLRRRGLFQSDAALVTDAAAEANIASVVSSPPEVFFQVFARSMAKLGMVGVKTGSEGEIRKHCALVNDIHYYMKVDDGPGVNGIEAARYFEDSINNFWTKLKGKDVADLEQSADLESINLLHGSEQEGNTASPTRLPEDILASEAVFPVQAELNVADGSKGLDAKGRWTPGLYAVYITLIRKKLPDEKEGQGEVSMAQFLGFLGLFNMLFFFPFALFLNFTKLEPFHRLTWEQVGLIVGKGLLDNVLSDYLWAKAILLTTTTVATAGLTIQVPIAAIVDTLTGHAPHLLDYIGAAAVLVGFAGINIPVGTPQGSQQEQETPIVSMVDDPVHLPSDRNATSMVDDPVYLPSDRNATGAVQ

SEQ ID NO: 15722 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 15723 - protein, 142 aa, Brassica napus
MQAFYVFVVSLLLTLNYRGEASGSVFFIDGSNNQYLRPPSDQAIPMSLSEISASVSALLGFAPPATLTAHGSSQLNKILKPNPFERPRAAFVLEIAGAHDALVEAHSFLGNAIRGSISSDSYNADIELPESGVSVVSVNEPS

SEQ ID NO: 15724 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMVVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 15725 - protein, 1043 aa, Ehrlichia ruminantium str. Gardel
MISALQVPNEIRRRMQLLYRTEENSYARYLTEKTEISQDSKIRIYSVAKQIIEKIRGGRNLGIIDAFMQEYGLSNEEGIALMCLAESLLRVPDDCTINDLIKDKIANSMWSNHIGNSSSMFVNAATWGLFIGGRVLKDTNDSTRWFSTINNLIKTMGEPIIRKAVQQAMYVLGKHFIKGRDIIEAIGNRKESELYSFDILGEASKTKKDAERYFTEYMKAIDSIGKSINNVTENLVDHDEISVKISALHNRYEFSQINEVLDEIVDKLLSICRLAKQNNIRVCIDAEEASRLEISLMILEKLRLDSSLDGWEGLGLAVQAYQKRAFSVLDFVEDIAVRSSHKMMIRLVKGAYWDYEIKNAQELGLSSYPVFTRKVYTDVSYLACAYKILTKQNTFYPCFATHNAYTLATILEIADKDHPGFEFQRLHGMGTSLYEYVTQEMAANIKCRVYAPVGSYQDLLPYLIRRLLENGANSSFINQMNDSNITLDQLIEDPLEKAKSFEYMPHPSISLPKDIFGDERINSAGIDITDSVTLVNFNEEMKEYKEHKFKALSIINGEELGSQAIEVFSPSNSEDVVGEVSFADATQAVSALDIAYDAFKEWSSMSVYDRAAILEKAADLIEENKAKLIVLLIREGGKVISDAIAEVREAVDFLRYYVAMGKKELGDSKKLPGPVGEDNYIYFRSRGVFICISPWNFPLAIFIGPIVAALITGNTVLAKPAEQTSIIAYEAVKLLYDAGVPKGVLHLLLGHGKELGEVLLKNEKIAGVAFTGSTETARIINQAIAEKEGAIIPFIAETGGLNTMIVDSSALIEQVTNDVIASAFKSAGQRCSALRVLFVQEEIADKQIEMICGAMEDLVIGDPMLLKTDIGPVIDDASREMLFTHADRMSREGKLLCKVNLGEDCDKGYFFPPCAYEIESISQLKREVFGPILHIIRYKKGDLHKILTEINNTGYGLTFAVQSRIQSNIDNIIDNINVGNVYVNRNQVGAVVGVQPFGGQGLSGTGPKAGGPYYLHRFLTEKVISINTTALGGNTTLMCLNDE

SEQ ID NO: 15726 - protein, 805 aa, Methanosarcina mazei Go1
MPEDKNKYIRWFEETTIEDIPTVGGKNASIGEMYRELTSKGVRIPNGFSVTASAYWHMLETGGILEKLKKTMEGLDTFDVSDLAKRGKVARDLILDAGIPDDIWQEIKGAYDRLCEQYGEYTDVAVRSSATAEDLPTASFAGQQETYLNIRGYPGLKDACIRCFASLFTDRAISYRVTHGFDHFKVALSIGIMKMVRSDLASSGVIFTLDTETGFRDVVFITGAYGLGENIVQGQVNPDEFYVFKPTFREGYKPIIQKKLGSKEIKMIYGRGDSKVLTRNVEVPEADRQRFCINDEEVLKLAEYAIDIEDHYSNKYDESRPMDIEWAKDGITGELFIVQARPETVQSQREKDVLETYVIEEKSEVLVKGRSVGDRIASGKARVITDVSDLPSFRPGEILIADTTTPDWEPVMKTAAAIVTNKGGRTCHAAIVSRELGIPAVVGAENATEVLNTGREITVSCAEGEDGLVYAGLLPFRKNTVSLKDLERPQTEIMMNLGNPESAFSFSMIPNDGIGLARLEFIITSYIKVHPMALVHPEQVKDPRELREIERLTRGYEKKEDYFIKQLARGVGMITAAFYPKPVVVRMSDFKTNEYASLLGGRYFEMEENNPMIGFRGASRYFDERYREGFALECRAMKKVRDEMGLKNLILMVPFCRTVEEAKKVIAEMEKNGLRRGENGLQIYVMCEIPNNVLLVDEFSEYFDGFSIGSNDLTQLTLGVDRDSEMLAAEFDERDPGVLKIMSMAVQGAKRNERHSGICGQAPSDFPEIAEFLVKEGIDSISLNPDSVMKITLKVLETEKELGKR

SEQ ID NO: 15727 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMVVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFL

SEQ ID NO: 15728 - protein, 303 aa, Pseudomonas syringae pv. tomato str. DC3000
MRFEGIYTPAVTPHTPDGDIDWAVFSEVLESLIEANVHGIIIGGSTGEYYAQTAEERLKLAAHAKDVMGNRVQLIIGTGAIRTEDAVLFAKDAKALKADAILVTTPPYALPTDQENAIHALTIDRAANMPIMLYNYPGRMGVQMNEDYLARVGKSKNVIAIKESSGEMGRVHLLAREFPHIALSCGWDDQALEFFAWGARSWVCAGSNFLPREHVALYEACVIEKNFDKGRQIMSAMMPLMHALDGGKFVQCIKFGCELNGLKVGDVRAPLRPLNAEDKRSLQTVIANVKRTVAHIISGASHA

SEQ ID NO: 15729 - protein, 505 aa, Pseudomonas syringae pv. tomato str. DC3000
MHDLLTADEYAAIAQSISFPSNAFINGAYKPAISGATFSTINPATGEFLSDLAACRAEDVDDAVSKAKKAFDDGRWRLLAPGERKSVLLKFARLLEDNRHELAVLESLDSGKPVRECQLVDVPDTIHTLRWHAELIDKLYDHTAPVGNDALTLVVREPIGVVGCVLPWNFPLLMLAWKIGPALAAGCSVIVKPAEQTSLTTLRVAELAFEAGVPAGVLNIITGTGKDVGEPIGLHKDIDMVSFTGSTVTGRRFLHYSADSNLKRVVLECGGKNPAVVMEDAEDLDLVAEQVVNGAFWNMGENCSATSRLLVHASVKDELLERMGAYIREWKMGDPLDPQTRVGALVSSDHFAKVKSYLDYANADKLDIVYGGDTQEGAFVQLTVVDGVERDSRLFQEEIFGPILSVTTFNSISEAIALANDTVYGLAASVYTGSLRKAIKLSREIRAGIVTVNCFGEGDASTPFGGFKESGFGGRDKSVFAHDQYTEIKTIWIDVSDRSVDETVK

SEQ ID NO: 15730 - protein, 342 aa, Mentha x piperita
MVMNKQIVLNNYINGSLKQSDLALRTSTICMEIPDGCNGAILVKNLYLSVNPYLILRMGKLDIPQFDSILPGSTIVSYGVSKVLDSTHPSYEKGELIWGSQAGWEEYTLIQNPYNLFKIQDKDVPLSYYVGILGMPGMTAYAGFFEICSPKKGETVFVTAAAGSVGQLVGQFAKMFGCYVVGSAGSKEKVDLLKNKFGFDDAFNYKEESDYDTALKRHFPEGIDIYFDNVGGKMLEAVINNMRVHGRIAVCGMVSQYSLKQPEGVHNLLKLIPKQIRMQGFVVVDYYHLYPKFLEMVLPRIKEGKVTYVEDISEGLESAPSALLGVYVGRNVGNQVVAVSRE

SEQ ID NO: 15731 - protein, 436 aa, Geobacter sulfurreducens PCA
MAMTQLEYARNGIITDKMKEAALAEGVSPEFIKAGIADGTIIICHNNKHHNGRPLAVGTGLRTKVNANIGTSADDTDITKELEKARVAVRHGADAIMDLSTGGPVDEIRRAIIAETNACIGSVPLYQAALDAVRTKKKAIVDMTVDDIFEGIIKHAEDGVDFITVHCGVTRATVERMKNEGRIMDVVSRGGAFTVEWMTYNNAENPLFEHFDRLLDIVKAYDMTLSLGDGFRPGCLADATDRAQIHELILLGELTQRAQDVGVQVMIEGPGHVPLNQIEANILLQKRLCHGAPFYVLGPLVTDIAPGYDHITCAIGGAIAAAAGADFLCYVTPSEHLRLPSVEDVREGVIASRIAAHAADIAKGVKGAMAKDIAMAKCRKKLDWEGQFEQALDPEKARRMRDESGVAEHGACTMCGEFCAYKVMDDAMEKQRTATL

SEQ ID NO: 15732 - protein, 433 aa, Oryza sativa (japonica cultivar-group)
MTEGKIVSWTASEGDRLAKGDPVVVVESDKADMDVETFHDGFLAAVLVPAGESAPVGSAIALLAESEDEIPAAQSKAASLSSSSSSSPPPPPPQESTPPPPPPPPPAPVAAAVSAPAPPSPASQGGLRVVASPYARKLAKDLNVDLNSITGSGPGGRIVAKDVEAAAAAPKKAAPVAAARPDVPLGSTVPFTTMQGAVSKNMVESLAVPTFRVGYTFTTDALDALYKKIKPKGVTMSALLAKATAMALVQHPVINSSCRDGKSFTYNSSINIAVAVAIDGGLITPVLPDADKLDIYSLSRKWKELVDKARAKQLQPHEYNSVYVKIDSVLIKLQTHYSAFDEMQKKTCTFTISNLGMFGVDRFDAILPPGTGAIMAVGSSQPTLVGTKDGSIGIKNQMQVNVTADHRVIYGADLAAFLQTLSKIIEDPKDLTF

SEQ ID NO: 15733 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARLSGASRIIGVDLNPAKHEQAKKFGCTDFVNPKDHTKPVQEVIVEMTDGGVDRAVECTGNADAMISAFECVHDGWGVAVLVGVAQKEAVFKTHPMNFL

SEQ ID NO: 15734 - protein, 322 aa, Triticum aestivum
SRPPRPLASAAMRAAAAQIDPSPSPSPAALAKSRLKRLFERQVLRVSPAERLPPVSAGGEKDKEKDDLEPSSVCLDGMVRSFLEDGGGAVGERAPAARCCNCFNGGDASDDEDGPAAAEASAISDAAETIKGLVHCASLRERNLLADVSTLVERHSAAGARKRDLLRLLAASLRAMGHDAALCLSRWDKSSSHPAGEHAYVDVLLPAGSERGDRERVLVDVDFRSQFEVARPTKAYRAVLQRLPSAFVGKEDRLRLLVAAAADSSRASLKKRGLHLAPWRKPEYMRAKWLSPYEREAPPPAPDASASELAAIGEGGEDGAKV

SEQ ID NO: 15735 - protein, 630 aa, Oryza sativa (japonica cultivar-group)
QFGIKHVDQDELLQGHGLCWSSDVVGASETISQSDPDRVRKSDIDEGVDVSLIEHESKRIKTDDGAAEEKKSVTQKAQILAFEIEGELFTLLGGVNKKYKEKGRSLLFNLKDKSNPVLRGRVLSGDITPKRLCSMTTEELASKELSDWRLAKAEELAKMVVLPSKEVDVRRLVRKTHKGEFQVEVEETDGISVEVGIGGDLLSHVPSRPTEGQTKTDDKSVHTEEKESDNSEQDGVIVTGGNNMPSNLEHTENEKTDLMQELMVDDLKDTENLPPIMSLDEFMETLDSEPPFEDDSTQTVKDDPNSIEKTDISLKSEDSSKNVDSASASDSQLDPQTLSPQDKFESKLQSPKKDAGSILFPVEQIKEDLLVKSSPEKANAENIDTGSQSIPESITDCKSAPDALLTHDSVWEGTIQLSLSSLTNVVAIFKSGEKTSTNEWRHFLDIKGRVRLSAFQEFLEQLPKSRSRAIMVTELRWKEGSLESGRQHLLRTIDSYIADERVGLVKPADGVELYLCPSQGKAAQILAEHLPKEQSSSLTVTGTSAIGVVVWRRPHVSPRIPARNDGSRNQSISRKQHAVIASAVPLSSKPTNERQHHGQDVVTDDVPPGFGPGVVREDDDLPEYDFVTVP

SEQ ID NO: 15736 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARLSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFL

SEQ ID NO: 15737 - protein, 593 aa, Pinus sylvestris
MCGILAVFGCLDASQAKRVRVLELSRRLRHRGPDWSGLYQSGHSFLAHQRLAIVDPASGDQPLYNEDRQIVVTVNGEIYNHEKLREQLKSHKFRTGSDCEIVAHLYEDYGEEFVNMLDGMFSFVLLDTRDQSFIAARDAFGITPLYIGWGFDGSVWFASEMKALHDDCESFESFPPGHIYSSKQGGLRRWYNPPWYSENVIPSSPYDPLVLRRAFEKAVIKRLMTDVPFGVLLSGGLDSSLVAAVASRYLAATKAGKQWGDKLHSFCVGLKGSPDLKAAKEVAEYLGTVHHEFHFTVQDGIDAIEDVIYHVETYDVTTIRASTPMFLMSRKIKSLGVKMVLSGEGSDEIFGGYLYFHKAPNKEEFHQETCRKIKALHMYDCLRANKSTSAWGVEARVPFLDKEFVNVAMDIDPERKMVKPDIGRIEKWVLRRAFDDEQNPYLPKHILYRQKGQFSDGVGYSWIDGLKSHAAEHVTDTMLRNAKYIFPHNTPTTKEAYYYRMIFERFYPQNAARLTVPGGPSVACSTAKAVEWDAAWAHNLDPSGRAALGVHASAYQECNAGANDGTGNGNVNTFSKMPGREASVDAREVLIKG

SEQ ID NO: 15738 - protein, 784 aa, Oceanobacter sp. RED65
MSKHVIWLDQLGLGDVDKVGGKNASLGEMISHLTKLGVTVPNGFATTADAFNEFLAYNGLPKLIDDQLEKLDSAHLSNLAEVGSAIRSAITGAKFPEKLEQGIRECYEKLGDGNDISVAVRSSATAEDLPDASFAGQQETHLNISGIDAVLASVKEIYASLYNDRAISYRIHQGYHGQQIALSVGIQKMVRSDIGSAGVMFTLDTESGFDDVVFITSAYGLGETVVQGAVNPDEFYVHKQSLKEDRPAILRRSLGAKAIKMIYGENEPVETVRVDREERFKFSITDSDIYDLANQALLIEKHYQRPMDIEWAKDGDDGKIYIVQARPETVKSRSDKNVMERYILKETGNVLCEGRSVGHKIGSGPVKVLKQIDQMETINEGDILVADMTDPDWEPVMKKASAIVTNRGGRTCHAAIIARELGIPAVVGCGDATDILQHGQEVTVSCAEGDTGFVYEGSLNFEHKTNSVGSMPELPFKLMMNVGNPDRAFAFQSLPGAGVGLARLEFIINRMIGVHPKALLNFDSLPEEIKLTVQRRMAGYDDPVDFYVEKLVEGISTLAAAFKDKKVIVRLSDFKSNEYANLIGGRLYEPEEENPMLGFRGASRYISKTFRDCFELECRALKKVRNEMGFTNVEVMVPFVRTVGEAKQVVDLLAENGLKRGENGLRIIMMCELPANALLADEFLEYFDGYSIGSNDLTQLTLGLDRDSGVIAHLFDERNEAIRKLLEMAITACKRQNKYIGICGQGPSDHPDLARWLMEQGIDSVSLNPDSVLDTWFYLAEKPQ

SEQ ID NO: 15739 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAVMEGARLSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 15740 - protein, 555 aa, Bradyrhizobium japonicum USDA 110
MSMSERQNPYNIGLDKTPANYVPLSPLSFLARSAAVYPDHVSTVYEGRSFTWAQTYERCRRFASYLAGKGIGVGDTVAAMLPNIPAMNEVHFAVPMTGAVLNALNIRLDAPSIAFQLDHGGARIILVDPEFSSVITDALAQMSGPKPFVIDVDDPAFKGGKRIGEIEYEAAVAQGDPDFTAIPPKDEWDAIALSYTSGTTGNPKGVVTHHRGAYLNAVSNILAGNLGQHPVYLWTLPMFHCNGWCFPWTIAASAGINVCLRKVEPTKIFELIKQHGVTHMCGAPIVYNTLINAPDAPKETSTGNAARRVVGLIAGAAPPVAVLEGAENIGIKLTHVYGLTEVYGPASVCAEQPGWDELPPAERARMKRRQGVPYPLEEGVTVINPQTMQEVPRDGETIGEVMFRGNIVMKGYLKNEKATKEAFEGGWFHTGDLGVLDEHGYVIIKDRSKDIIISGGENISSVEVEDILYKHPAVLFAAVVAKPDPKWGEVPCAFVELKDGASATEAEIIAFCRSHMSGFKTPKAIVFGPIPKTSTGKIQKFLLRNEVGSAKAITA

SEQ ID NO: 15741 - protein, 323 aa, Gibberella zeae PH-1
MADKMDRGLDEIIADTRSNRPRNNRGQGRRREPRNDFPRDGVRKSVRDDSRNIDSEWVHDRFEENNNRRAPAPRRRRESPEQDSKGTKIRVDNIHYDLTDDDLSELFQRIGPISRLQLRYDRAGRSEGTAYVTYERNEDAKAAILEFDRANANGQPIYLTLLPSRNPFDTAVMPGRSLAERISSPGDRRSHSPHRQRDDDDAARRGIDRYVPGQGSRRSPMPRGRGQGQGQGRGQGGRRPGARRDGREGGREGGRDQEGGRGGRGNRPSKKTQEELDAEMADYFGGDSAPAEAANQQDAPPAQAPAAAQPQVHAAADDIDMIE

SEQ ID NO: 15742 - protein, 499 aa, Kineococcus radiotolerans SRS30216
MPTERRWCPAGGPGTLGGRPAVPTRSPGGPGMTVTEQSVPQTAPGAPGPARAARDHLWMHFARMGAYQDRPAPVIVKGEGAHVWDDRGHKVLDGLSGLFVVQAGHGRAELAEVMAKQAETLAFFPVWGYATEPAVQLAERVASYAPGDLNRVFFTTGGGEAVESAWKVAKQYFKLTGKPMKHKVISRATAYHGTPQGALAITGLPAMKQAFEPLTPGGFRVPNTNIYRAERMGAPTDPVAFGAWAAARIEEAILFEGPETVAAVVLEPVQNSGGCFVPPPGYFQRVREICDRHDVLLVSDEVICGFGRHGTMFACEKFGYQPDIITCAKGMSSGYGPIGAMIASDRIMEPFLEGKNFFPHGYTFGGHPVSAAVSLANLDIFEREGLNQNVLDNEQALGDTLRRLLDLDIVGDVRGDGYFWAVELVKDKATKETFDLAERETLIKQFLPGALFRNGLYARPDDRGEPVIQVAPALTTGQAEFDEMEQVLRATLTEAMRLV

SEQ ID NO: 15743 - protein, 1320 aa, Escherichia coli
MGTTTMGVKLDDATRERIKSAATRIDRTPHWLIKQAIFSYLEQLENSDTLPELPALLSGAANESDEAPTPAEEPHQPFLDFAEQILPQSVSRAAITAAYRRPETEAVSMLLEQARLPQPVAEQAHKLAYQLADKLRNQKNASGRAGMVQGLLQEFSLSSQEGVALMCLAEALLRIPDKATRDALIRDKISNGNWQSHIGRSPSLFVNAATWGLLFTGKLVSTHNEASLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEESDRLEISLDLLEKLCFEPELAGWNGIGFVIQAYQKRCPLVIDYLIDLATRSRRRLMIRLVKGAYWDSEIKRAQMDGLEGYPVYTRKVYTDVSYLACAKKLLAVPNLIYPQFATHNAHTLAAIYQLAGQNYYPGQYEFQCLHGMGEPLYEQVTGKVADAKLNRPCRIYAPVGTHETLLAYLVRRLLENGANTSFVNRIADTSLPLDELVADPVTAVEKLAQQEGQTGLPHPKIPLPRDLYGHGRDNSAGLDLANEHRLASLSSALLNSALQKWQALPMLEQPVAAGEMSPVINPAEPKDIVGYVREATPREVEQALESAVNNAPIWFATPPAERAAILHRAAVLMESQMQQLIGILVREAGKTFSNAIAEVREAVDFLHYYAGQVRDDFANETHRPLGPVVCISPWNFPLAIFTGQIAAALAAGNSVLAKPAEQTPLIAAQGIAILLEAGVPPGVVQLLPGRGETVGAQLTGDDRVRGVMFTGSTEVATLLQRNIASRLDAQGRPIPLIAETGGMNAMIVDSSALTEQVVVDVLASAFDSAGQRCSALRVLCLQDEIADHTLKMLRGAMAECRMGNPGRLTTDIGPVIDSEAKANIERHIQTMRSKGRPVFQAVRENSEDAREWQSGTFVAPTLIELDDFAELQKEVFGPVLHVVRYNRNQLPELIEQINASGYGLTLGVHTRIDETIAQVTGSAHVGNLYVNRNMVGAVVGVQPFGGEGLSGTGPKAGGPLYLYRLLANRPESALAVTLARQDAKYPVDAQLKAALTQPLNALREWAANRPELQALCTQYGELAQAGTQRLLPGPTGERNTWTLLPRERVLCIADDEQDALTQLAAVLAVGSQVLWPDDALHRQLVKALPSAVSERIQLAKAENITAQPFDAVIFHGDSDQLRALCEAVAARDGTIVSVQGFARGESNILLERLYIERSLSVNTAAAGGNASLMTIG

SEQ ID NO: 15744 - protein, 658 aa, Bradyrhizobium japonicum USDA 110
MATRAKKSVKRKSGKKAAKKATKKAVKALARKAAKKVKKTKKAAAKKGVKKSAAKTARKAGKKAAKKQVGAKKAVKKAAKQPAKSPTKKAPAKKAKVTAAAVTAAPTPVATPPKAVKPNVSKPKAPRAPKPVAAPQAAVPAAAPARDNVFYITTAIAYPNGNPHIGHAYEAIATDTLARFARLDGKDVFFLTGTDEHGLKMIQTAQNEGLTPSALAARNAARFKAMDERLNVSFDRFIRTTEEQHHRSTQEIWRRMEANGDIYADTYAGWYSVRDEAYYAEDETRLNDDGVRLGPQGTPVEWVEEKSYFFRLSAYQEKLLKLYTDNPDFIGPDSRRNEVVSFVKGGLRDLSISRTTFDWGVKVPGDEEHVMYVWVDALTNYITGVGFPDESDKNWRYWPADVHIIGKDIIRFHAVYWPAFLMSAGIPVQKRVYAHGFLFNRGEKMSKSVGNVVDPFNLADQYGVDQMRYFFLREVPFGQDGNYNHEAIVARINADLANDLGNLAQRSLSMIAKQLGGVLPEPGEFSDNDKAILAMADGMIAASREAMATQQIHHWLNAVWAVVAEANRYFAGEAPWALAKTDPARQKTVLYVTAEVVRQIAILAQPAMPTASGLLLDSLGVPGGERNFAALGGAKRIAPGSTLPAPTPAFPRYIEPAA

SEQ ID NO: 15745 - protein, 609 aa, Dehalococcoides sp. CBDB1
MENYQRTDIRNIAIIAHVDHGKTSLVDVMLKQSRIFRENQHVGELIMDRNTLEREKGITILAKNTAITYRGVKINIIDTPGHADFSGEVERVLNMADGCLLVIDSIDGPMPQTRFVLKEAMQKKLKPIVVINKIDRENSRPEVVLGLVQDLFLELATTEEQLDFPVVYTSAREGYAVNTPGTKNTDLVPLFECILSKIPPPSIAQGEFQMLISNLDYDTHKGRIAIGRIQRGKICSRDRIVNIDSQNKAHSFEVGQVFTFMGLGKQEVECAEAGEIVAITGLENASIGDTVTSPLQPEALPRIEIGEPTVRMTFGVNTSPFGGRDGKFCTSRQLRERLYRELETNIGLRVEETDSPDSFLISGRGELHLSILVETMRREGYEFEISKPEAITKTIDGKIYEPVEALTIDVREDFVGEVTELLGKRQARMTDMHNDGEGNVRLEYNIPTRGLIGFRNSFLTATRGTGVLNSQFLEFQPWCGEIEQSRTGALVAAEAGLSCTYGLSNSQERGIIMIDANIPVYEGMIVGLHARGLDLAVNVCKQKKMTNIRSSTSDIAIKLVPPLKLSLEQSMDFIADDELVEITPKGIRLRKKILNTDLRLRARKRTDNN

SEQ ID NO: 15746 - protein, 369 aa, Avena sativa
MDGAPVAEFRPTMTHGGRFLLYNIFGNQFEITSKYQPPIMPIGRGAYGIVCSVMNFETREMVAIKKIANAFDNNMDAKRTLREIKLLRHLDHENIVGLRDVIPPSIPQSFNDVYIATELMDTDLHHIIRSNQELSEEHCQYFLYQLLRGLKYIHSANVIHRDLKPSNLLLNANCDLKICDFGLARPSSESDMMTEYVVTRWYRAPELLLNSTDYSAAIDVWSVGCIFMELINRAPLFPGRDHMHQMRLITEVIGTPTDDDLGFIRNEDARRYMRHLPQFPRRPFPGQFPKVQPAALDLIERMLTFNPLQRITVEEALEHPYLERLHDVADEPICTDPFSFDFEQHPLTEDQMKQLIFNEALELNPNFRY

SEQ ID NO: 15747 - protein, 555 aa, Silicibacter sp. TM1040
MYKYNDFDSAFLAERNRQFRAQVERRIAGALTEDEFKPLRLMNGLYLQLHAYMLRVAIPYGTLNPDQMRALALLAEKWDKGYGHFTTRQNIQYNWPKLKDVPDMLDALAEVNLHAIQTSGNTIRNVTADHFAGAAADEIEDPRPIAELIRQWSTDHPEFQFMGRKFKIAVSGAANDRAVLKAHDLAIKIVKNEDGEVGYQVLVGGGLGRTPMIGKVLNDFVAADDLLPYIESVISVWNQLGRRDNKYKARIKITVHELGLEKIRELTEERFAQVRPTFGGADQALFQDIKRHFAAPEFRSEGTEVFDAAYDSDPVFRAWADTNLAEHKAPGHAIATISIKKHGATPGDATAAQMYAMADIAEEFAYGELRISHEQNVILPHVHKNDLPAIHARLKAADLATANIGLISDIIACPGMDYCALATARSIPVAQEIATRFEDLKLEHDIGHLQIKISGCINACGHHHVGHIGILGLDRAGVENYQITLGGDATETAAIGTRTGPGFAYDEIVPAVERIVETYLEQRESAEEEFLQTYRRVGMEPFKAALYPASEKKVA

SEQ ID NO: 15748 - protein, 119 aa, Glycine max
  misc_feature (16)..(20): Xaa can be any naturally occurring amino acid
  misc_feature (56)..(56): Xaa can be any naturally occurring amino acid
  misc_feature (62)..(62): Xaa can be any naturally occurring amino acid
  misc_feature (68)..(68): Xaa can be any naturally occurring amino acid
  misc_feature (72)..(72): Xaa can be any naturally occurring amino acid
  misc_feature (84)..(84): Xaa can be any naturally occurring amino acid
  misc_feature (97)..(97): Xaa can be any naturally occurring amino acid
  misc_feature (99)..(99): Xaa can be any naturally occurring amino acid
  misc_feature (109)..(109): Xaa can be any naturally occurring amino acid
APPPPPIITRRDDPIXXXXXRAELHRRGIAQMRINNRSLQDMYIFGDPLLVPIIIXERLTNXYHSAIXNSNXIPLEGEGRHILXNGSRATKKLCGSXPXKNELVLRIVXFVHGFQGNHL

SEQ ID NO: 15749 - protein, 473 aa, Arabidopsis thaliana
MAQSSTEPKFSLRLIIDEEKNKVVLAEAGTIVRLLAKHRKSDPVTIGCLRNLYTSVVDMELDDFETDACKQMLLYPKNIREAQYRNFKLNIDTNESLKCFGCRFFSICRMCSNFNTSLCKCGKLMNEEISFLEYEENDVEGVFMRDKSSFIITDDLRLTDDSTSSLLQTLKDLGCADVSKLREQVLDIGLKEVMTLMQCVFTSNTPLTDAFLKNQSSNTVRKIYRKLSDDKGDEAEPDKVITIDAIVRKQDMKILYVECGEDFVDLLFTFLAIPLESIWEISGNSITIGRIGNLFRSFKDLSDNEVLSASKCMIPYYYRCQKQLLKIRTPTPRVYLGHCYSKTLSYSQSFYLTTKRTTKRMTFVDPKSDCCGRSKDGKGFVKRGTKFIVSDDLIVTPKISSSTFSVLKKFQILTDDLEVQAITISNADALNLLGASLVTSSALSSAFGNLIVKKPKEENVSWNPVSKKPKVET

SEQ ID NO: 15750 - protein, 239 aa, Zea mays
  misc_feature (144)..(144): Xaa can be any naturally occurring amino acid
  misc_feature (178)..(178): Xaa can be any naturally occurring amino acid
  misc_feature (207)..(207): Xaa can be any naturally occurring amino acid
MAFAAAARRSLASPRISDCLSRRFHPALPQLLPSNSIGDPRKPSPLPLPPAPRPLRFSFSPCGTAQTLDLLPFGIHLLAGPPRRGFSSSSRDIDFADVLTGAANAWPPVAAPASFPGEVALAAGDSSIAVAAVQHLIDAVHSFXWWISIALPTVLLRSVSCPLWMLARKRVYEVSGDXQTSKLVNNAKDDVSREEAERAAWSSLKKXGFASYLPLIVTPYTLITLHIAVSNMGDNVPSL

SEQ ID NO: 15751 - protein, 127 aa, Glycine max
MAMASATTLATITVVAASPSVGSRRSGKRNVNFIRGLNSFGGLKAQNNVTLLGLPVCTEQCFAKVVSSLKYPSSSSRKGRGGGAAFSTCNAAGEIFQIAAIMNGLVLVGVAIGFVLLRVEAFVEESE

SEQ ID NO: 15752 - protein, 171 aa, Glycine max
  misc_feature (147)..(147): Xaa can be any naturally occurring amino acid
TKNQGFELTKQRYGKANVKFLRVYREGGKHEVKEIRARVLLEGAFEISYTNGDNSTIVATDTQKNTLFALAKLHPIEPLEQWCLQVANDFLSRHKHISAVNLKVEEHPWDRIQVAGKEHPHSFQKGSGGIRIVKLRMPRNGTPSLSXGFRELEIMKTTQSGFEGFIRDDYT

SEQ ID NO: 15753 - protein, 536 aa, Medicago sativa
  misc_feature (109)..(109): Xaa can be any naturally occurring amino acid
MAVSSFHRVFTFECRSDPDFTSLPSTDNHHHNRRRHFPTTSLSSAAAISSPILRFPPNFQRQLSTKARRNCSNIGVAQIVAASWSNEGTGNPSGIAGSDSGAGCCICCXCNDFAGAVRPRRRCRRWDVVENGAVQTNRSSYSSFLKSDASKTIHAAERLGRAIVTDGITTPVVNTSAYFFKKTADLIDFKEKRQTSYEYGRYGNPTSTVLEEKISELEGAESTILMASGMCASVVLFMALVPAGGHLVTTTDCYRKTRIFIETFLPKMGITTTVIDPADVGALESALEQHNVSLFFTESPTNPFLRCVDIKLVSELCHKKGTLLCIDGTFATPLNQKALALGADLILHSLTKYMGGHHDVLGGCISGSIKVVSQIRTLHHVLGGTLNPNAAYLFIRGMKTLHLRVQQQNSTGMRMAKLLEAHPKVKRVYYPGLPSHPEHELAMRQMTGFGGVVSFEIDGDITTTIKFIDSLKIPYIAASFGGCESIVDQPAILSYWDLPASERAKWKIYDNLVRFSFGIEDFEDLKADVLQALEAI

SEQ ID NO: 15754 - protein, 530 aa, Triticum aestivum
  misc_feature (151)..(151): Xaa can be any naturally occurring amino acid
  misc_feature (453)..(453): Xaa can be any naturally occurring amino acid
  misc_feature (462)..(462): Xaa can be any naturally occurring amino acid
  misc_feature (475)..(475): Xaa can be any naturally occurring amino acid
GRPRRSSGSSCSSSGPPWCAVQEEASYTSIRRFSPRPSRSAHLPLPHACGSRVLRPWRFFRGLAAVSRLRSRMGQDATTLGGVRWLQMQSASDLDLRSQLQEMIPEQQDRLKKLKSEHGKVQLGNITVDMVLGGMRGMTGMLWETSLLDPXEGIRFRGLSIPECQKVLPAAVKDGEPLPEGLLWLLLTGKVPTKEQVDALSKELLSRSTVPGYVYKAIDALPVTAHPMTQFTTGVMALQVESEFQKAYDKGMPKTKFWEPTYEDCLNLIARLPQVASYVYRRIFKDGKAIAADNTLDYAANFSHMLGFDDPKMLELMRLYITIHTDHEGGNVSAHTGHLVGSALSDPYLSFAAALNGLAGPLHGLANQEVLLWIKSVMEETGSNITTDQLKEYVWKTLKSGKVVPGYGHGVLRNTDPRYSCQREFALKYLPEDPLFQLVSKLYEVVPPILTEXLGKVKNPWXPNVDAHSGLLAEXLGLSETRYYTVLFGVSRSMGIGSQLIWDRALGLPLERPKSVTMEWLENYCKNKAA

SEQ ID NO: 15755 - protein, 207 aa, Triticum aestivum
  misc_feature (128)..(128): Xaa can be any naturally occurring amino acid
  misc_feature (150)..(150): Xaa can be any naturally occurring amino acid
TREDAHAFDVISVKIADLGNACWVNHHFTNDIQTRQYRSPEVILGSKWGASTDVWSMAAMVFELITGDYLFDPQSGTKYGKDDDHIAQIIELLGPFPKSLCLSGKWSQEIFNRKGELRNIHRLRHWAXLPDVLREKYHFKEDEAKRIADXLTPMLELVPEKRANAGGMAGHVWLEDTPGMKGLKIEGLEVGGRGEGIDGWATEVRKR

SEQ ID NO: 15756 - protein, 304 aa, Acinetobacter sp. CR1
MMAAQLKQGKIGFIGADPVQSRQAFDRQMQSILSTPTAVKRVEEIRLNLASGNIAARYYHPAPHKKLPLIVFYHGGGFVVGGLDSHDEFCRLMAVHAHAQVLSVEYPLAPEASPQQIIQVCEDALAWAYQHRREMKILKNRIAVAGDSAGGNIAAVVAQRSAQSAYAPNAQFLIYPALDFKSRHPSFFAYKDGLVLTGQDIDFVTQHYVTQHQVALDDPIISPTFGKLKKLAPAFVVTAGHDVLHDEAEIYAHKLRQNQVTVKYVEYLDQTHGFISMTFVSRRAKKISIELCKNFRKFWDRPRS

SEQ ID NO: 15757 - protein, 696 aa, Vibrio vulnificus CMCP6
MATQGLTFHGDSIHIQFEEGLVGLVKRSAEPLNLAEASKHPAFKYFPQLGEETYHSFLGAPIIHRKKVLGVLVIQQKTPRLFSEMEESFLVTLSAQLAVIIAHAQSLGHWSLASKPAAVQGIAASSGVAIGEFWYDNSQPILSEVCPASTLDKEREQEWLAVAIEAALADFRRMRKKFDSEINKDALAIFDLFTHLLNDPMLRTDLKKHVERGDRADWALRQVVESYSSRFARMSDVYLRERAHDIRELGQRLLFFLHNSEQEQPRIERPVILVANELTASLLASVPKKYLLAVVALEGAANSHAAILSRALGVPAVMGANLNLEEVHGKQGIVDGYSGEIYIQPNRQILREYRSLVTEESELFAMVNKELALPAKTQDNVDVEVLLNAGLSADSNIAINAGVDGVGLYRTEIAFLLQHRFPSEDEQYQQYRAILSSYPQQRVVMRTLDIGGDKPLPYLPIEEDNPFLGWRGIRFTLDHPDIFLIQLRAMLRASAEHGNLSILLPMISGVGELDDAIRLIQQAYHEVVLLDERVVMPQIGVMIEVPSMVYLIPSIAQRVDFVSVGTNDLTQYLLAVDRNNARVSDVYESLHPAVLQALQQIYQQCGQYHLPVCICGELAGDPFGALLLLGLGYRSLSMNTSNVARIKYLIRHSQLSDLQALSQQALSLSYGKDIHQLMRDYFINHDFAGFIRAGKK

SEQ ID NO: 15758 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARLSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 15759 - protein, 303 aa, Brassica napus
  misc_feature (183)..(183): Xaa can be any naturally occurring amino acid
  misc_feature (220)..(220): Xaa can be any naturally occurring amino acid
DKQLQLPWWGLVLACAIAMFFTLPIGVIQATTNQQMGLNVITELIIGYLYPGRPLANVSFKTYGYRRVAQALYFVGDFKLGHYMKIPPRSMFIVQLVATVVSSSVCFGTTWWLISSVENICNTDLLPVGSPWTCPGDEVFYNASIIWGVIGPRRMFTKEGIYPGMNWFFLIGILAPVPFWYLXSEKFPEKKWLTLIHIPVIFAAGSPMPHAKAVPYWSWXLIVGVVFNYYIFRRFKSWWARHNYILSAALDAGTAIMGVLIFFAFQNNDISIPDWWGLENSDHCPLAHCPTAKGVVIEGCPVF

SEQ ID NO: 15760 - protein, 1139 aa, Bordetella bronchiseptica RB50
MQQLGATRRYAASDLVGFLACEHLTQLDLRALDAGQAPAAADDEQMALVQAKGQAHEQAWLERLRARHPDLADVTRAGPDLAARLAATRAAMAAGAPVIYQAALCHGPYVGHADFLLRTECPSALGDYGYEALDTKLARSPRASFVLQLSFYAWLLEHAQGVAPRSMHVVLGSGRELALRVADYAHYLRQVLRRFEAAIAAEPAPPTYPEPCEHCPQCRWRVACEARRVADDHLSLVAGMSRQQARRLNAQGVATLAQLGALPEHAQVAGIEAGTLQRLRAQAALQWRARVDGARHYELLAAQDEGPRGLARLPRPDPGDMFFDMEGDPLEDGGLEYLFGLYVIDDGAERFVPFWAHDRRQEKQAFEAFMDFVAERLRRHPDAHIYHYAPYEATALKKLMSLHGTREAEVDHLLRAGKLVDLYRVVREGLRISEPSYSIKYVERFYLPRRAGEVTNAGASIVYYERWKATGEPRLLQDIADYNRDDVISTWRLRDWLCGIRPAALPWHNEAGQQDLDAARAVIGEMTEAERRLLPYRAALADDLPADEAAWSPRDAFRALAWHLLDFHRREQKPAWWAWFARAEATDGELIEDAECLGGLARDDAAPPVRQAQSLRYTYRYPAQETKLRTGARCTDVRTGASLANLVVDPHARLASFTCSARKPAPPPRMALGPAAPVNNKELVNAVFRYGDAVCRAPDGMSTPMRAVDALLRREPPRIRGLARGAPLVAPHAELLPQVLDVVARMDETTLFLQGPPGAGKTYTGSRVLLQLLRAGRRVAVSSNSHHAINNLLRGLERLAQREGFALRGAKKSTSAGDDSCLGGAQIEDVFDNKDVDPARHQLVAGTAWLFARPEFEQAFDYLFVDEAGQVSLANLVAMGQCARNIVLLGDQMQLGQPSQGTHPGRSGESALEYLLDGQATIAASQGVFLDTSYRMHPEICGFISEAIYDGRLRAAPATAAHRLLLDEAAGRELPAHGIRYVPVPHDGNTQSSREEAARVAELCALLLRQRHVDEAGAPAPLTLDDILFVAPYNVQVNTLRAALPDGARVGTVDKFQGQEAQVVIVSMATSSGDYLPRDLEFLFSRNRLNVAISRARTLAILVASPALTAVRCRSAEQMALVNTLCWVAETGSASPYQV

SEQ ID NO: 15761 - protein, 848 aa, Yersinia pestis CO92
MSKIKIAIIGNGMVGHRFIEDLLDKADKDQFDITVFCEEPRIAYDRVHLSSYFSHHTAEELSLVREGFYEKQGVKVLVGERAITINRAEKVIHSNSGRSLYYDKLVMATGSYPWIPPIKGSEGQDCFVYRTIEDLNAIEACTRRSKRGAVIGGGLLGLEAAGALKSLGVETHVIEFAPVLMAEQLDPMGGDQLRQKIERMGVRVHTGKNTQEIVHSGQNSRKTMLFADGTQLEVDFIVFSTGIRPQDKLANQCGLATARRGGIAINDYCQTSDPDVYAIGECASWQERTFGLVAPGYKMAQVAADHLLGRENAFLGADMSAKLKLLGVDVGGIGDAHGRTEGARSYVYLDESKEIYKRLVVSADNKTLLGAVLVGDTTDYGNLLQLALNNITLPENPDSLILPAHAGNKPTIGVDSLPDSAQICSCFDVTKGDIIRAIGQGCQTVAALKSATKAGTGCGGCIPLVTQVLNAELSKQGIEVNNHLCEHFAYSRQELYHLIRVEGIKTFTELREKYGKGYGCEVCKPTVGSLLASCWNEYVLEPQHTPLQDTNDNFLGNIQKDGTYSIIPRSPGGEITPDGLLVVGQIAKEYNLYTKLTGSQRIGMFGAQKDDLPAIWARLIDAGFETGHAYAKALRMAKTCVGSTWCRFGVGDSVGFGVALEHRYKGIRAPHKIKFGISGCTRECAEAQGKDVGIIATENGWNLYVCGNGGMKPRHADLLAADLDEETLMRYLDRFMMFYIRTADKLQRTSVWLESLEGGIRYLQLVILEDKLGINDQLEAEIARLRDKVACEWKATVENPAAQVRFAHFINSSLRDPNVQVVREREQHRPARPDERIPVRVLELEDNA

SEQ ID NO: 15762 - protein, 89 aa, Glycine max
  misc_feature (83)..(83): Xaa can be any naturally occurring amino acid
TMIAAPAVTTVHHAGAGMAAPFTGQKSMVGFPTRKTNNGISCIGYNCLRLQCLQVWTPVVKSEVETLSYLPHLVDAQMAKEVXYLIRNG

SEQ ID NO: 15763 - protein, 552 aa, Oceanobacter sp. RED65
MYIYDEYDQKIVNERVSQFRDQTQRYLDGKLTEEQFLPLRLQNGLYVQRYAPMLRVAVPYGLLSSEQARKLGHIARTYDKGYAHISTRTNVQFNWPELAAVPDILAELASVQMHAIQTSGNCIRNTTTDQFAGVVPNELVDPRPYCEIIRQWSTFHPEFAFLPRKFKIAVNSHESDDRAATLLHDIGIKIVRNEQGELGYAFYVGGGLGRTPIVASLVKEFVAEKDLLTYLDAVLRVYNLHGRRDNKYKARIKILVKALGVDAFRDKVDAEWQHLKGGPGTLTQEELERVKGHFTAPNYETLDENTELQKQLSENKAFANWYNRNVNEHKVKGYAIVTLTLKKLGVPPGDITDRQFDSVADLADKYSFGEIRNTHEQNMVLADVKQDDLFELWQQAKELGFATPNLGLLTDMICCPGGDFCALANAKSIPVAEALQAKFDDLDYLHDLGDLDLNISGCMNACGHHHIGHIGILGVDKKGEEFYQVSLGGSSGPDASVGKILGPSFAREEMPDVIEKVLSVYVRNRIEGERFIDTYRRIGHSPFKEFVYAKSH

SEQ ID NO: 15764 - protein, 323 aa, Pisum sativum var. macrocarpon
MENFPIVDMGKLNTEDRKSTMELIKDACENWGFFECVNHGISIEMMDTVEKLTKEHYKKCMEQRFKEMVATKGLECVQSEIDDLDWESTFFLRHLPVSSISEIPDLDDDYRKVMKEFALKLEELAEELLDLLCENLGLEKGYLKKAFYGSKGPNFGTKVSNYPPCPKPALIKALRAHTDAGGIILLFQDDKVSGLQLLKDEQWIDVPPMRHSIVINLGDPLEVITNGKYKSVMHRVIAQTDGARMSIPSFYNQGGDAVISPASTLLKEHEPSEVHPKFVFDAYMKISMGLKFQATEPRFELAEIMSIVKVGPVVRLWICVWLS

SEQ ID NO: 15765 - protein, 430 aa, Listeria innocua Clip11262 [sequence omitted]

SEQ ID NO: 15766 - protein, 194 aa, Triticum aestivum
  misc_feature (127)..(127): Xaa can be any naturally occurring amino acid
  misc_feature (160)..(160): Xaa can be any naturally occurring amino acid
  misc_feature (168)..(168): Xaa can be any naturally occurring amino acid
  misc_feature (174)..(175): Xaa can be any naturally occurring amino acid
  misc_feature (178)..(178): Xaa can be any naturally occurring amino acid
  misc_feature (185)..(185): Xaa can be any naturally occurring amino acid
RGAMRISALSEAGVIYVMTHDSIGLGEDGPTHQPIEHLVSFRAMPNILMLRPADGNETAGAYKVAVVNRKRPSILALSRQKLPHLPGTSIEGVEKGGYTISDNSTGNKPDLIVMGTGSELEIAAKGXPNELRKEGKTVRVVSFVSWELFDEQSDEYKESXLPAAVTAXISIEAXXTLXGWQKYVXGAQGKGICI

SEQ ID NO: 15767 - protein, 510 aa, Listeria innocua Clip11262
MSKSPVAIIILDGFGKRAETVGNAVAQANKPNFDRYWANFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLEKAISDLNYGAIATVSGRFYAMDRDKRWERVEKAYKAIVSAEGEKFEDPIELVKASYANDKNDEFVVPAIITKDGKPVATVKDNDAVIFFNFRPDRAIQLSNAFTDKEWDHFDRGANHPKNIKFVTMTLYNPSIDAEVAFEPIEMKNVIGEVLSNEGLSQLRIAETEKYPHVTFFMNGGRNEEFPGENRILINSPKVETYDLKPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 15768 - protein, 159 aa, Rickettsia prowazekii str. Madrid E
MINYLKSFFLYEIIRGMTLTLKYFFKPKVTINYPYEKSPVSPRFKGEHALRRYENGEERCIACKLCEAICPAQAIVIESDERDDGSRRTTRYDIDMTKCIYCGLCQEACPVDAIVEGPNFEFASLTHTALIYDKERLLNNGDKWEQALANKLHKDYQYR

SEQ ID NO: 15769 - protein, 251 aa, Listeria innocua Clip11262
MRKPIIAGNWKMNKTAAKAGQFAEDVKNNVPSSDAVESVVAAPALFLQELVRLTEGTNLRVAAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 15770 - protein, 396 aa, Listeria innocua Clip11262
MAKKVVTDLDLKNKKVLVRVDFNVPMKDGKITNDNRIVAALPTIEYILEQNGKAILFSHLGKVKTEEDKEGKSLRPVAARLSELLGKEVKFVPTTRGPELEKAVDELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 15771 - protein, 336 aa, Listeria innocua Clip11262
MTVKVGINGFGRIGRLAFRRIQNVEGIEVVAINDLTDAKMLAHLLKYDTTQGRFDGEVEVHDGFFNVNGKEVKVLANRNPEELPWGDLGVDIVLECTGFFTAQDKAELHIKAGAKKVVISAPATGDMKTIVYNVNHETLDGTETVISGASCTTNCLAPMAKVLEDKFGVVEGLMTTIHAYTGDQNTLDAPHPKGDFRRARAAAENIIPNTTGAAKAIGEVLPTLKGKLDGAAQRVPVPTGSLTELVTVLDKKVTVDEVNAAMEAASDPETFGYTSDQVVSSDIKGMTFGSLFDETQTKVLTVGDQQLVKTVAWYDNEMSYTAQLVRTLEYFAKIAK

SEQ ID NO: 15772 - protein, 479 aa, Salmonella enterica subsp. enterica serovar Paratyphi A str.
MAQHAVYFPDAFLTQMREAMPSTLSFDEFISACQRPLRRSIRINTLKISVADFLALIAPYGWSLTPIPWCHEGFWIERDDEEALPLGSTAEHLSGLFYIQEASSMLPVAALFADDNHPQRVMDMAAAPGSKTTQIAARMGNRGAILANEFSASRVKVLHANISRCGIANTALTHFDGRVFGAALPEMFDAILLDAPCSGEGVVRKDPDALKNWSPESNLDIAATQRELLDSAFHALRPGGTLVYSTCTLNRQENEDVCLWLKETYADAVEFLPLGDLFPDADRALTPEGFLHVFPQIYDCEGFFVARLRKMSSLPAMPAPGYKVGAFPFTPLKGREALNVTQAANAVGLLWDENLHLWQREKEVWLFPAEIESLIGKVRFSRLGIKLAESHNKGYRWQHEATIALACPTHAHAFELSAQEAEEWYRGRDIYPQTPPAADDVLVTFQHQPLGLAKRIGARIKNSYPRELVRDGKLFTGNS

SEQ ID NO: 15773 - protein, 699 aa, Pseudoalteromonas tunicata D2
MSVTLEFLAGKPYPLGATLQNEGVNFAVFSAHATKIELCLFDASGHSEIARLAMLKGEEHVWHGFIKGAKAGMLYGFRAHGPYMPELGQRFNANKLLIDPYSKALHGEFRWSNLHSVELSEPLLNANFINNSDSASDTPKSKVVSLAKYTGQKPHIPWSKTVIYECHVKGATARHPGITPQKQGTFLGLSEPAFITHLKSLGVTTIELLPCHHFISERFLTDKGLKNYWGYNTLSFFAPHSDYLVNDNIAEFQTMVSRFHQAGIEVILDVVYNHTAEGNHLGPTLSWRGLDNLTYYRLDTANPRHYINDTGCGNTININHPRVLQLILDSLRYWVEVMGVDGFRFDLAPILGRQYSGFKSRHAFFQSINQDPILSQVKLIAEPWDIGPGGYQLGGFPIAWREWNDKYRDTMRRFWRGDLGLLPEFAQRLHGSNDLFEHNGRGPLASINFITAHDGFTLADLVMYQDKHNLQNGENNQDGHSENLSANYGVEGPSEDVQINALRLRQQKNFLLTLILSQGVPMFAAGSELGHTQQGNNNAYCQDNEINWLNFKESTVCNELSPFIRKLIELRDRFFVYKKLNYLHHNDVDFHLTWLSTSGIAMTAEDWTNHQNQQLGYFIEPRAHIKSQEVLLVLFNASDKTQFFTLPTRQNIKQWQLCLTTLAVNESHTHYSSSDIIAVAAKSCWILSAVIQETPHGTL

SEQ ID NO: 15774 - protein, 401 aa, Pseudoalteromonas tunicata D2
MQVTRALFDEVMVPNYAPSSVIPVKGQGSRVWDQNGKEFIDFAGGIAVNCLGHCHPVLVKALQDQSEKLWHLSNVMTNEPALRLAKKLTDATFAEKVYFANSGAESNEAALKLARRYALEVFGAEKTHIIAFNKGFHGRTFFTVTVGGQAAYSDGFGPKPADIQHCNYNDLAAFEALISDKTCAVMMEPLQGEGGIISPTAEFVQAVRALCDKHNALLIFDEVQTGVGRTGHLYAYQGLGVTPDILTTAKALGGGFPIGAMLTTTAIAAHLKVGTHGSTYGGNPLACAVAEAAFDVVNTPDVLNGVKEREQLFREGLTAINEKYNVFSEVRGEGLLLGAVLNADFAGRSRDFLLASADHGLMSLVAGTDVVRFAPSLIIPKEDIVEGLARFEKAVSQVVNG

SEQ ID NO: 15775 - protein, 346 aa, Candidatus Pelagibacter ubique HTCC1002
MTKVGEHITLDIIGTNREYDPSVYENVIRKIAKAAEVTILEISKYKFEPQGFTILALLAESHISFHTFPEKGIISFDFFTCGKVSPSIALDIVKKEFKHKRIVTKAFDRDTKSLYHDIYSSPGLQKSYVVNEVLEDFKSKVGQHIEILDLEQFGKSLFIDNEIQVATNDEVLYSSTFVNAALKLNKDMGTAAIIGGGDGGVARECMSKGFDFIDWYELDPEVVEVCNKHLGSIGNKSTEKNSVKCIWGDAFESIKSVEDDKYDKIFVDLNDDQFCIDLAAKNMDSLIRILKPNGVITAQVGSQDKKPEQVEKWLDVFNKNFGNTTLDRVYIPSFDCSWNFSSSINH

SEQ ID NO: 15776 - protein, 406 aa, Rhodopseudomonas palustris CGA009
MEEFYRIRRLPPYVFEQVNRAKAAARNAGADIIDLGMGNPDLPAPPHVLEKLKDTLGKPRTDRYSASRGITGLRRAQAAYYDRRFGVKLNPDTQVVATLGSKEGFANVAQAITAPGDVVLCPNPSYPIHAFGFLMAGGVIRSVPSEPTPDFFAAAERAIIHSIPKPIALIACYPSNPTAYVASLDFYKDLVAFAKKHEIMILSDLAYAEVYFDDNNPPPSVLQVPGAMDVTVEFTSMSKTFSMAGWRMGFAVGNERIIAALARVKSYLDYGAFTPVQVAATAALNGPDDCIKEMRETYKKRRDILVESFGRAGWEIPPPSASMFAWAPLPPAFREIGSMQFATLMVEKCGVVVSPGVGFGEHGEGFVRIAMVENEQRIRQAARGVRRFLESGVETLHNVVPLAAQR

SEQ ID NO: 15777 - protein, 192 aa, Brassica napus
MASSSQFRYTQTPSKVVLLRNLPWECVEEELIDLCKRFGKIVNTKTYVGANRNQAFVEFGDVNQAISVVSYYASSSEPAQIRGKTVYIQYSNRHEIVNNQSPGEVPGNVLLVTFEGVQSHDVSIDVIHLVFSAYGFVHKIATFEKAAGFQALVQFTDVDTALAARTALDGRSIPKYLLPEHVGSCNLRMSYS

SEQ ID NO: 15778 - protein, 636 aa, Zea mays
  misc_feature (201)..(201): Xaa can be any naturally occurring amino acid
MELRHFRCCASRLLLLVTLLLGFRRAGAQDSTSYTVPAQFACDVSSPCDTYVVYRTQSPGYLDLGSISDLFGTSQARIASANGLSSEDGVLQPGQPLLVPVRCGCAGAWSFANVTYPIRQGDTFYNLAKASYENLTEYHLIQNLNPGSEPTSLQIGQEVTVPLLCRCPARAERSRGVQSLITYMWQAGDTMSQVSKLMNAXADEIAVANNVTAGSAASASAAGLPMLIPVRQRPRLPAPLYAAAAADGKSRSRRRAAVIGASVSGSLVALAALFVAILARRRYRKKPSMRLGSRFAVNTKLSWSRNQFGHDGSNSFAHVMKGGKLLTGVSQFIDKPIIFVEEEIMEATMNLDERCKIGSTYYRAKLDGEVFAVKPAKGDVSAELKMMQMVNHANLIKLAGISIGADGDYAFLVYEFAEKGSLDKWLYEKPPSALPSSSCTVATLSWGQRLSIALDVANGLLYMHEHTQPSMVHDDIRARNILLTADFRAKISGFSLAKPAMVDAAATSSDVFAFGLLLLELLSGRRAMEARIGSEIGMLWREIRGVLETGDKREAKLRKWMDPALGSEYHMDVALSLASMARACTEEDAARRPNMTEVVFSLSVLAQPLSVADGFEKLWQPSSEDNIRIAGSVAAR

SEQ ID NO: 15779 - protein, 444 aa, Mesembryanthemum crystallinum
MVTIKCVKARQIYDSRGNPTVEADIHLDDGTYARAAVPSGASTGVYEALELRDGGKDYMGKGVYKAVKNVNEIIGPALVGKDPTQQTAIDNFMVQQLDGTVNEWGWCKQKLGANAILAVSLAVCKAGAQVKKIPLYQHIAEIAGNKNMVLPVPAFNVINGGSHAGNKLAMQEFMILPTGASSFKEAMKMGSEVYHNLKSVIKKKYGQDATNVGDEGGFAPNIQENKEGLELLKTAIEKAGYTGKVVIGMDVAASEFYKEDKSYDLNFKEENNDGSQRISGEALKDLYKSFVAEYPIVSIEDPFDQDDWEHYAKMTAECGEKVQIVGDDLLVTNPKRVKKAIDENPCNALLLKVNQIGSVTESIEAVKMSKKAGWGVMASHRSGETEDTFIADLSVGLSTGQIKTGAPCRSERLAKYNQLLRIEEELGDKAVYAGANFRRPVEPY

SEQ ID NO: 15780 - protein, 685 aa, Gibberella zeae PH-1
MASKLKPVDIPTFATTQLALLDQELQTEINETSDLISNHSPTALQRAGIALTNLVVSGQRTGLGGRTVVELSPDAATGSADELPEHGLRTGDIVLVAEQPAGSAKKREVKDLEKKGARGVVTKVRREWVSVAIDEGKEEVAFTGRVWAVKLADEVTYKRMNWTMEKLNKMDESEYSSLTRVLFGLSSPSPVATDLTKDESVGNLDWFDPTLNDSQKDAIRFALASREVALIHGPPGTGKTHTLIELILQMIKLEQRILVCGPSNISVDNVVERLAPHKVPILRLGHPARLLPSVVDHSLDVLTQTSEAGTIVKDIRSEMDTKQASIKKTKSGKERKAIYNDLKELRKEFRERERRCVSTLIGGSKVVLATLHGAGGYQLRNEEFDVVIIDEASQALEAQCWVPLVSAKKVVCAGDHLQLPPTIKSTNTKVKAPVKEGVKITKGATLEVTLFDRLLALHGPSIKRMLTTQYRMHESIMRFPSDELYDSKLIAADAVKHRLLKDLEYEVEDNEDTSEPVIFIDTQGGDFPEKNEEDDKDTPKKGKASLHGDSKSNEMEAALVQQHVKQLVAAGVRPEDIAVVTPYNAQLAVLAPLKDKFPGIELGSVDGFQGREKEAVIVSLVRSNSEGEVGFLGERRRLNVIGDSETVQNVILGISADRSSIDSCCPESSALLGGRKAGMGDLSFS

SEQ ID NO: 15781 - protein, 459 aa, Rickettsia prowazekii str. Madrid E
MEKYDVAVIGGGPGGYVAAIRAAQLKKKVVLIEKAHLGGVCLNWGCIPTKSLLKSAEVFEYIKHAQDYGIDVGIAEINIKKIVERSRKIANTLACGVQLLLKKNKVTIIDGVASFGENKVINVNDKPTVKAENIIIATGTRPKILQGFEPDIKQIWTSKEAMIPQHVPKSMIIIGSGAIGIEFASFYNSIGVDVTVIEAKNRILPSEDTEIAGIAHKNFEQKGIKIITNAKLIKQTKSQNEIEVELELEGKTQKLQATILLMAVGISANIENLGLEKTKVEVENGYILTNGLMQTAESGIYAIGDVAGVPCLAHKASHEGIIAAESIAGLNPNGINKHNIPYCIYSSPQIASVGLTEEIAKDLGYEIKIGRFPFSANGKALVSGNSDGLIKTIFDVKTGELLGAHMVGLEVTELIQGYVVSKNLEGTELDLINTIFPHPTLSEMMHESVLAAYDMAIHI

SEQ ID NO: 15782 - protein, 591 aa, Zea mays
MPTMHALRLCPLLSTIRSTPPRATAAARQGALFVARCSSAGTPSAAQALKISSIPTKPVEGQKTGTSGLRKKVKVFQQENYLANWIQALFNSLPPEDYVGATLVLGGDGRYFNKEAAQIIIKIAAGNGVQKIIVGRNGLLSTPAVSAVIRKRKANGGFIMSASHNPGGPDNDWGIKFNYSSGQPAPETITDQIYGNTLSISEIKTADIPDTDLSSVGVVSYGDFAIEVIDPVSDYLELMENVFDFQLIKDLLSRPDFRFIFDAMHAITGAYAGPIFVEKLGADPDCILNGVPLEDFGNGHPDPNLTYAKELVFTMFGTHAPDFGAASDGDGDRNMILGKRFFITPSDSVAIIAANAQAAIPYFQFGTKGLARSMPTSGALDRVAEKLNVPFFEGKLSICGEESFGTGSDHIREKDGIWAVLAWLSILAHRNKDKKVGERLVSVEDIAMEHWKTYGRNFFSRYDYEACESHSANQMMDHLRDVMANSKPGEKYGNYTLQFADDFSYTDPVDGSTVSKQGLRFVFTDGSRIIFRLSGTGSAGATIRLYIEQFESDISKHSLDAQTALKPLIDLALSVSKLKDFTGREKPTVIT

SEQ ID NO: 15783 - protein, 398 aa, Streptococcus pyogenes MGAS315
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGSKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 15784 - protein, 590 aa, Glycine max
MRTSWADLAANSASENAGTSNSTAPSRPVYVPPHLRNRGPSESLAPAPPSNNNNNVGSRWGALPPRNGWGNRSGGWDRREVNPFGGQEDAAAEEELGGEEQQESTGINFDAYEDIPVETSGENVPPAVNTFAEIDLGDALNQNIRRCKYVKPTPVQRHAIPISLAGRDLMACAQTGSGKTAAFCFPIINGIMRGQAQPLQRPPRGVRIVYPLALVLSPTRELSMQIHEEARKFSYQTGVRVVVAYGGAPINQQLRDLERGVDILVATPGRLVDLLERARVSLQMIRYLALDEADRMLDMGFEPQIRKIVEQMDMPPPGARQTMLFSATFPKEIQRLASDFLSNYIFLAVGRVGSSTDLIVQRVEYVQESDKRSHLMDLLHAQRANGVQGKQALTLVFVETKKGADSLEHWLCLNGFPATTIHGDRTQQERELALRSFKSGNTPILVATDVAARGLDIPHVAHVVNFDLPNDIDDYVHRIGRTGRAGKKGLATAFFNDNNASLARALADLMQEANQEVPAWLSRFAARSSFGGGRNRRSGGGRFGGRDFRREGSFSRGGSDYYSAGNNSSGYGNSGGYGGGYGPGVTSAWD

SEQ ID NO: 15785 - protein, 331 aa, Cryptococcus neoformans var. neoformans JEC21
MEPKPLTAYQQTYHWRNKNCAPFAYDWIKQSLPGLKVDDGQQSAEISSVTSVSGDCDLGQRKGKLLTIYDLEVQASWIGKTKDGNEVKGTLKIPEVSHEAIDGVSDYVYEFSITGGSSSASEELLFYIRKSFPPLLSDKFNSFRPALLAAHGSATADAASAPDSGASTPAAYTPAPPTKGADEPINEEQKKEKKSVGATVTVEVKADLQASADDLWGLLTDENKIPMWSRSAAKLSLKAGSPYELFGGNVRGKVITADPPKKLVQTWQVKSPSWPSEHYGTMTLSLSQGSDTTAATFTLDGVPAGTQADVEKALNSFYIQGLKQMGLGTFL

SEQ ID NO: 15786 - protein, 1185 aa, Lactobacillus acidophilus NCFM
MKKYNKWGTKGVFICASALLSVWLGATWTDGNVQAAETPDAGNQASTEVSQRVITENEKKTVVQPAKDTQTDEKDTDNTQLASATPSEETTQVEEAKQQALKDTTKVVVHYQGDGSKWVPYIWGKKPNGNGNQYKWDGKDDYGYYSNITVDGNEQEMGVLIKGKDSWDKDGQGNDRIVKVGDNGKAEVWYKEGSDEAQDVKPTYDSAKVNIHYQGNDDVTSISYWTNTDPQNKKIIDLSKSDVQEKEGSFDLSNTKFNSIFVAPIGTDTEVREFTPLPGKSATDIYLVTKDPTVYYTKSFALATQSLTSASMDSGKTVNIQTGKEMTAAEAKKNLSIKDNSIVNVVAVNPDQDGKSKQFTITTAQDLSILDNNQIGIYGNYKSIDIGSYVRSKDFDTKYYYNGDDLGATYTEKQSQIKLWAPTAKKVVLNLYDSLNNDASATKTFVMNRGDKGVWSVILPGDYKNWAYDYSLSFGNGTTTQTNDPYSKAVTINGDRSVIEDVDAIKPNDFSRLPQFSAPTNAIIYETSIRDFTSDKNSGIKDKGKYLGMIESGVTPDGQITGLDYLKSLGVTHVQIMPMFDFASINESKADDSYNWGYDPKNYNVPEGSYSSNAADPTTRIMEMKEMINGLHKAGIRVVMDVVYNHVYNTDEQSLNKTVPGYYFQYDSEGHTTNGTGCGNDMASERLMARKYIVDSVKYWAKNYNIDGFRFDLMGILDVDTMNEVRSELNKIDPSILVYGEGWDMRKTDHDIGAGQYNADKVDKSIGFFSDDIRNAIKGAEFGGVTPGLVEGNGKEENYKEDAKKFIDGFLGGQNYGKDAKHPYQAPEQTINYVACHDNRTLYDMLKTLMPDESEANIIKRDKLATSMMMLSQGIPFIHAGQESLGTKDGNENSYNASVEVNEINWGRVKENKDMVDYFKKLVNLRKSQSVFRQNDYSQINKNVKVLNDGQNGVFAFEYNTNGKKLYVAFNVNDKDAKLENVDLSVATKLLDSDGNTQIGKESVLKPLSTLVAEVSTKEAKPDDSSSIINPPVNTNIGDNNTDTLLSTVDIVLTHNAYIYENDGITTVKANDGKNVTLKVGQTIHALNKAQIVILNNKEFYQIGDNQYVKVNNTLNWNILKHNSFVYSKSGKALKKNHKRILLKKGHKVLLLDNACLTKIHGKQFYRIGNNKYVKAVNVVIEVKA

SEQ ID NO: 15787 - protein, 286 aa, Pseudomonas aeruginosa UCBPP-PA14
MSDYQETLYQGYGQRFSIDNMLHEVRTEHQHLVIFENARMGRVMALDGVIQTTEADEFIYHEMLTHVPILAHGAARRVLIIGGGDGGMLREVAKHKSVERITMVEIDGTVVDMCKEFLPNHSQGAFDDPRLNLVIDDGMRFVATTEERFDVIISDSTDPIGPGEVLFSENFYQACRRCLNEGGILVTQNGTPFMQLEEVRTTAARTDGLFADWHFYQAAVPTYIGGAMTFAWGSTREGLRRLPLETLRQRFRDSGIATRYYNADIHLGAFALPQYVLQAIGKQDND

SEQ ID NO: 15788 - protein, 335 aa, Bordetella bronchiseptica RB50
MPKTPSDASPKARQAADRTAERQRAIQREQDQRDQRKPAAGRPGEAPRTGARDHPEPPMPRQHLAKPGNEADMALQPQFLAPAYRGSGKLEGLAALVTGGDSGIGRAVAVLYAREGADVAIVYLQEHDDARETARHVQAEGRRCLLIAGDVRDPVFCEEAVARTLREFGKLDILVNNAAYQEHASSLQDITDERLDETFRTNIYGYFHMARAALPHLKEGASIVNTGSVTGLRGHPTLLDYSSTKGAIHAFTWSLAANVAERGIRVNAVAPGPVWTPLNPADQAPGQIKDFGARTALKRAAQPEELSPAYVFLASPACASYITGIVLPVTGTPGE

SEQ ID NO: 15789 - protein, 473 aa, Methylococcus capsulatus str. Bath
MAEPKTIHADVLVLGGGPGGYTAAFRAADLGRQVVLVERYPTLGGVCLNVGCIPSKALLHVAQIIHEAREAGEFGLRFGAPEIDLDQIRGFKDKVVKTLTGGLETLARQRKVTVVQGTGRFTGEHGMQVETTDGPVTVGFDHAIIAAGSRAVKIPDFPHDDPRLMDSTDALALQEVPKRLLIVGGGIIGLEMATVYHALGAGITVVELMDQLIPGCDADLVRPLHQHIKKQYENIYLKTRVSRIEPEAAGLKVFFEGEGAPESDLFDRVLVAVGRAPNGALIGAENAGVHVDAKGFIPVDEHQRTNVPHIYAIGDIVGNPMLAHKATHEAKVAAEVIAGKPSAFQALTIPSVAYTDPEVAWMGVTEAQAKAQGIEYEKAVFPWAASGRALGIGRKEGATKLLCDKTTKRVIGAGIVGPHAGELIAEAVLAMEMGADAEDIGLTVHAHPTLSETFAFAAEMIEGTITDLYIRKR

SEQ ID NO: 15790 - protein, 589 aa, Leifsonia xyli subsp. xyli str. CTCB07
MDSVILRNASSFYITTPIFYVNDVPHIGHAYTEVAADVLVRWHRQAGEDVWLLAGTDEHGQKILRTAAAQRLSPAEWTDRLVHDSWRPLLEALRISADDFIRTTEDRHKVVVIAFLTLLREKGLVYEGTYEGFYCVGCEEYKQESDIIAGTGAFAGQVLCPVHARSVDVVNEKNYFFKMSAFQDRLLEMLADEEFLRPAAVRNEILAFVGSGLKDISITRSSFDWGVEVPWEPGHVVYVWFDALLNYISGIGWGSDVEEFDRRWPDVHIIGKDIARLHAVLWPAMLMAADLPVPKRIVAHGWLLVNGEKMSKSNATGIGPEQIVKAFGIDAFRYYFVRSIVFGQDGSFSWDDIHRRYNADLANGLGNLVSRTIAMITKYRAGIVPEAAAPTAAEDEVRHTITQARANASAAIDRFALSEALGQVWTIVERLNSYITEQTPWSLARDEAQAHRLDTVLNTVAEGLRELAVLLRPFLPDTAQAIWAGLGAEAVCGDLRRSDGGEGRGRRQPPEGCRHRRRAAALPPHRAGGGDRHRGGTDARLSLTAEEMIEVARTTAARSARRWTNSSTLSQQRRRARTDAQKDALLAQD

SEQ ID NO: 15791 - protein, 235 aa, Schizosaccharomyces pombe
YWASSQLTQLFLSTDLESLEPTCLSKDTIYQWKVVQTFGDRLRLRQRVLATAIVLLRRYMLKKNEEKGFSLEALVATCIYLSCKVEECPVHIRTICNEANDLWSLKVKLSRSNISEIEFEIISVLDAFLIVHHPYTSLEQAFHDGIINQKQLEFAWSIVNDSYASSLCLMAHPHQLAYAALLISCCNDENTIPKLLDLIKSTDAFKVILCVQRIISIYYFEDIEAAALEHHHHHH

SEQ ID NO: 15792 - protein, 436 aa, Methylococcus capsulatus str. Bath
MAQEQTVVVPDIGDFKDVEIIEVLVKPGDKVAANDSLITLESDKAAMEIPSPYSGTVTELHVRVGSKVSMGTPILQLREDEGTDASGAASAPVEPAPAEPVSPPPAAAAPAAGDTQAVPASAPTPPAPMPVAEEGSGPAHASPAVRRFARELGVDVAKVRGTGPKGRILKTDVQSFVKQAVATAERTGGGGFAVPAMPEIDFAQFGPIERQPLSRIQKLSSANLHRTWLTVPHVTQHDEADITELEAFRNALKAESAKRGVKLTLLPFIIKAAVAALKDFPRFNASVAPNGEELILKRYYHVGFAVDTPDGLVVPVIRDADTKGIWDIAAELAAIGDKARGKKLRTADLQGGTFTVSSLGGIGGIAFTPIINAPEVAILGVSKAQLRPVFQDGQFVPRLMLPLSLSYDHRVIDGADGVRFVTHVSSLLADMRRVLL

SEQ ID NO: 15793 - protein, 895 aa, Methylococcus capsulatus str. Bath
MIASNPSLNSQFAANTDTDPEETREWLDALAAVIETEGVERAHFLIEKLVDKARRSGANLPYKANTAYINTIPPHAEARSPGDAGIEHRIRCYLRWNAMAMVVRANQKSTEYGGHISSFASSATLYDVGFNHFFHAPDRDHGGDLVFFQGHSAPGIYARAFLEGRLTEEHLDRFRAEVGGGGLSSYPHPWLMPDFWQFPTVSMGLGPLMAIYQARFMKYLADRKILLNTEGRKVWCFCGDGEMDEPESMGAIGLAGREKLDNLIFVVNCNLQRLDGPVRGDGKIIQDLEAEFRGAGWNVIKVIWGSHWDALLARDTKGLLRQRMEEVVDGEYQTYKAKDGAYVRKHFFGKYPELLEMVANMSDEDIWHLNRGGHDPHKVYAAYAAAVAHKGQPTVILAKTIKGYGMGRAGEGQMIAHQQKKLDAEALKAFRDRFNIPIPDDKVHEAPYYKPAEDSPEMIYLQERRKALGGYLPQRRKEAPHLQIPELSIFETMLKSSEDREMSTTMVFVRLLSSLLRDKALGRYVVPIVPDEARTFGMEGLFRQYGIYSSVGQLYEPQDADTVMFYREDKSGQILEEGICEAGAMCDWIAAGTAFSNHNVQMIPFYIYYSMFGFQRVGDLMWAAGDMQARGFLMGGTAGRTTLAGEGLQHQDGHSHLIMGAIPNCITYDPTFAYELAIIVHDGLRRMYQEGENVFYYITVMNENYTHPALPKGAEEGIIKGLYKFRDAGKDEAVQLLGSGTILREVIKAAELLEADYGIKAGIWSATSFNQLRRDGLEVSRWNLLHPEQPRKTSYVERCLAPTAGPVVAATDYVKAYPDLIREFVPRRYTVLGTDGFGRSDRRSALRRFFEVDSHYIAFAALKSLADEGGIEKTKVSEAMTRWNIDPDKANPIGC

SEQ ID NO: 15794 - protein, 455 aa, Oceanobacter sp. RED65
MNDTPKSLAQEDSQYVLHPASSITALLDQGPQMIVSAKGSTITDADGNELLDAVGGLWCVNAGYGRPELAQVVKEATEQLAYYHTFSNASNPWQVQLAKKLLQLAPSNLGKVYFGSGGSDANDTLVKIAWHYHSLRGKSTKTKVIAREQAYHGTSISTASLTGLGGFHKEYPLPLDFVLHTDCPHFYTRGLEGETEQQFCDRLIDNVAKLIEKEGADNIAAFFAEPIHAAGGIIEPPAGYYPKLKTLLKQHDILLVADEVVCGYGRLGTWFGSDQLDIEPDMLSTAKGLTSGYFPMSAAFITDEIFDVLKEGSAKIGAFSHGYTYSGHPVGCAVALANLNIIENEGLVERAKENGAYLHARLLEELGDHKNVGEIRGRGLLAGVQLVKDKVNKELPDPADKWPAKVTAMMRKNGVIVRPLPSVGTLAISPPLVITRDEIDRLVSEIKAAIDAEIA

SEQ ID NO: 15795 - protein, 343 aa, Glycine max
MDPHTEELPQYIHINQNEFCIRRHKKQKEEDIAICECKYDADDPDNACGDSCLNVLTSTECTPGYCHCDILCKNQKFQKCEYAKTKLFKTEGRGWGLLADEDIKAGQFVIEYCGEVISWKEAKRRSQAYENQGLKDAFIIFLNVSESIDATRKGSLARFINHSCQPNCETRKWNVLGEIRVGIFAKHDIPIGTELAYDYNFEWFGGAKVRCLCGALKCSGFLGAKSRGFQEDTYLWEDDDGRYSVEKIPVYDSAEDEPVSNFNGRTEPSLDVIVKAEQLSESTAFHVQPLDSVQMKDLDVKKIKTDVADEDMNFYSQDSEHTLSQKNAISHIRSNTAGRNFAW

SEQ ID NO: 15796 - protein, 677 aa, Bradyrhizobium japonicum USDA 110
MTFHSIYAHGFARVAACVTTSHVADPSANAKAILAAANACHEQSAAVAVFPELCLSGYAIEDLVKQDPLLDAVERGLAAIVEASDALMTVLIVGAPLRFGHRIYNCAVVIHRGNVLGVVPKSYLPTYREFYEGRHFASGAGIAGETIVFGGLHAPFGVDLLFAAEDVPGLTIGVEICEDMWIPVTPASELALAGASVLINLSGSPITIGRARSRALLCQSTSARCLAAYVYSAAGAGESTTDLAWDGQTSIYENGVLLAEGERFRQGGQITFADVDLDLLRQERALMGTFDDNRRQREAFFRKVTFALKPPASDIGFLRKVERFPFVPSDESLLEQDCYEAYNIQVAGLVQRMRATGTKRVVIGVSGGLDSTHALIVAAKAVDLLGLPRENILAYTMPGFATGSESKTNALALMKSLQTNWQELDIRTTATQMLKDIGHPFGKGEKVYDVTFENVQAGLRTDYLFRLANHHGGIVIGTGDLSELALGWCTYGVGDQMAHYNVNAGVPKTLIQHLIRWVIASQQFSDDVNRTLASILSAEISPELVPVKPGEKPQSTEASVGPYELQDFNLFYTLRFGMRPSKIAFMALQAWKDVAKGEWPPAFPNDRRKAYELPEIRRWLEVFLRRFFAFSQFKRSAMPNGPKVSAGGSLSPRGDWRAPSDSSAAAWLEDLDRNVPN

SEQ ID NO: 15797 - protein, 471 aa, Leifsonia xyli subsp. xyli str. CTCB07
MAPNPLAPSWLKVPEDPNALVPGLWSRTVVREAGDGVLSVGGVPVTALAERFGTPLYVVDEAEVRERAADVRAAFQEAFAGVGTAAKVYYAGKAFLSIEVARWMAGAGLNIDVCSGGELAVALAAGVAADRLGFHGNNKSEAEIEAAVSAGVGAIVIDSVQEIDRVAAAASRHGVVQPVRLRVNSGVHAHTHAFLATAHDDQKFGIALPDAAAAVARIREHGSLAFLGLHGHIGSQIFGADGFAESASRLLAVHRELLAGGDVPELNLGGGFGIAYTAADDPAPIAELAHRIAETVAASCTRLGIPLPVVAFEPGRSIIGRAGLTLYTVGTTKEVLAAAQDGGETAVRRYVSVDGGMSDNARPALYEADYSARIAGRVSAAPPVLVRVAGKHCESGDIVVHAEYLPADTAPGDLLAVPATGAYCWTLASNYNYLGRPAVVAVRDGEARVIVKGESIEDLLARDAAYEGANG

SEQ ID NO: 15798 - protein, 462 aa, Xanthomonas campestris pv. campestris str. ATCC 33913
MSFESLGLAPFLLRALAEQGYETPTAIQQQAIPLVLAGHDLLAGAQTGTGKTAAFGLPLLQHLGTTPQPVNGPRKPRALILTPTRELATQVHDSLRGYSKYLRIPSAVIYGGVGMGNQLDALRRGVDLLIACPGRLIDHIERRSVDLSGIEVLILDEADRMLDMGFLPSIKRILTKLPRQDRQTLLFSATFEENIKQLALEFMRNPMQIQVTPSNTVAESITHRVHPVDGARKRDLLLHLLAQDSREQTLVFARTKHGSDKLALFLEKSGIKTAAIHGNKSQGQRMRALSDFKAGRVTVLVATDIAARGIDIDQLPKVINYDLPMVAEDYVHRIGRTGRNGSTGEAISLVAQDEAKLLRQIVRMLGRDVEIRDVPGYEPQTPIRWGNSAPGRAEQPGGDRAPRKSHARRPHGDAPRQAHAHAGPKKPGGQRSSGPRQATAGAGAGRRDGGRGGSGRPASRGA

SEQ ID NO: 15799 - protein, 474 aa, Exiguobacterium sibiricum 255-15
MSSKRLVIVGGGITGLAAAYYAERAFPDLNITLLEAGERLGGKVATYREDGFTIERGPDSYVARKHILTDLIEAIGLGEKLVRNNTSQAFILDTGGLHPIPKGAVMGIPTDLDLFRQTTLLTEEEKQEVADLLLHPSDSLRIPEQDIPLGEYLRPRLGDALVEKLIEPLLSGIYAGNIDQMSTFATYPQFVANEQKAGSLFEGMRLMRPLDQLPQTPQTTIKATGQFLSLETGLESLIERLEEVLERSEIRLETPLLAISREDGRYRLKTDHGPEYADYVLLTIPHPQVVQLLPDAHLPELEQLTTHSTATVTMIFDQQQSLPIEGTGFVVNRRAPYSITACTAIDQKWNHSAPDHTVLRAFVGRPGNDHLVHESDEVLQQAVLQDLEKICGRTLEPKQVIISRLMDGLPAYTVGHADRIQRVREEVLAQYPGIYLAGLAYDGVGLPDCVASAKTMIESIELEQSHTDESVNET

SEQ ID NO: 15800 - protein, 431 aa, Triticum aestivum
  misc_feature (280)..(280): Xaa can be any naturally occurring amino acid
  misc_feature (323)..(323): Xaa can be any naturally occurring amino acid
TSRSGMAGGDEGSLVPREVPGSYGMPFVSAIRDRLDFYYFQGQDKYFESRVERYGSTVVRINVPPGPFMARDPRVVAVLDAKSFPVLFDVDKVEKKNLFTGTYMPSTSLTGGFRVCSYLDPSEPTHAKVKQLLFSLLASRKDAFIPAFRSHFSSLLATVESQLVLGGKANFNTLNDATSFEFIGDAYFGVLPSASDLGTTGPAKAAKWLIFQLHPLVTLGLPMILEEPLLHTVHLPPILVSGDYKALYKYFNAPATKALDTAQGLGAERDEACHNLLFAXVTIKGLQVCPGIPRAPGAEKIPKTVPKFAPGDPSSTGRPKMTXHRGERLAGRPRVFGSTAREFVGDRFVGEEGRKLLQYVYWSNGRETESPSVDNKQCPGKNLVVLVGRLLVVELFLRYDTFTADVGVDLLGTKVEFTGVTKATSGPESAV

SEQ ID NO: 15801 - protein, 107 aa, Erysimum cheiri
LGLWDTAGQEDYSRLRPLSYRGADIFVLAFSLISKASYENVLKKWMPELRRFAPNVPIVLVGTKLDLRDDKGYLADHTNVITSNQGEELRKQIGAAAYIECSSKTQQ

SEQ ID NO: 15802 - protein, 312 aa, Medicago truncatula
MGEWIPQSGNNNGSYFQFPPHAPASAPPPPHPPHGHGHGLPPSPIRFSDRERYLAELLAERQKLGPFLQVLPQSTRLLTQEIRRISSAGSGFIMEHDHPDSSTTPFRPPLPQHPITRPMDFDWPHREDNGNIQRMGSFQASPVGWHGPQGIPTTPIVKRVIRLDVPVDKYPNQYNFVGRILGPRGNSLKRVEAMTECRVYIRGCGSVKDSIKEEKLKDKPGYEHLKEPLHLLVEAEFPEDIINSRLDHAVAVLENLLKPVDESLDHYKKQQLRELAMINGTLREESPSMSPSMSPSMSPFNSNGMKRAKTGR

SEQ ID NO: 15803 - protein, 455 aa, Vibrio angustum S14
MFGIFKPKAHIAPLENSKVDSTYSRLRWQLFFGIFFGYAGYYLVRKNFSLAMPYLIDEGFSRGELGVALAAVSIAYGLSKFLMGNVSDRSNPRYFLTAGLVMSSLVMLCFGFMPWATGSVAAMFILLFLNGWFQGMGWPACGRTMVHWWSRKERGEIVSVWNVAHNVGGGLIGPMFILGLWAFNDDWRTAFYVPALFALLVAFFVWLTVRDTPQSCGLPPIEEYKDDYPEGYDKSFETEMTAKEIFFKYIFNNKLLWSIAIANAFVYLIRYGVLDWAPVYLKEAKGFSVDKTSWAYFLYEWAGIPGTLLCGWISDKLFKGRRAPAGILFMVLVTLAVLVYWFNPAGNPTIDMLALIAIGFLIYGPVMLIGLYALELAPKKAAGTAAGLTGLFGYLGGAVAANAVLGYTVDLYGWDGGFIILVGSCVTSIVCFVYALLGERALHERKAKEKAALAQ

SEQ ID NO: 15804 - protein, 118 aa, Geobacter sulfurreducens PCA
MNKIDAIELEQMKKNIPPFKPGDTLKVHVKIVEGDKSRIQAFQGVCISRQNGGIRESFTVRKISNNIGVERVFPLHSPTVDAIEVITRGHVRRAKLYYLRKLRGKAARIREKKYVAAQ

SEQ ID NO: 15805 - protein, 452 aa, Pseudomonas syringae pv. tomato str. DC3000
MAFDFDLFVIGAGSGGVRAARFAAGFGARVAVAESRYLGGTCVNVGCVPKKLLVYGAHFSEDFDHAKGFGWSLGEASFDWSTLIANKDREINRLNDIYRKLLVDSGVTLLEGHAKIVGPQQVEINGQTHSAERILIATGGWPQVPDVPGREHAITSNEAFYLKALPKRVVVVGGGYIAVEFASIFNGLGADTTLVYRGELFLRGFDGSVRSHLHEELLKRHMTIRFNSDIERIDKQSDGSLLLSMKGGGTLETDCVFYATGRRPMLDNLGLDSVDVKLDEHGYIKVDEHYQTSEPSILALGDVIGGVQLTPVALAEGMAVARRLFKPEQYRPVDYNHIPTAVFSLPNIGTVGLTEEDAIKAGHDVQVFESRFRSMKLTLTDDQERTLMKLVVDAKTDRVLGCHMVGPDAGEIVQSLAIAIKAGATKQVFDDTIGVHPTAAEEFVTMRTPAKR

SEQ ID NO: 15806 - protein, 590 aa, Zea mays
  misc_feature (66)..(66): Xaa can be any naturally occurring amino acid
  misc_feature (104)..(104): Xaa can be any naturally occurring amino acid
  misc_feature (108)..(108): Xaa can be any naturally occurring amino acid
  misc_feature (117)..(117): Xaa can be any naturally occurring amino acid
  misc_feature (122)..(122): Xaa can be any naturally occurring amino acid
  misc_feature (165)..(165): Xaa can be any naturally occurring amino acid
MAQLVETYACSPATERGRGILLAGDPKTDTIAYCTGRSVIIRRLDAPLDAWAYPDHAYPTTVARFXPNGEWVASADASGCVRVWGRYGDRALKAEFRPLSGRVXDLRXSPDGLRIVXSGDGXGKSFVRAFVWDSGSTVGEFDGHSKRVLSCDFKPTRPFRIVTCXDHSNFVNCIRYAPDGSKFITVSSDKKGLIYDGKTGEKIGELSTEGNHTGSIYAVSWSPDSKQVLTVSADKSAKVWDIMEDASGKLNRTLSCPGIGGVDDMLVGCLWQNDHLVTVSLGGTFNVFSASNPDQEPVTFAGHLKTVSSLVFFPQSSPRTILSTSYDGVIMRWIQGVGFGGRLMRRNNTQIKCFAAVEEELVTSGYDNKVFRIPLNGNQCGDAESVDIGGQPNALNLAIQKPEFALITTDSGIVLLHNSKVISTTKVNYAITSSSVSPDGTEAVVGAQDGKLRIYSISGDTLTEEALLEKHWGAITSIHYSPDVSMFASADTNREAVVWDRASREVKLKNMLYHTARINSLAWSPDSRLVATGSLDTCAIVYEIDKPVASRVTIKGAHLGGVHGLTFLDNDILVTAGEDACIRVWKVVQQ

SEQ ID NO: 15807 - protein, 328 aa, Bradyrhizobium japonicum USDA 110
MSIGKTGKILLADIGGTNARFALSQSEPGNGDQTGSIDYVKVADFPTVQEAIVDVLARRAGGEPPQRAVLAVAGPVTNNRCVMTNSPWVIDGNELQPTLGFDSVHVLNDFEVVAWSLPALRSADLIPLGGQDGLPGEPLLVVGPGTGFGVSCLVERYGARLAVVTEAGHATLPAENEREERVIASLRRRFGHVSIERGALSGSGLQSLYEALAEIDGVQVPHRDAAAITKAALDGSCPVSRATLEMFCATLGSVAGNLAVTFGARGGVYIAGGIVPRFPEFLAASAFRARFEAKGRFQDYLRNIPTRLVTKPDASFVGLKMFADHNPD

SEQ ID NO: 15808 - protein, 514 aa, Oryza sativa
MAMAAAMGVASPYHAAHAAASTSCDSLRLLVAEGRPRRPRGVASSSSSSSSAGRRRRPLVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLPSGTVI

SEQ ID NO: 15809 - protein, 242 aa, Zea mays
MRKAYRDSIKVLEADIQHANTLASEFPRDYDGACLQMRLSYSPAAHIFLFLVQWTDCSLAGALGLLRILIYKVYVDGTTTMSTHERKASIKEFYAVIFPSLLQLQRGITDVEDKKQKAVCMEKYRKKDEDGRDTLSDIDVEREEECGICMEMNSKVVLPNCTHAMCIRCYQDWSSRSQSCPFCRDNLKKTCPSDLWIYVEDQDVVDMETVSSENLRRLFMYISKLPLIVPDVIFSVYDSHIK

SEQ ID NO: 15810 - protein, 478 aa, Burkholderia mallei ATCC 23344
MKTCEQFYIGGAWRPSTGKGMIDVIDSGTEAVIGRVPEGTAEDAKAAVAAARAAFDGWAATPPAERARYLHKITENLKARSEELAQSITGEVGMPIKLSRAIQVGGPIYNWGAYAKLAETFAFEEQVGNSLVVREPVGVVAAITPWNYPLNQITLKVAAALAAGCTVALKPSEVAPLNAFILAEAIHDAGLPAGVFNLVCGYGPVVGEALASDADVDMVSFTGSTRAGKRVAELAAAGVKRVALELGGKSASVILDDADFAAAVKGTVSACYLNAGQTCSAHTRMLVPESRYEEARDLAKAAAQAYVAGDPRDDATRLGALASSVQQKRVQDYIRRSIDEGAELVTGGLGMPEGITRGFFVKPTVFGRVKPDATIAQEEIFGPVLSILTYRDEDDAVRIANDSPYGLGGAVWAGSDERAMRVARRIRTGQVDINGGAWNMAAPFGGFKQSGIGRENGVYGLDEYLEYKSMQLRPHKRA

SEQ ID NO: 15811 - protein, 340 aa, Methylococcus capsulatus str. Bath
MNNHAISDPGAADLRDSREVFAGIRRLVDGEAAAVDSLILRELHSDVVLINQIGQYIVGSGGKRLRPMLHLLSAKALGYPGDHHITLAAVIEFIHTATLLHDDVVDESALRRGQDSANALWGNSASVLVGDYLYSRSFELMVRVQDMRVMDILSRTTTAIAEGEVLQLLNCNNPATDEGRYLDVISRKTAILFSAAAQLAAVLAGSSHAVEESLKNYGTYLGIAFQLKDDVLDYKADPEEWGKNLGDDLAEGKPTLPLIYALSQSSGAEAELLRQAIEHGEREHFKKVYAVIESTDAISYTERRARDAANKAIEQVTHLPESGYKDALIALARFAVDRGY

SEQ ID NO: 15812 - protein, 291 aa, Methanosarcina acetivorans C2A
MFEGAMPALITPFTKDDRIDREGLRRNIAFVEEGGVSGIVPCGTTGESATLSALEHEEVIDIAVECAKVPVVAGTGSNNTGEALQFTKHAADAGVDGVLLISPYYNKPNPAGLLAHFKKIAEAVDIPMILYNVPSRTGQDMPVDVITKLAKVENIVGIKEASGSVGKVSQILEQTIDDDFVVLSGEDGLTLPIISVGGSGVISVAANIVPDKMSGMVSAALKGDYETARKIHFEIAPLIRALFLETNPIPAKKAAELIGLASGHLRLPLAPMSDANQLKLVTELKKLGVMK

SEQ ID NO: 15813 - protein, 220 aa, Medicago truncatula
MSSRRRVGEEEYDYLFKVVLIGDSGVGKSNLLSRFTRNEFCLESKSTIGVEFATRTLQVEGRTVKAQIWDTAGQERYRAITSAYYRGALGALLVYDVTKPTTFDNVTRWLKELRDHADANIVIMLIGNKTDLKHLRAVATEDAQSYAEKEGLSFIETSALEATNVEKAFQTTLGEIYRIISKKSLSTANEPAAAANIKEGKTIAIGGSETTNTNKPCCTS

SEQ ID NO: 15814 - protein, 203 aa, Medicago truncatula
MSSNEYDYLFKLLIIGDSSVGKSCLLLRFADDSYDDTYISTIGVDFKIRTVELEGKTAKLQIWDTAGQERFRTITSSYYRGAHGIIIVYDVTDIESFNNVKQWLHEIDRYANHSVSKLLVGNKCDLTDNKLVHTHTAKAFADELGIPFLETSAKDSINVEQAFLTMAAEIKNKMGSQPTGSKSAAESVQMKGQPIQQNTNCCG

SEQ ID NO: 15815 - protein, 357 aa, Geobacter sulfurreducens PCA
MEIRVAPLPAEQKKHKATDETALGFGRLFTDRMLVAEWKVGQGWVDARIEPYAPFSLDPACAVFHYAQEIFEGLKAYKWADGSIALFRPEMNARRFNHSAERLCMPEVPEDLFIGGIEQLVALERDWIPASAGTSLYIRPAMIAVEPALGVKPADHYYFFVILSPVGAYYASGFNPVKIMVEDQYVRAVPGGTGEAKTGGNYASSLRAGLEAKKKGFDQVLWLDGVHRRYIEEVGAMNMLFAYGKTIVTSPLTGTILNGVTRDSVLKLAASRGYTIEERLIDVNDLMADIRAGKVTEAFGSGTAAVVSPVGILAYKGESVTVGDGGVGPITRELYDTLTGIQTGRIPDTFGWTRKIA

SEQ ID NO: 15816 - protein, 253 aa, Rhodopseudomonas palustris CGA009
MIAPSLSSGVEQLGDMIAHASSIVPFTGAGISTESGIPDFRSPGGLWSRNQPIPFDEFVARQDARDEAWRRRFAMEQTFAKARPARGHRALASLYKAGKVPAIITQNIDNLHQVSGFAEHDVVELHGNTTYARCIGCGKRHELDWVREWFFRTGHAPHCTACDEPVKTATVSFGQSMPSDAMRRATELAQHCDLFIAIGSSLVVWPAAGFPMLAKECGAKLVIINREPTEQDEIADLVIRHDIGETLGPFVGN

SEQ ID NO: 15817 - protein, 468 aa, Streptococcus pyogenes MGAS315
MTKTLPKDFIFGGATAAYQAEGATHTDGKGPVAWDKYLEDNYWYTAEPASDFYNRYPVDLKLSEEFGVNGIRISIAWSRIFPTGKGEVNPKGVEYYHNLFAECHKRHVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDSGYSGEIGVVHALPTKYPFDANNPDDVRAAELEDIIHNKFILDATYLGKYSDKTMEGVNHILEVNGGELDLREEDFAALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDDGRIDYVKKHLEVISDAISDGVNVKGYFMWSLMDVFSWSNGYEKRYGLFYVDFETQERYPKKSAYWYKKVAETQVIE

SEQ ID NO: 15818 - protein, 706 aa, Bordetella bronchiseptica RB50
MYPSLPDRLLPGLPAPLGATSDGLGVNFAVFSANAARIELCLFDARGRKELARLPMPECTDEVWHGYLPDAQPGLVYGYRAHGPYNPRAGHRFNPHKLLLDPYATALTGALRWSDALFGYRMQHPRADLSMDRRDSAAGVPKAVVTEPAFHWGATRRPATAWAHTVIYEAHVRGVSMLRSDLREPIRGTCAALADPRFIDHLHRLGVTALELMPVHAFLQDRTLVERGLRNYWGYNTLAYFAPEPAYLADGQPHDLRRAIRRLHAAGIEVILDVVYNHTCEGNELGPTLSWRGLDNASYYRLVPGDERRYIDDTGTGNTLNLSHPRVLQMVMDSLRHWTTHYRVDGFRFDLGVTLGREGTGFDAGSGFFDALLQDPVLARVKLISEPWDVGPDGYQLGRHPPGMAEWNDQFRDTARRFWRGDPGMAGALATRLTASRDVFDHRHRRPWSSINFAAAHDGFTLQDVVSFAERHNEANGEDGADGHGENYSSNWGVEGAASSAVIRETRARVQRALLATVMLADGTPMLLAGDEFGNSQGGNNNAYCQDGPMGWLDWAVAQSTPGRALTAYAARLAGLRRAHPSLRATRYGDPAHQWQEGLGAIDWFNGRGAPMTSADWDAPEGRLLVLRRALPDPAQPGRVDVTLLLCNAAAEPRPCVLPAPTLAWTLALDSASPEAPAAPCDGGEAIVGARAVLLLTASVDGAHAP

SEQ ID NO: 15819 - protein, 393 aa, Ehrlichia ruminantium str. Gardel
MSDHVKITPMTLNFGPQHPAAHGVMRLVLEMGGEVIERIDPHIGLLHRGTEKLIEYKTYLQALPYFDRLDYVSPMAQEHAYSLCVEKLLKCEVPIRAKYLRVIFCELTRILNHLLNISSQALDIGAMTPLLWMFEEREKILNFYERASGARFHSAYIRPGGVAADIPEDLIHDIFQFVNTFPKFMDDVDSLLTENRIWKQRNVDIGVVSKKQALNWGFSGPMLRACGIPWDLRKSQPYEIYDELEFKIPIGEKGDCYDRYLVRMAEIRESISLVEQCLNRIPDGPVKTDDRKIAPPKRSEMKKSMEALIHHFKLYSEGYIVPAGETYMAVEAPKGEFGVYIVSDGTNKPYRCRIRAPGFAHLQAIDMMAKGHMLADLTAIIGSLDIVFGEIDR

SEQ ID NO: 15820 - protein, 512 aa, Corynebacterium glutamicum ATCC 13032
MKVNLGIGSYPRRRATVRPESTAIEFEGTSITYGEFSKRVNRLGHALLDLGVAHQDRVAYVGFNHPALLEVFFSTNLIGATPVLVNPRLSANEIDYIIQDSGASIVFYGIDLIEHATYLQELHPEIIMVAVEGDEGPGLRRKALIEAASDADIDLEVSDDDIALLMYTSGTTGRPKGAMLSHRNLFFNYFNALLSQEIEQGAVLLSTAPLFHIAGLNMTTIPVMMKGGKVIIHREFRAEHVLDEIERSKVSESFMVPAMIDMLSNHPSFAERDLSSLRAIMVGGSPLSERALRIWQGRDVKIVQGFGMTETAPGACILEATDTSTHLGTAGRAHFFTDIKLVDPKTGEEVPTGEAGEVLIRGPHVMTGYWNRPEDTASALQNGWYHSGDIAIKDEDGYYTIKDRIKDMYISGGENIYPAEVEQALQELEAVLDAAVIGVPDERWGETGIAFVSIRESYLTNPPTGPELRELLGSVLARYKLPREIHIIEELPRNATGKIQKNILRDFTIPVS

SEQ ID NO: 15821 - protein, 200 aa, Ehrlichia ruminantium str. Gardel
MKLKSIMSQCQFIIGATSIKSLPDFSIPEVALAGRSNVGKSSLINAITNNRKNARISSKPGCTRQINFYLINKGLMVLVDLPGYGYSKADRATVNSYICLMEYYLLNRKNLSKVVLLIDAKVGFKEIDLDFIRWLEVHQILYQLVLTKIDRVQSNVLDVIVSDVQNFNLNFIIYPIINVSSKCKQGIEELIYEIAQCIKK

SEQ ID NO: 15822 - protein, 253 aa, Aspergillus flavus
MGHEDAVYLAKLAEQAERYEMVENMKVVASADVELTVEERNLLSVVYKNVIGARRASWRIVTSIEQKEESKGNESQVTLIKEYRQKIESELAKICDDILEGLDKHLIPSGQSGESKGFYHKIGDYHRYLAEFAIGDRRKGAADASLEAYKAATEVAQTDLTPTHPIRLGLALNFSVFYYEILNSPGQACHLAKLAFDDAIAELDTLSEESYKDSTLIMQLLRDNLLDTLSEESYKDSTLIMQLLRDNHPLDLV

SEQ ID NO: 15823 - protein, 102 aa, Glycine max
KPYSWRSKYGWTAFCGPVGPRGRDSCGKCLRVTNTGTGANTIVRIVDQCSNGGLDLDVGVFNRIDTDGRGYQQGHLIVNYQFVDCGNELDLTKPLLSILDAP

SEQ ID NO: 15824 - protein, 108 aa, Glycine max
MFLKQTSVGGGGNKKRVTGTWTFRFPKDPKFSPVRFLQQLGAKVASAIRVVSMRRRSSRKVSSSSLVRTRSVSDPPDSHRAKAVEDCIEFLHSSSSRERPTSVSESSL

SEQ ID NO: 15825 - protein, 463 aa, Triticum aestivum
  misc_feature (386)..(386): Xaa can be any naturally occurring amino acid
MLAGGVGSNRGGSSHLSSSGADLRGGRSFLFGNTWFMLSAYPARLLHTADRRAPAAAFVAAAIHRTPRVVRAHGGTGQGLLQRGIVMAACGYAFGRADLGAAAKRQLEKDSSSVAAHASRIVAMGSAGTAARPDVSFKYRGLEYCKKVGVSLRCREQWGMARTFWTSAVGPGRQLSFSVDPWARDFSTSCAAPYSAGATESQLTLDEALQEKQTDNSTVASDGKSPAPEKLKLVSGSCYLPHPAKEATGGEDGHFICIDEQAIGVADGVGGWADHGVDAGLYAKELMSKSMSAIKDEPEGAIDPSRVLEKAFTGTKARGSSTACIITLKEQGLHAVNLGDSGFIVVRDGRTVLKSPSQQHDFNFTYQLESGGGSDLPSSADVFHYXNLYDNEITAVVVEALRSGLGAQGTAQKIAALARERAEDKHRQSPFAAAAQEAGYRYYGGKLDDITVVVSYVMSAAAV

SEQ ID NO: 15826 - protein, 389 aa, Azoarcus sp. BH72
MISGLFDLPWWGYIVVALVLTHITIASVTIFLHRHQAHRALELHPIPSHFFRFWLWLTTGMVTKEWAAIHRKHHAKCETVDDPHSPQTRGIRKVMLEGAELYRAEAKNQETLQRYGHGTPDDWLERNVYRHNVVGISLMLVINVICFGPIGLTIWAVQMAWIPFWAAGVVNGLGHYWGYRNFDCTDASTNLFPWGILIGGEELHNNHHSFATSAKLSAKWYEFDIGWMYIRSMEILRLAKARKTIPQPRFGEAKRIVDFDTLQAVITHRYDVMTRYVASLKHTCSEEIEKLKLTHGSKFDAKAFRRWVLSGEERHLEAGEKQQLEIMLKDSKALSTVVAMREELAALWARSNATREQLLGQLHDWIARAEQSGIQQLQDFSLRLRRYAV

SEQ ID NO: 15827 - protein, 397 aa, Streptococcus pyogenes MGAS315
MPKLSKRVLEMKESVTLAAGARAKALKAQGRDVLNLTLGEPDFFTPKHIQDKAIESIQNGTASFYTNASGLPELKAAIATYLKNQYGYHLSPDQIVAGTGAKFILYAFFMAVLNPGDQVLIPTPYWVSYSDQVKMAEGQPIFVQGLEENQFKVTVDQLERARTSKTKVVLINSPSNPTGMIYGAEELRAIGEWAVHNDILILADDIYGSLVYNGNQFVPISTLSEAIRRQTITVNGVAKSYAMTGWRVGFAAGEPEIISAMSKIIGQTTSNLTTVSQYAAIEAFCGSQSSLEEMRLAFEERLNITYPLLCQVPGFEVVKPQGAFYFFPNVKKAMEMTGFSDVTSFANAILEEVGLAVVSGAGFGAPENVRLSYATDIKTLKEAVRRLHVFMESNEIN

SEQ ID NO: 15828 - protein, 448 aa, Triticum aestivum
MAELPLAGGLLDLRPGKLSPKPPPPPLPMPGADAPASPRPELRVDEPNPQIPHTAADAGETLASSEAPVPTVGSGVGVCVEAESELAGGRAVLPADCQLDTDGNGVELGALEESGTVVSDTTAPAGLEEVDADAGASPEGSATQDSDTGVDAESRGDDQGATESRVTIPPTAGEVHNKVDWEKNTSEVKSSDKTAPVASSALLLTSGAAILPHPSKAATGGEDAYFIEDYGWFGVADGVGQWSFEGINAGLYARELMDGCKKVIAESEGGSELAPEQVLSKAAAEASSPGSSTVLVAHFDGQLLHVSNIGDSGFLVIRNGEVCAKSKPMVYGFNFPHQIEKGVDPLTLVENYTIDIEEGDIIIAATDGLFDNVYEQEMAAMISKSLQADLKPAEMAEHLAARAHEVGRSGAGRSPFSDSAVAAGYLGFSGGKLDDTAIVVSIVRRSEA

SEQ ID NO: 15829 - protein, 267 aa, Arabidopsis thaliana
MGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNRNYVVDLYLERDIGDLEVASEAILRFPGVVKHGMFLGMATTLIVAGKFGVTVKDRFG

SEQ ID NO: 15830 - protein, 106 aa, Arabidopsis thaliana
MENTVGLYVIDVYIKPPIPKFSSLLKDSETRFLFLVVARGETSVLAGYFAWKTVSSSPEFDSPDELNEKQELNLKKKMENGFWVFVDMASGRYLWRNLKEMREKSQ

SEQ ID NO: 15831 - protein, 116 aa, Aspergillus nidulans FGSC A4
MSRQLISSEKFPLKPHNCPATKVPGLVFLAGQTATGEIKQATRTVLQNIKEVLELSGSSLEQVVKYNVYLADMKDFAAMNEVYIEFLPKPMPSRSCLQALPPGEGTVIEIECIAQV

SEQ ID NO: 15832 - protein, 464 aa, Oryza sativa (japonica cultivar-group)
MAALLLWLSWLLLSLLSIYLLDLLAHSRRCLPPGPRPLPLIGSLHLLGDLPHRSLAGLAKTYGPLMSLRLGAVTTVVASSPEVAREFLQKHDAVFATRSTPDATAPARSAPTSSGQEKVPELVDHVAGLARDGTAVDIGRVAFTTSLNLVARTIFSHDLTSLDDHGASKEFQRLITDVMEAVGSPNLSDFFPALAAVDLQGWRRRLSGLFARLHRLFDAEMDHRRLHGMKEKDGDFLEVLLRLAARDDDTARLDGDTLRSLFTDLFTAGSDTSSSTVEWAMAELLQNPISMAKLCDELRRVVGSRRRIEESEIGQLPYLQAVIKETFRLHSPAPLLLPRQATRTIQIMGYTIPKGTRVLINVWAMGRDEDIWPEAGKFIPERFLERTIDYKGGDLELIPFGAGRRICPGMPLAVRMVHVLLASLLIHFKWRLPAEVEGNRIDMTEKFGVTLAKANHLCAMAAPT

SEQ ID NO: 15833 - protein, 629 aa, Corynebacterium glutamicum ATCC 13032
MPPAPKLAALGLQHVLAFYAGAVIVPLLIAQSLNLDTATTIHLINADLLTCGIATLIQSVGIGRHIGVRLPIVQGVTTTAVAPIIAIGLGVTDGQGGVASLPAIYGAVIVSGIFTFFAAPVFARFLKFFPPVVTGTVLLVMGASLLSVSANDFVNYADGVPAARDLAYGFGTLAVIILAQRFFRGFMGTLAVLIGLVGGTAVALILGDANLDEVGNAEAFDITTPFYFGVPEFNAVAIFSMIIVMIITMVETTGDVFATGEIVGKRTRRSDVTRALRADGLSTLMGGVMNSFPYTCFAQNVGLVRITGVKSRWVAAAAAGFMIILGVLPKAGAIVASIPSPVLGGASLALFANVAWVGIQTIAKSDLADSRNSVIVTSALGLAMLVSFRPDVAQAFPEWARIFVSSGMSVGAITAILLNLLFFHVGRQSGGQVATSKSGERINLDAVNKMDRTDFVETFAPLFNSKTWPLETAWESQPFANVTELREAIQVAVLTAPLSDREELIHDYPDMAQLILATEEEAATISQDRGSIGLDDLDDVDQEKLITVTEQYRERFNMPYVAYFDTMDSVDTVVAAGLRRLDNSDEQEHRQALSEIIEIANDRFDILLADANPARSAFDRKFTETDFLG

SEQ ID NO: 15834 - protein, 625 aa, Bradyrhizobium japonicum USDA 110
MQSRLLSQPSASRVAQFSVDTTPVAAGASLLTMKLETVSVDFTDEQKRYLEGFTTGLQISRVGRGLGGGSGKANAEPTGPDAVHIKAQDKVIASGKKLADQEKFKRDEHPFDAYPRLRQQALDNAPPSPADNFRWRYYGIFYVAPTQDSYMCRLRIPNGIMKHWQLSGLADLADDLCGPYSHVTTRANLQLREIPPKHAVKLIEGIQDLGLCSRGSGADNIRNVTGTPTAGIDPQEIIDTRPFAREWHYHILNDRSLYGLPRKFNVAFDGAGRIAVLEETNDIAFTAFEVKDGFGVEPGVWFRLGLGGITGHKDFAKYSGIIVKPEQATAVADAIVRVFIDHGDRTNRNKARLKYVLDAMGHDGFLKLVEERLKTPFTRVPEEAFAPRPAADRMAHIGVHKQKQDGLNWIGVSLTLGKLTCDQMRSLAKVARDLGDGEIRLTVWQNLLIPGVRDENVELAIAAIKQIGLAVEASHIRAGLIACTGNAGCRFAASNTKRHAAEIGDWCEPRVEMDKPVNIHVTGCHHSCAQHYISDIGLIGARVPVNEDDTVEGYHLFTGGGFGPDADVGQEVYHDLKAEDAPKTVEALLKAYIAHRASPDETFLSFARRHDGETLRKLADAQVSA

SEQ ID NO: 15835 - protein, 308 aa, Burkholderia mallei ATCC 23344
MPATFPDVLALGEAMVEFNQARLGEPNYLQGFGGDTSNFCIAAARQGARAGFVSAVGGDHFGRLLLDLWRGERVDTSYVRVDDGAPTGVYFVSHGEHGHAFDYLRAGSAASCYAIRDLPLDALAAARFVHLSGVSLAISTSACDAAFAAIAHARANGARVSFDTNLRLKLWPLPRARAVMTEALRHTDVCLPSWDDVTALTGLDERDAIVDALLALGPRVVALKLGREGAYVATPGERRVVPGFVVDALDATGAGDCFGGAFVARLAAGDDPFSAARYANAAAALSTQGFGAVAPIPSRDAVERLLGA

SEQ ID NO: 15836 - protein, 436 aa, Rickettsia prowazekii str. Madrid E
MTNGNNNNLEFAELKIRGKLFKLPILKASIGKDVIDISRVSAEADYFTYDPGFMSTASCQSTITYIDGDKGILWYRGYDIKDLAEKSDFLEVAYLMIYGELPSSDQYCNFTKKVAHHSLVNERLHYLFQTFCSSSHPMAIMLAAVGSLSAFYPDLLNFNETDYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSSENIPKYVAKAKDKNDPFRLMGFGHRVYKSYDPRAAVLKETCKEVLNELGQLDNNPLLQIAIELEALALKDEYFIERKLYPNVDFYSGIIYKAMGIPSQMFTVLFAIARTVGWMAQWKEMHEDPEQKISRPRQLYTGYVHREYKCIVERK

SEQ ID NO: 15837 - protein, 1074 aa, Coccidioides immitis RS
MQELFDVFEDAPASGATSTHPVIPRAKKDTTKKRQANGEVKQNTPIADVNGAEQPSGDSAQNESEAFAEFEAEQPEAKRPRVEPEPVVADTFETEQSREIAASAGLQPAQEGAAVVLSHQVRHQVALPPNYPYVPISQHKPPETPARTWPFKLDPFQQVSIASIERGESVLVSAHTSAGKTVVAEYAIAHCLKNNQRVIYTSPIKALSNQKYREFASEFGDVGLMTGDVTINPTATCLVMTTEILRSMLYRGSEIMREVAWVVFDEIHYMRDKTRGVVWEETIILLPDKVRYVFLSATIPNAMQFAEWITKTHSQPCHVVYTDFRPTPLQHYLFPAGGEGIFLVVNEKGNFKEENFQKAMGAIADKKGDDPADANARGKGKGKNKKTNKGGEKGPSDVFKIVRMIMMKSYNPVIVFSFSKRECEAHALTLKNLSFNDDSEKEMVTKVFNSAIEMLSDEDKKLPQIENILPLLRRGIGVHHSGLLPILKETIEILFQEGLIKVLFATETFSIGLNMPAKTVVFTNVRKFDGTSQRWLTPSEFVQMSGRAGRRGLDDRGIVIMMVNEEMDPTVVKEIVRGEQDKLNSAFYLGYNMILNLLRVEGISPEFMLERCFAQFQSASSVGTLEKELEDLENQRENMTISDEGTIREYYDSRQLLATYNDEMRITMCRPTYCQRFLDPGRLVHVQHGKIDFGWGLVVNFQQRKPPKNVLEEYPPHESIIVDVLLDICENASFHMTGDQTLPPGVRPARKGEKSTMAVVPVVLSCIQAFSTVKVTLPKDLKSAESKKYTKKILTEVQRRFPDGVAVLDPIQDMGIKEEPFKMTMRKVEVVEARLLSNPLHNSPRLPELYDQYATKVELVNKIKETKRKISDAMSIIQLDELKCRKRVLRRFQFINASDVVQLKARVACEISSGDELMLSELLFNGFFNTLTPEQCAAVLSVFVFEETAKETPAITNEELAKPLREIQAQARTVAKIAQESKLAVNEEEYVQSFRWELMEVIYKWAKGGSFAEICKMTDVYEGSLIRTFRRLEECMRQMAQAAKVMGSSDLESKFEASLSLVKRDIVAAQSLYL

SEQ ID NO: 15838 - protein, 293 aa, Kluyveromyces lactis NRRL Y-1140
MEFTDLLYHHALAFEDAALFYYDKDELQNLHQTLNNMVNSLRNGGKLIFVGCGKSYKIICKTVAMLTSMGIPARDLHPIEAMHGDMGCCQPNDSLIFCSTSGETDEVLNLLRYLKAGGSYWEKCIRIAVTGNRNSTLATHCQHTIVVPQADRFKEPKFQRGLRAPTISTSLMVTVLDCICIEISKAWFGNDPVKREIFFNERHPGGGIGKITSSTNLTQLVRAPTDYQTPQYHSYMVKRNETLTETQFLSLLITFDYIQFSPKNVRVPTCLLREEHKRAVHSGTVPEWFRRYL

SEQ ID NO: 15839 - protein, 366 aa, Exiguobacterium sibiricum 255-15
MKADLLGVINLSGEEGFFKELTEHRNLAAVPFAGRYRLIDFTLTNMVQNEIANIGVFTLEKYRAMMDHLGSGKEWDLDRSNGGLYIFPPALSQDAHEFRGDLSNFHLHRDFFLRSKENYVVISGSNILSAVDYRDVLREHKASNADITVVYTKRDLPCNYCRPIRFSDQNRVTAIGSRGYEPSDETFYMETVVLSKNLFVRLVDEAIGRGEYDLLQSIIRSQLNRLHVHGYEYTGTSQVIHSLRSYYRESMLLLEQWGAINDFQHVYTKIKHEPPTRYLPGSTIKNSLVANGCKLEGTATDSILFRGVKVGKHARIKNSIIMQKSVIEEGAVVEYAILDKEVTVKRGQVIRGTAEEPIVIKKQTIV

SEQ ID NO: 15840 - protein, 588 aa, Bradyrhizobium sp. BTAi1
MDQATQPRSAGHGLRSVADNVWIVDAGRISAAGVPLPIRMVVIRLSSGDLLLHSPTRFSHALREELERLGPIKYLLAPNVAHWMFLRDWQAALPNAQVYAAPGLARRAQVRRSGLRIDRELTDVTPDAWSQDLQIVLISAPLFSEVELFHRPSRTLILTDLVQNLAPEGLGAVRRTVARLLGITAPDGKAPAYLRLVLRLGGRAVRLAAARLITLAPERVIFAHGRWFDTGGTQRLRASLGWLLDSAPEARRLMRDLRGTRVVVTGASSGIGRATALALAREGASVVLAARRENVLKDVALECETLGGRAIAVATDVTDADAVKRLAEQAVRTFGGVDVWINNAGTGVFGPYQDADMALHRKTVEVNLLGTMNGAYAVLPIFLRQRRGTLINNISLGGWAPTPFAAAYTASKFGLRGFSASLRQELTAHKDVHVCSVFPAMVDTPGFVHGANVSGRTLDPGPLLYRPEDVAETFVQLVRTPRDEVAVGWPARLGQISYALARRPTEQLMSTAFRFLLSRANSAPRSTGAVLAPIAAGTAVSGGWLGRKKLPPAGQLSRIGLAVGIGGIALMLLARRRPPSAPRARAHR

SEQ ID NO: 15841 - protein, 444 aa, Arabidopsis thaliana
MVRRQEEEKKAEKGMRLGKYELGRTLGEGNFGKVKFAKDTVSGHSFAVKIIDKSRIADLNFSLQIKREIRTLKMLKHPHIVRLHEVLASKTKINMVMELVTGGELFDRIVSNGKLTETDGRKMFQQLIDGISYCHSKGVFHRDLKLENVLLDAKGHIKITDFGLSALPQHFRDDGLLHNTCGSPNYVAPEVLANRGYDGAASDIWSCGVILYVILTGCLPFDDRNLAVLYQKICKGDPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVNQEERTQKGQVGLSVTAEVFEIKPSLNVVELRKSYGDSCLYRQLYERLLKDVGTSSPEQEIVT

SEQ ID NO: 15842 - protein, 386 aa, Exiguobacterium sibiricum 255-15
MAKKNVVAMLLAGGEGKRLGALTKHTAKPAVAFGGKYRIIDFPLSNCTNSGIDTVGVLTQYEPLELNRYLGIGSAWDLDRRNGGLTILPPYQAQNGKNWYEGTANAIYRNMSYINQYDPDYVLVLSGDHIYKMDYEKMIEEHRQGGADVTISVREVPWEEAPRFGILNTDEDLRINEFEEKPENPKSNLASMGIYVFNWDVLKRHLIQDAGDAESSFDFGKNIIPNMLYENLNIRAYKFKGYWKDVGTIQSLWEANMDLLEADPEFDLYEPSWKVHSVNPNQQPQYIGNNASIETSIINEGCHIEGEINHSVLFYGVDVAEGSLVKDSVIFPNVKIGKDVTIHRAILADGVVVEDGATIGTPNGEVFVIEANSVIPKNEVVKEAIQ

SEQ ID NO: 15843 - protein, 459 aa, Mycobacterium smegmatis str. MC2 155
MSHKQSRGPHVAPAYTGRLAMAPVPSLRLPDEAMDPSAAYRFIHDELMLDGSSRLNLATFVTTWMDPEAEKLMAETFDKNMIDKDEYPATAAIEARCVSMVADLFHAEDLRDDDPASAVGVSTIGSSEAVMLAGLAMKWRWRAKAGDWKGRTPNLVMGANVQVVWEKFCRYFDVEPRYLPMAEGRYVITPEQVLDAVDEDTIGVVAILGTTYTGELEPVAEICEALDKLAAGGGVDVPVHVDAASGGFVVPFIHPDLVWDFRLPRVVSINVSGHKYGLTYPGVGFVVWRNKEHLPEELVFRVNYLGGDMPTFTLNFSRPGNQVVGQYYNFLRLGRAGYTQVMQCLSQTARWLGDELRDSEHFELISDGSAIPVVAFRLKGDPGYTEFDISQALRAHGWQVPAYTMPEGAEDVVVLRVVVREGFSADLARALKDDIITVLGQLDALKPRGQFDQLQPFAH

SEQ ID NO: 15844 - protein, 1081 aa, Ralstonia solanacearum GMI1000
MPKRTDIKTILIIGAGPIIIGQACEFDYSGAQACKALREEGFKVVLVNSNPATIMTDPSTADVTYIEPITWEVVERIIAKERPDAILPTMGGQTALNCALDLHRHGVLEKYNVELIGASPEAIDKAEDRQKFKEAMTKIGLGSAKSGIAHSLEEALAVQAQIARETSSGGYPIVIRPSFTLGGTGGGIAYNREEFEDICKRGLDLSPTNELLIEESLLGWKEYEMEVVRDKKDNCIIVCSIENLDPMGIHTGDSITVAPAQTLTDKEYQILRNASLAVLREIGVDTGGSNVQFSINPEDGRMIVIEMNPRVSRSSALASKATGFPIAKVAAKLAVGYTLDELKNEITGGATPASFEPSIDYVVTKVPRFAFEKFPQADSHLTTQMKSVGEVMAMGRTFQESFQKALRGLEVGVDGLDEKSSDRDEIIAEIGEPGPDRIWYLGDAFRLGLSIDEVYAETAVDPWFLAQIEDIVRTEALVKARTLDSLSAAELRLLKQKGFSDRRLATLMKTTAQAVREKRIAEKVRPVYKRVDTCAAEFATNTAYLYSTYEAEHGECEADPTERKKIMVLGGGPNRIGQGIEFDYCCVHAALALREDGYETIMVNCNPETVSTDYDTSDRLYFEPVTLEDVLEIVDKEKPVGVIVQYGGQTPLKLALDLEANGVPIIGTTPDMIDAAEDRERFQKLLHDLGLRQPPNRTARAEDEALKLADEIGYPLVVRPSYVLGGRAMEIVHEPRDLERYMREAVKVSNDSPVLLDRFLNDAIECDVDCLSDGKRVFIGGVMEHIEQAGVHSGDSACSLPPYSLSQATVDELKRQTAAMARALNVIGLMNVQFAIQQKGGEDIVYVLEVNPRASRTVPYVSKATGISLAKVAARCMAGQSLDEQGIHDEVVPSYYSVKEAVFPFNKFPGVDPVLGPEMRSTGEVMGVGRTFGEALFKSQLAAGSRLPEKGTVLMTVKDSDKPRAIEVARTLHTLGYPIVATRGTASAIEAAGIPVRVVNKVKDGRPHIVDMIKNGELALVFTTVDETRAAIADSRSIRTAALANRVTYYTTIAGARAAVEGLKHLQNLDVYDLQGLHASL

SEQ ID NO: 15845 - protein, 305 aa, Pseudoalteromonas tunicata D2
MRSIEQLKNASLITAIKTPYQANGEIDLNAYDQLVLAQIDADVDGIVVGGTTGEGQLMNWEEHLMLIAHSVAKFSDKLIIVGNTGSNNTREAIKATQYGFATGMDAALQINPYYGRSSIAGVKEHLSRVLALGPAFIYNVPGRTGQDLTPEILIPFASHPNFIGIKECAGNERIADYERQGIACWSGNDDEAHDARHLFGSHGVISVTSNLVPNIMRQLMDKSNPALNTHTQPLMNWLFCEPNPIAINTALMMTGAVKPVFRLPYVPLTHSQREIGLSLMSEFDVNELVGGKANHLSDDAFILTA

SEQ ID NO: 15846 - protein, 528 aa, Fusarium heterosporum
MALTVFEHASALWYRLQGSVSLAVLSTLAVVIAGWYILSSISLYFSRRQFIALHGCKPIANRYPSKWFGINFILEAGRTYKERRYLDALTWNFRNIGYTHEVRALGGTSVWTVEPENIKAVLTSKFKDYSLGNRPAVMGPLLGRGVFVTDGEEWSHSRALLRPNFAKDQVADLSMIERHLQQLLKMIPDDGKAIDLNDLILSFTMDSSTEFLFGESTETLTSGINRQFSDAFAYSLHDISSGLRLGPWYKFRRTDPKAVQSHRICREYADKYVEKALEYRRNYIKSVEDGATDKPSIDGGDSRRTFLRELALATDDREKLRDELLSLLLAGRDTTASLIGSLLFSLAKKPECWEKVRSEIEETLHGDLPSYEQLRNFKYAKYRVNEALRLYPPVPNNAKIGIRDTVLPRGGGPEGRDPIIVPKDAPVIYTVYALHRRYDLFGDDADDFRPERWENQRYTWEFLPFNGGPRICLGQQYALVETLYVLVRFAQHFSKIESMDPEPWTESLALTVSSGNGVKVKLERGSSE

SEQ ID NO: 15847 - protein, 148 aa, Zymomonas mobilis subsp. mobilis ZM4
MKSVSALIAGVLAILGVSPVSAEPQFLNSGKVLKGDFPFSEAVKVGNTIYLSGQVGIVPATQQLAAGGIQAESHQVMQNIKAVLEVHGYQMDNLVKCTAFLADMKEWPAFNEIYKGYLVEGKYPARSALGANGLALGARVEVECIASK

SEQ ID NO: 15848 - protein, 441 aa, Salmonella enterica subsp. enterica serovar Paratyphi A str.
MYHGQLKNILLLSLRFIMDKLSYASDSSTSAWNTYLQQIERVAPYLGELSPWVDTLRHPKRALIVDIPVQMDDGTIRHFEGYRVQHNLSRGPGKGSVRYHPDVDLNEVMALSAWMTIKCAALNLPYGGAKGGIRVDPFSLSEGELEHLTRRYTSEIGIIIGPQKDIPAPDVGTNGKVMAWMMDTYSMNHGTTITGVVTGKPIHLGGSLGREKATGRGVFVSGLEAARRANIAVEGARVAVQGFGNVGSEAARLFAGAGARVVAIQDHTATLFNATGIDMKALTAWQTEHKQIAGFPGAETIASDAFWRLEMDILIPAALEGQITRQRAEALTCKLVLEGANGPTYPDADDVLASRGILVVPDVVCNAGGVTVSYFEWVQDMASFFWSEEEINARMDKIMTDAIVHVWEKAAEKSCSLRTAAYIVACERILLARKDRGIYPG

SEQ ID NO: 15849 - protein, 394 aa, Zymomonas mobilis subsp. mobilis ZM4
MKIAKRAERIEPFYVLEVAKAAAQLSQDAGNDTKPMIHLTIGEPDFTAPPLVQEAAIRAIRAGATQYTPAIGLGLLRERISDWYRQRFGIDVPARRIVVTAGASAALQLICTALIEAGDEVLMPDPCYPCNRHFVIAAEGCPVVVPTTAAERYQLSAEKVAENWSDKTRGVLLASPSNPTGTSIHPEELRRIHAFVQSKGGITLLDELYLGLSHDDAFGQTGLTLDENVISINSFSKYFSMTGWRLGWLVAPEPLVPVIERLAQNFFLCPSTVSQHAALACFEPESIAEYERRRAEFKARRDWFIPALEKIGFKVPVAPDGAFYAWADCSEWFHAWDVPSSWEFAFEAMKRARVAISPGRDFGAAETARFVRFSTANSMDNLQEAVARLSALRP

SEQ ID NO: 15850 - protein, 568 aa, Glycine max
MAPSFAINGGFPGARVTPPSVTGRFAAVYSEVQNSRIDHELPLPSVLKNPFIIVDGPQSSAAGNPEEIAKLFPKLFGQPSAALVPSDSHAPHANRKLKIGVVLSGGQAPGGHNVISGIFDYLQDLAEGSTLYGFRGGPAGIMKCKYVELTSDYIYPYRNQGGFDMIRSGRDKIETPEQFKQAEETVQKLNLDGLVVIGGDDSNTNACLLAEHFRSKNMKTRVIGCPKTIDGDLKCKEVPTSFGFDTACKIYAEMIGNVMIDARSTGKYYHFVRLMGRAASHITLECALQTHPNITIIGEEVAAKKMTLKDVTDYIVNIISKRAEDNYNYGVILIPEGLIDFIPEVQHLIAELNEILANDAVDEGGLWKKKLTDQSLKLFEFLPKAIQEQLMLERDPHGNVQVAKIETEKMLIQMVETELEKRKQQGTYKGGFRGQSHFFGYEGRCGLPTNFDSTYCYALGYGAAALLQSGKTGLISSVGNLCAPVEEWTVGGTALTSLMDVERRHGKFKPVIKKAMVELEGAPFKKFASLRDEWALKNCYISPGPIQFTGPGSDAINHTLLLELGAQA

SEQ ID NO: 15851 - protein, 376 aa, Oceanobacter sp. RED65
MSDTFIKSKAAIAWGPGQPLSVEEVDVMMPRKGEVLVKIIATGVCHTDAFTLSGEDPEGNFPAILGHEGGGIVEAVGEGVTSVAVGDHVIPLYTPECGECKFCTSGKTNLCQKIRETQGKGLMPDGTSRFYKDGKPIYHYMGTSTFSEYTVLPDISLAKVNKSAPLEEVCLLGCGVTTGMGAVMNTAKVQAGDSVAIFGLGGIGLSAIIGATMAGASRIIGIDINESKFELAKQLGATDCINPNDYDKPIQEVIVELTDGGVDFSFECIGNVDVMRSALECCHKGWGESVVIGVAGAGQEISTRPFQLVTGRVWRGSAFGGVKGRSELPGIVEKYLAGEFKLNDFITHTMGLEDINEAFDLMHEGKSIRSVIHYNK

SEQ ID NO: 15852 - protein, 126 aa, uncultured beta proteobacterium
MNKSIIQTADAPAAIGTYSQAVRVDHTVYMSGQIGLEPASMQMVEGIDAQIHQVFKNLAAVAAAAGGSLADVVKLNVFLTDLGHFPRVNEIMAGYFSQPYPARAAVGVSALPRGALVEADAVMVIG

SEQ ID NO: 15853 - protein, 219 aa, Zea mays
LLPPPPPPPAPRAPLAPRETLNPVTLAAGDRWSPASAAMFGTPNSPSLFGTPSSTPSFGTPSTTPAFGTPSSTPAFGAPSSTPAFGVPSSTPAFGAPSSTPAFWTPTSSPTFGTPSSTPAFGAPPSSSPSPFGFQQQVTPSPSPFGFGGGAGGQITTQMAPVAPLPLSPSDRDIQAMVDAYKEDPGNPRYAFRHLLFSVTDPSQRVKPVAASDIMWAEA

SEQ ID NO: 15854 - protein, 463 aa, Listeria innocua Clip11262
MTKVNSFFRKKSFHNPATDKHHLNKTLGAFDLTMLGVGAVVGGGIFILPGQVASVIAGPGIIISFIIAGIACCLAALCYSEFASKLPVAGSAYTYSYHVFGEGVAWILGWSLILEYGLAVAAIASGWSSYMKSLLAGFDLHIPTAISSAYNPSAGTYFDLLAFVVVMVIGILLSFGIRESTRVNNIMVLVKIAVVVLFIIVGAFYVKPDNWTPFLPFGVQGVITGASTVFFAYIGFDAVSSAAEEVKNPQKNMPIGIIASLAVCTLLYILLSAVLTGVVPYTDLVGVSAPVAFALQAINQNWIAGLLSVGAIVGMTTVVLVMSYGGTRLLFAMGRDGLLPKSFSKISKNDTPVRNTMIFATVMGLIASTVPMEDLAQLINIGTLFAFAMVSVGIFFLRRNPELNQKGFKTPFYPVVPALSFLLCVYLMLNLSKTTWIAFGVWFVLGIIVYTFYGRKHSALRLK

SEQ ID NO: 15855 - protein, 428 aa, Thermococcus kodakarensis KOD1
MTQLEEARKGVVTEEMKFIAEREGIDAEKLRRNVAKGYTVIFRNVRHDWVKPVAVGAGVRVKVNANIGTSRDIVDVKAEIEKAKVAVKYGADTIMDLSTGGDLDEIRKTIMHAVDVPVGTVPIYQAAEEMLAKGKAIIEMSEEDMWRAVEKHFKDGVDYTTIHVGVTKEVVEKMKRTKRAVGMVSRGGTFLAAWILHWGEENPFYKDYDYLLELAREYDVVLSLGDGLRPGGLPDAGDELQIAELYTLGRLVRRAREAGVQTMVEGPGHVPIDQIAAQVKLAKVATDNAPFYVLGPIVTDIFPGYDHITAAIGGAIAALNGADFLCYVTPAEHLGLPDVEHVRQGVIAAKIAAHAVNLTRFEADFKKDYLMALARGKLNWARQFELSMDKERFVEIRKERPTKTEACSMCGDLCAIKLINDMLAGERK

SEQ ID NO: 15856 - protein, 496 aa, Nicotiana tabacum
MISTMGLLQSWGGLGTSIASFIFMWDMIRRYCPPELIRASDKWTRRIRSFFYPFIQISISEFMSNNLKPHDAYAAVEAYLSVHLAKEAKKLRAETVHGGGKLVLSMDEHERVTDEFGGAKIQWISGKIVQRESKYLPEVERKYYKVTFHKKYRDMVTDTYLEHVIKTGKEIQMRNRKRKLYTNGHNKTTWSHIVFEHPATFDSLAMEAEKKREIVDDLLMFRESKDFYARIGKAWKRGYLLYGPPGTGKSTMIAAMANLLDYDVYDLELTSVRDNTELRRLLAETSSKSIIVIEDIDCSLDLTGQRKKKQEKPPEEKTSKTKKEVPRKDTEESGSRVTLSGLLNFIDGLWSACSGERIIVFTTNYVDKLDPALTRRGRMDKHIELSYCSFEGFEVLAKNYLLLDEHPLFEPIEMLMKETKIIPADVAESLMPSSPKEDAGKCLLKLIDALKQAKEMMIKKGKEESADKGVPEMKEDADVLQDMEDSADSLDGFTQN

SEQ ID NO: 15857 - protein, 349 aa, Glycine max
  misc_feature (74)..(74): Xaa can be any naturally occurring amino acid
  misc_feature (308)..(308): Xaa can be any naturally occurring amino acid
MPNDSVLSLFFFVTLFTCLLSATSHDDHIFLPSQLHDDDSVSCTATDPSLNYKPVIGILTHPGDGASGRLSNAXTGVSYIAASYVKFVESGGARVIPLIYNESPENLNKKLDLVNGVLFTGGWAVSGPYLDTLGNIFKKALEKNDAGDHFPVIAFNLGGNLVIRIVSEQTDILEPFTASSLPSSLVLWKEANAKGSLFQRFPSDLLTQLKTDCLVLHNHRYAISPRKLQYNTKLSDFFEILATSEDRDGKTFVSTARGRKYPVTVNLWQPEKNAFEWATSLKAPHTEDAIRVTQSTANFFISPRVRPXEARKSTNTPDAQKVRDNLIYNYKPTFGGTAGKGYDQVYLFE

SEQ ID NO: 15858 - protein, 480 aa, Coprinopsis cinerea okayama7#130
MTDLKLPEGFLFGFATAAYQIEGAINEGGRTPSIWDTFTRAKSPEGVPHIADESSGEFACDHYRRWKEDIGLLKSYGANSYRFSVSWSRIIDFSAGKDERGVTGRRDPANPEGIKFYRDILEELVKNNITPAITLYHWDIPQALEDRYGGWRNREVVNDFVHFAKVCFEAFGDLVKHWITLNEPWCCSVLGYGYGVFAPGRSSNRAKSAEGDSATEPYIVAHNLILAHAYAVKAYREEFSSQKGSIGITLDTFWYEPYDEEKDAAATQRAFDARLGWFADPIFKGHYPPSMKDISNGAIPQFSEEDIAVVKGSADFLGLNTYSSNLIRPRALKSIIEDAGSDSFKGKTTSTFKRKDGTELGRHSQGPPAKPTPSVTENGFPAKGENDLPVEEAIHDKDRVEYFRGYTQALLEAINIDKVPVKSYFAWSLLDNFEWADGYRTRFGVTYVDYKTFKRYPKDSARFLGKVCRFSTAKGVKLMV

SEQ ID NO: 15859 - protein, 567 aa, Zymomonas mobilis subsp. mobilis ZM4
MMVETFMSYQSQPAIPVKESRVTLLRNPLLNKGSAFSAEERKAFQLEGLVPAQIESINIQAERCYQQYKEQKTDLDRYIFLRALQDENETLFFHLVADHIADMMPILYTPTVGSACQNYSHLFRKSRGLFIAYPDRDKIGDILKQTEQENIKIIVVTDGERILGLGDLGVGGMGIPIGKLALYTACGGIDPATVLPIVLDVGTNNENLLNDPLYMGWHHKRITGDEYYSFVDRFVQAVMQQWPDVFLHFEDFAQKNALPLLKKYRDQYCCFNDDIQGTSAVALATLYSACKTRKTSIRDQRIIFLGAGSAGCGIAEQIVSAMVAEGLDEATARGQVYMVDRNGLITDDMQDIPDFQKKLAQPLSKLKNWKSQDQGFFLLDVVKQSKATVLIGVSGQKGLFTEEVIKTLASQCEAPFVMPLSNPTSHMEAIPEDILKWTEGKALVATGSPFSPVVINGKSFPIAQCNNAYIFPGIGLGVLAAKATRVTDNMMVAAAYALADTAPAAQNKGNAILPSFDDIEEVSYVIALAVAKAAVKDGVAEQKDETALLALIKGYYWHPEYRAYQLA

SEQ ID NO: 15860 - protein, 271 aa, Zea mays
  misc_feature (37)..(37): Xaa can be any naturally occurring amino acid
EQGEMGKGAQGSDAAAAGGEVEENMAAWLVAKNTLKXMPFKLPPVGPYDVRVRMKAVGICGSDVHYLREMRIAHFVVNEPMVIGHECAGVVEEVGAGVTHLSVGDRVALEPGVSCWRCRHCKGGRYNLCEDMKFFATPPVHGSLANHVVHPADLCFKLPDRVSLEEGAMCDPLSVGVHACRRAGVGPRTGVLLVGAGPIGPVVAAWRGGAFGAPRVGGPGILTTPPLALGTLSWPRTRPFWVSPPPGRPCRTRWTASRRPWGLEFNIYLEW

SEQ ID NO: 15861 - protein, 244 aa, Triticum aestivum
  misc_feature (213)..(213): Xaa can be any naturally occurring amino acid
MSSSSKLFQSACKAARSFLASSSAPAAASSVLADGRNAALATLANLGRNSTLPAAYAHHLHTNAASSQGYAWIAAIPAAVYMLQDQEVHAAEMERTFIAIKPDGVQRGLISEIVSRFERKGYKLVAIKLVVPSKQFAEKHYHDLKERPFFNGLCDFLSSGPVLAMVWEGEGVIKYGRKLIGATDPSKSEPGTIRGDLAVVVGRNIIHGSDGPXETAKDEIALWFQPKELVSYTSNEEKWIYGVN

SEQ ID NO: 15862 - protein, 376 aa, Pseudoalteromonas tunicata D2
MSKRDYYEVLGVERDASERDIKKAYKRLAMKYHPDRTAGDKDLEAKFKEVKEAYEILTDSQKRKTYDQYGHAAFEQGGGHGGFGGGQGDFGDIFGDVFGDIFGGGGRRQSRQQRGADLRYNMDLSLEEAVRGKSVEIKVPTWVSCDPCDGSGAKAGSKPTTCGTCHGSGQVQMRQGFFAVQQTCPTCSGRGQIISDPCNKCHGQGRVEKTKTLSVKIPAGVDTGDRIRLSGEGEAGLNGAPAGDLYVQVSVREHAIFVRDGNNLYCEVPISFTTAALGGDVEVPTLDGRAKLKIPSECQTDKMFRLRAKGVKSVRSGAIGDLICKVVIETPVNLNERQKELLRELEESMGSNTSKNRPKEQGFFDGVKKFFDDLTK

SEQ ID NO: 15863 - protein, 304 aa, Geobacter sulfurreducens PCA
MVVTGLGQCCWDTLAEVEEYPSPDSKAESGQWVEQGGGPAATALVTVARLGLQCRFAGVVGDDAAGALIRHALHAEGIDVTHLLTRPGAASQRAFIMVERTGGRRTIVWQRPTGAHLAPAELEEPFWSGSAFLHLDGLMEEASLHGVREARRRGIPVMVDAGRMRPGMRELAKLCDYLVAAEQFFLDLGWDGSEEQFARLADGLGAPTVTVTLGDRGSLTRHDGTTCHVPAFPVTTLDTTGAGDVFHGGYLFGLLKGWPLRETVIFASAAAALSCLHLGAQRGAPRLDEVIRFLVDRGIPVPAV

SEQ ID NO: 15864 - protein, 571 aa, Burkholderia thailandensis E264
MARIGGRAEPIADACPPTEPIREGCYNNALSAGAPAGRSLARGPDGLKRRRRPAARRGFVFIPKWVASPVSRASRSCAGCPAAPFERNATMSDSVAKPVDATFDQFGLAAEILRAIAEQGYTTPTPIQANAIPVVLSGRDVMGAAQTGTGKTASFSLPIIQRLLPQANTSASPARHPVRALILTPTRELADQVAANVHAYAKHTPLRSAVVFGGVDMNPQMAELRRGVEILIATPGRLLDHVQQKTANLGQVQILVLDEADRMLDMGFLPDLQRILNLLPKERQTLLFSATFSPEIKKLASTYLRNPQTIEVARSNAAASTVTQIVYDVAEGDKQAAVVKLIRDRSLKQVIVFCNSKIGASRLARQIERDGIVAAAIHGDRSQSERMQALDAFKRGEIEALVATDVAARGLDIAELPAVINFDLPFNAEDYVHRIGRTGRAGASGDALSLCSPNERKQLADIEKLIKRTLSLETLELDLPRHRHDERGGRRERERDERRGASAGRRSAGGERAHHPRREAPIDDFFLKPYVPSSSANQPEEAKPAQPEKKAPKQPLAALLGGFGMPRKTSS

SEQ ID NO: 15865 - protein, 192 aa, Neisseria gonorrhoeae
MSIKNAVKLIEKSKARFVDLRFTDTKGKQHHFTVPARIVLEGPEEWFENGQAFDGSSIGGWKGIQASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCG

SEQ ID NO: 15866 - protein, 192 aa, Neisseria gonorrhoeae
MSIKNAVKLIEKSKARFVDLRFTDTKGKQHHFTVPARIVLEGPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCG

SEQ ID NO: 15867 - protein, 192 aa, Neisseria gonorrhoeae
MSIKNVVKLIEESEARFVDLRFTDTKGKQHHFTVPARIVLEDPEEWFENGPAFDGSSIGGWKGIEASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCG

SEQ ID NO: 15868 - protein, 305 aa, Methanosarcina acetivorans C2A
MVKPEKFIPKAIEKISQEIKEGKAIIALSGGVDSSVCAELAYRAIGDRLQPIYIDTGLMRKGETERIKHIFSHMNLHVVYAKDRFLEALAGVTDPEEKRKAVGETFIRVFEDEAKRIAADYLIQGTIYPDRIESEGGIKSHHNVGGLPSVMDFEKIVEPIEDLYKDEVREVAWALQLPEEICERMPFPGPGLAVRILGEVTEEKLEVVREANFIVEEELLERFCPWQTFAAVLGKGTGVKGDIRAYGWIVAVRAVGSRDGMTAEALELPWEVLKHLEARITSEIPKVARVVYDITPKPPATIEFE

SEQ ID NO: 15869 - protein, 162 aa, Azoarcus sp. BH72
MRQHATTTLAREMQMTVTVRQILEEKGSRTYSVRPDCSVFEALGVMAEFDIGSVIVVDNERLVGIFTERDYARKVVLKGLGSRDVSVSELMTPNPCTVTPTHTVDEVMAIMTENRFRHLPVVDHGRIVGMVTIGDMVKSVVSQQQATIRHLSSYIAGDIAVN

SEQ ID NO: 15870 - protein, 571 aa, Coccidioides immitis RS
MDKSEKGIVVAGNDQSNLPAYESSEDARDAIENQEQLGFWTRMGCTPESFKQRTLADKHNQLNRTLKGRHLHMIAIGGSIGAGLFVGSGSALHDGGPATLIIDFMIIGVMMFNVVFALGELAIMYPVSGGFYTYSTRFIDPSWGFAMGWNYVFQWAIVLPLELTVAGLTIGYWQVDVSVGVWITVFIIAIILINIFGVLGYGEEEFWSSCLKLAAVVIFMLIALVCVLGGGPSHGKYGEYWGARLWYDPGAFRNGFKGVCSVFVTAAFAFSGTELVGLAAAESKTPVQSLPSAIKQVFWRITLFYILGLFFVGLLVDSNDERLLGSGLIDVTASPFVIAAKDAGLDGFDSFMNVIILISVLSIGNSGVYGGSRTLTALAEQGYAPKMFAYVDRAGRPLYSTIFLIAFSLLAYVNLSASGAEIFDWLQALSGLAALFTWGSICLAHIRFRSAWKYHGHTLDELPFKAALGVVGSWIGLTLVIIVLIAQFYTAVWPLGGGVNNAEGFFKSYLAMPVVLFFWACGYFWKGKGWLKLSQIDVDSGRREIDWEAHNAMMEKRRNAALIKRIMYFLF

SEQ ID NO: 15871 - protein, 192 aa, Neisseria gonorrhoeae
MSIKNAVKLIEESEARFVDLRFTDTKGKQHHFTVPARIVLEDPEEWFENGPAFDGSSIGGWKGIQASDMQLRPDASTAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCG

SEQ ID NO: 15872 - protein, 250 aa, Zea mays
MGRKFFVGGNWKCNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 15873 - protein, 625 aa, Bordetella parapertussis
MCGVAGLIHLDGAAVDPAVLQGMTDAIAHRGPDGEGHWIDGNVGLGHRRLAIIDLSPAGHQPMISADSRYVLSYNGEIYNFRELRAELETAGYRFKSRTDSEVLLYAVIAWGLEKALKRFNGMFAFALWDRHERRLILARDRYGIKPLYYAEQGGTLAFGSEQKAILALPGFRRKLDKAALLEYFTFQNIFTSKVLLEDIQILPAGHYAIVEPDRRASISLTQYWDFCFREPDVAATDQEYREELDRLFVQAVKRQLVSDVELGSYLSGGMDSGSIAAVAAAEHPYIKTFTCGFDLNSASGIELGFDERSKAEYMSYCFKTEHYEMVLKAGDMERILPHVACHLEEPRVGQSYPNFFAAKLASRFVKVVLSGAGGDELFAGYPWRYYRAVVNDDFEHYVDKYYNFWQRLLPNSELKRVFAPIAGEVEHVWTRDIFRNVFRHHADQLYRPEDYINHSLYFEAKTFLHGLLVVEDKLSMAHGLETRVPFLDNDLVEFAMRCPIRLKLNNLAEVVKINENETGNKVRKFFEKNRDGKTILREVMNHRLPADISKAEKQGFSAPDASWFKGESLEFVRRKLLDGHSPLYEIMDAATVRELVNEHLGGIRNRRLLIWSLLSVDAWMRQTF

SEQ ID NO: 15874 - protein, 137 aa, Kluyveromyces lactis NRRL Y-1140
MARKITWKDVGVKDGFPLISPGFATESGNQLLFSSGCVGTDPVTNELPEDLEQQARNSMINLKKVLEVSGSSVDSVLKILLFVSDGSYAGIVNKVFKEFFPNQPARSCIVVAFPNNKLKVELECIAEIPSKKRWFKL

SEQ ID NO: 15875 - protein, 432 aa, Exiguobacterium sibiricum 255-15
MSTHTKRPTSESLYEVAQKCIVGGVNSPSRSYKAVGGGAPVYMERGEGAYFYDVDGNRYIDYLAAYGPIITGHGHPHITEAITNASRNGLLYGTPHRLEIDFAHKLQQAIPSLEKVRFTNSGTEAVMTTIRVARAYTGRELVVKFSGCYHGHSDLMLIAAGSGPATLGSPDSAGVTKATAKEVITTPFNDIESYRQIMAEWGDQVACVLVEPIVGNFGIVEPQPGFLEAINEITHEHGALVIYDEVITAFRFTYGSAQELLNIRPDMTALGKIIGGGLPIGAYGGRQDIMEHVAPLGPAYQAGTMAGNPASMAAGIACLELLEQPGVYEEFDRLGAKLEQGILEAADTHGVTITINRLKGALTVYFTDETVVDYLGAERADSEMFGRFFKLMLEQGVNLAPSKYEAWFLTTAHTETDIDETIAAVNRAFAQL

SEQ ID NO: 15876 - protein, 644 aa, Vibrio fischeri ES114
MSSSRKQARLDAKTNIESLSVQPYPNSNKVYIEGSRPDIRVPMREISLADSLVGGTKESPIFEPNEPIQVYDTSGVYTDPSYDIDVYKGLPKLRQEWIEERNDTELLDGVSSVYSQERLADETLDELRYGNLPTIRRAKQGQCVTQLHYARQGIITPEMEYIAIRENMGRQKFADEQLNHQHPGHSFGANLPKEITPEFVRREVAEGRAIIPSNINHPEAEPMIIGRNFLIKVNANIGNSSVSSSIEEEVEKLVWSTRWGGDTVMDLSTGRNIHETREWILRNSPVPIGTVPMYQALEKVNGVAENLNWEVMRDTLIEQAEQGVDYFTIHAGLLLRYVPMTAKRVTGIVSRGGSIIAKWCLAHHQESFLYTHFREICEICAKYDVALSLGDGLRPGSVADANDEAQFAELRTLGELTKVAWEYDVQVIIEGPGHVPMHMIKENMDEQLKHCHEAPFYTLGPLTTDIAPGYDHITSGIGAAMIGWYGCAMLCYVTPKEHLGLPNKDDVKTGLITYKLAAHAGDLAKGHPGAQIRDNALSKARFEFRWEDQFNLSLDPITAREYHDETLPQESGKVAHFCSMCGPKFCSMKISQEVREYAKDSEQVALDQAIEIKMIDDPLEGMRQKSEEFKASGSELYHPVVEAE

SEQ ID NO: 15877 - protein, 125 aa, Brassica napus
MNPRREPRGGRSALFDGIEEGGIRAASSSSYTSHEINEHENERALEGLQDRVILLKRLSGDINEEVDAHNRMLDRMGNDMDSSRGILSGTMDRFKTVFETKSSRRMLTLVASFVGLFLVIYYLTR

SEQ ID NO: 15878 - protein, 271 aa, Pseudomonas syringae pv. phaseolicola 1448A
MPITANRDTLLCMSMAARPGNFGVRFHNHLYQQLGLNFYYKTFSPNDLAAAVAGIRSLGIRGGAVSMPFKEACIELVDELDASAAVIQSINTIVNTDGHLKAFNTDYIAVAQLMESHAVPRSAFALRGSGGMAKAVAFALRDAGFTDGLIVARNEQAGRRLAEACGFRWQAELGSARPPLLVNVTPLGMQGAQADELSFDLQAIDAAETIFDVVATPAETPLIQAARRQGKRVVSGDEVAAIQALEQFVLYTGIRPTDEQYQQAAAFARAG

SEQ ID NO: 15879 - protein, 192 aa, Neisseria gonorrhoeae
MSIKNAVKLIEKSKARFVDLRFTDTKGKQHHFTVPARIVLEGPEEWFENGQAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCG

SEQ ID NO: 15880 - protein, 615 aa, Burkholderia thailandensis E264
MRGGRGPGRSRGGRARARRAHARQSAVLYATRHAGRSAAILIVPPRRRAPRPPACRAPARRRGPPPIHAVSLLIAMTLNSLPVWPALQAHYEEIRDAHLRDWFAPANDRAPTRAERFTFEGGGLAADFSKNLITDATLALLVRLAREAGVEARRDAMFAGETVNPTEGRAALHTALRANSPDAPFHAQVAAERAKMARFADAVRAGAWTGYTGKRIRHVVNIGIGGSDLGPKMVVHALHHVATPDIATHFVSNVDGADLARVLERIDPQETLAIIVSKTFTTLETMTNARSLREWFVANGCPEDALAKHFVGVSANPAEVVKFGIAEANVFEMWDWVGGRYSLWSAVGLSIMIAIGPERFAELLAGAHDMDEHFRTAPLERNLPVLQGLVGIWYRNFFGAQSYLVAPYSEALHYLPSYLQQLEMESNGKSAQIDGAFVDYPTSAVTWGEPGTNGQHAFFQMLHQGPTLVPIDFIAVLTPEHPLASHHPKLLANCFAQSEALMLGRTLDEARKIAGPAHPELAPHLTFPGNRPTTTLLVDALTPRTLGALIALYEHKVLVQAAVWNINPFDQWGVELGKILGKVVEADLTAPQVDPAKHDSSTSALIARARKALGE

SEQ ID NO: 15881 - protein, 358 aa, Leifsonia xyli subsp. xyli str. CTCB07
MLRGGDKAGGDEKRSSMKIGILTSGGDCPGLNAVIRGAVLKGDRVLDAEFAGFRYGWRGVVEGDIMPLDRHSVRGLSRQGGTILGSSRTNPFEGEKGGPENIQRMMDENGIDAIIAIGGEGTLTAARRLTDAGLRIVGVPKTIDNDLAATDYSFGFDTAVEIATEAIDRLRTTAESHQRCMVLEVMGRHVGWIALHSGMAGGAHAILIPELPQSVDRICEWVESVRDRGRAPVIVVSEGFHLDTMEEAHSHKGLDAFNRPRLGGIGEMLAPLIQERTGIESRATVLGHMQRGGVPSAYDRVLATRLGMAAVDAAYEGRWGSMVALRGTDVVNVSIADATGGLKTVPQARYDEAALLFG

SEQ ID NO: 15882 - protein, 192 aa, Neisseria gonorrhoeae
MSIKNVVKLIEESEARFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCG

SEQ ID NO: 15883 - protein, 273 aa, Yersinia pestis CO92
MDQKFAVFGNPISHSKSPRIHTLFSEQTGIEHRYGKVLAPSEAFENTLVSFFADGAQGANITTPFKERAYDQCDELTDRASLAGAVNTIKRLEDGRLLGDNTDGIGLLSDLERQNLIRTTDHILLVGAGGAARGVILPLLSYGCTVVVTNRTHTRAQQLAKVFNHIGDIDVCEMSELAGQRFDLVINATASGLHGEVPNLPAAILTSQTRCYDMFYQAGTTPFLAWAQRLGLADYADGLGMLVGQAAHAFKLWHGVMPEITPVLAQLRSELGK

SEQ ID NO: 15884 - protein, 192 aa, Neisseria gonorrhoeae
MSIKNAVKLIEESEARFVDLRFTDTKGKQHHFTVPARIVLEDPEEWFENGPAFDGSSIGGWKGIEASDMQLRPDASTAFVDPFYDDVTVVITCDVIDPADGQGYDRNPRSIARRAEAYLKSSGIGDTAYFGPEPEFFVFDGVEFETDMHKTRYEITSESGAWASGLHMDGQNTGHRPAVKGGYAPVAPIDCG

SEQ ID NO: 15885 - protein, 359 aa, Prosthecochloris aestuarii DSM 271
MTTKQNIKRYSRKELEELMQSIGEPRFRAAQLHRWLYSDRASDFHEMTTISKSLRETLDRKYFLPQCSMSSTQCVEDSSADSTTRKFLVQLHDQEAVETVLIPAEGRNTVCVSTQVGCPLHCSFCATGYMGFTRNLNAAEIAEQVFLVQDYLDAIGCGAVTNIVYMGMGEPLLALEEVIESVGILSDTTYRLHISQKKITLSTVGLLPEIGMLARSGLTTNLAISLHSADQETRASLMPSARDYPLKELRKTLIQYTSETGQPVTLVYMLLKEINDTQEDALKLVRLARSFLCKINLIDYNPIVNIKFDSAGEQRKNIFIRTLVDAGLNVTVRKSHGSSINAACGQLAINKKLPESSTL

SEQ ID NO: 15886 - protein, 102 aa, Burkholderia thailandensis E264
MDTQQRIKQIVDENPVVLFMKGTAQFPMCGFSGRAVQVLKACGVDQFKTVNVLEDEEIRQGIKAFSNWPTIPQLYVKGEFVGGSDIMMEMYQSGELQQLFTA

SEQ ID NO: 15887 - protein, 192 aa, Neisseria gonorrhoeae
MSIKNAVKLIEESEARFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCG

SEQ ID NO: 15888 - protein, 450 aa, Bacillus circulans
MSIHMFPSDFKWGVATAAYQIEGAYNEDGRGMSIWDTFAHTPGKVKNGDNGNVACDSYHRVEEDVQLLKDLGVKVYRFSISWPRVLPQGTGEVNRAGLDYYHRLVDELLANGIEPFCTLYHWDLPQALQDQGGWGSRITIDAFAEYAELMFKELGGKIKQWITFNEPWCMAFLSNYLGVHAPGNKDLQLAIDVSHHLLVAHGRAVTLFRELGISGEIGIAPNTSWAVPYRRTKEDMEACLRVNGWSGDWYLDPIYFGEYPKFMLDWYENLGYKPPIVDGDMELIHQPIDFIGINYYTSSMNRYNPGEAGGMLSSEAISMGAPKTDIGWEIYAEGLYDLLRYTADKYGNPTLYITENGACYNDGLSLDGRIHDQRRIDYLAMHLIQASRAIEDGINLKGYMEWSLMDNFEWAEGYGMRFGLVHVDYDTLVRTPKDSFYWYKGVISRGWLDL

SEQ ID NO: 15889 - protein, 207 aa, Triticum turgidum subsp. dicoccoides
VPRLSELLGIAVKKAEDVIGPEVEKLVADLENGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVP

SEQ ID NO: 15890 - protein, 548 aa, Arabidopsis thaliana
MNRAENLDSIPTDLILEIFSRMSTKSIGRCRCVSKLWKSMLGHPYFTELFLTRSSDHPRLLFGVKRERQWLFFSSPQPQDLYEKSSLVDFHMNFSDFHMNFSGDIRRNECTYVSGFIYFPRKRIKNYLCDFRVICNPITGQYAILQLITFHEKRSFLGFDPIDKQFKVLRMKYNDRGIVVHHILTLEPGKMRWRKIRCPLAHEPFWEEICANGVLYYLAEPTDGGSYVICCFDVRSEKFKFIDAKCFGDFSIQLINYKGKLGGISWKYDTVDGKRTVELYMWVLEDVEKQKWSKYVYPLPGNSYHYSVAGVTAKGDIVFVKTYTSKPFYVFYVNPEKKTFQRVEIHGNHEVFDTNNLVYAFVDHVEDLQFDVMKKTYAAKPISPPKQKPKPPSTETSSREDHQGWISISSRKYHQVRTIAHRQQGRRKFESINKFNALYLDDGDEDTVAHQQRDHHTFKSISKFKAQRLLDDDEFTGVKTSKCDTSHLQNRVTAVHELHIWSITVGKVSLASQVSIKPEADTDAILDKVIEYIKRHHVTIQVEKEQNP

SEQ ID NO: 15891 - protein, 504 aa, Oryza sativa (indica cultivar-group)
MSSSVGGGGGQQFRYTQTPSKVLHLRNLPWECAEEELVELCNPFGRIVNTKCGVGANRNQAFVEFTSRKGFQKLYLPTNSIIVYTYVLFVINAAHYLCKAIPSLQTDINQAISMVSYFASSSEPAQIRGKTVYIQYSNRQEIVNNKSPGETAGNVLLVTIEGVQANDVTIDVIHLVFSAFGFVHKIATFEKAAGFQALIQYTDAATASAAREALDGRSIPRYLLPEHVTSCCLRISFSAHKDLNIKFQSHRSRDYTNPYLPVNSSAIDTLQPAVGADGRKVEAEGNVLLASIENMQYAVTVDVLHTVFSAFGTVQKIAIFEKNGGTQALIQYPDVTTASVAKEALEGHCIYDGGYCKLHLSYSRHTDLNVKAHSDKSRDYTIPQGAMQAVPQPPGVPTTSAGWQGNPQAGGAYAPPGAAAPNHGTTGQVPNWNPGNSGYAPAPGAYPGQMYSSPMQYGASGGFSAPAAPPQELHTSQQMPPPQYGNQPGPAGAPGTGQPHPYYR

SEQ ID NO: 15892 - protein, 459 aa, Rhodospirillum rubrum ATCC 11170
MADYDYDLLTIGAGSGGVRASRLAGGFGARVAVVEGSRIGGTCVMRGCVPKKLLVYGAQYANDLEDMIGYGWSMGGVAFDWPSLITAKNRELDRLEGVYRTMLRNGNVALLEGRARFLDAHSVDIDGKTVTADKILIAVGGWPQMPVIPGIEHAITSNEALDLMVMPERLTIVGGGFIAVEFASIFNALGVDVSVVIRKDKILRGFDADIRDTLTEELVRRGITIVPGTVINRIDKRPGGGYRLIRTPGEAIDTDLVMYATGRAPNTAGLGLEAAGVKVAASGAVIVDEWNRTTVDTIYAIGDVTDRIALTPVAINEAIAFAHTVFNDTPRVMDYENVASAVFSQPPVGTVGLTEEQARARGPVRIFRTRFRAMKHVLAGRDEKTMMKLVVDARTDRVLGCHMVGADAPEIIQGLAVALKCGATKAQFDATIGIHPTAAEEFVTMRDPVPEPVFAQPAD

SEQ ID NO: 15893 - protein, 540 aa, Cryphonectria parasitica
MADPFAPRSMKRKNVKGLALTPAAPKPPPTAENANFSHSRNNQSEDTSAQLEIGIEFNLDLRPEDLEIIKDLGSGNGGTVSKVKRIPTNTTMARKVIHVEAKREMRKRIVRELQIMHNCHCEHIVTFYGAFLNDNNDVIMCMEYMDVGSLDRVSRVFGPVRVDVLGKIAEATLGGLTYLYYKHHIMHRDIKPSNILVNSRGHIKLCDFGVSGELINSVADTFVGTSTYMAPERIQGEKYTVKSDVWSFGLSIMELAIGKFPFAASEQLSDAEAAPAGILDLLQQIVHEPAPKLPKSDAFPQILEDMIQKCLLKTPDDRPTPQELYDRDPFVQAAKRTPVDLREWAVSLMERDNRKSHLAPQLSPGTQELLRSNNSPDGAAEDRALATPTSGEIPIVGALLQSPRDQYNSASNRSPTRSDRGPGSSSAGRPGGPPVHPGLGSRVSTTNSIPKMAPPPPPRPGRHSPNLSAGSGSGRQATFALPVRPAPAGPLPNPPMRKQTPDETTSGRGPMRRQATWGASSGSMGAQGMGGYPANQVRRE

SEQ ID NO: 15894 - protein, 194 aa, Zea mays
MASLWKTKVLPGLNKIFDKDGKKAAAAGFFKSFNKEEIGKEIEEKKAELEPKVAEAYEASPPEVKALFKDKKPVKISKKNSTAVTKFLDELAKIDFPGAKVVSEAVAKSGASPLSPAITFILDKVAPYIPKEEPKAEDAVAEATSREVAVEVEDAEPAIADAAAETPSEAKKGEEEKPAAEEAAPPAAAATEEK

SEQ ID NO: 15895 - protein, 933 aa, Arabidopsis thaliana
MVRISLLLLCLLVSTCLFTSSSAQAPGFVSLDCGGAEPFTDELGLKWSPDNHLIYGETANISSVNETRTQYTTLRHFPADSRKYCYTLNVTSRNRYLIRATFLYGNFDNSNNVYPKFDISLGATHWATIVISETYIIETAELVFLASSPTVSVCLSNATTGQPFISTLELRQLSGSMYGSMLSEDRFYLSVAARINFGAESEASVRYPDDPYDRIWESDLQKKPNYLVDVAAGTVRVSTTLPIESRVDDRPPQKVMQTAVVGTNGSLTYRMNLDGFPGFGWAFTYFAEIEDLAEDESRKFRLVLPEQPEYSKSVVNIKENTQRPYRVYAPGYPNITLPFVLNFRFAKTADSSRGPILNAMEISKYLRKSDGSVDATVMANVASLYSSTEWAQEGGDPCSPSPWSWVQCNSDPQPRVVAIKLSSMNLTGNIPSDLVKLTGLVELWLDGNSFTGPIPDFSRCPNLEIIHLENNRLTGKIPSSLTKLPNLKELYLQNNVLTGTIPSDLAKDVISNFSGNLNLEKSGDKGKKLGVIIGASVGAFVLLIATIISCIVMCKSKKNNKLGKTSELTNRPLPIQRVSSTLSEAHGDAAHCFTLYEIEEATKKFEKRIGSGGFGIVYYGKTREGKEIAVKVLANNSYQGKREFANEVTLLSRIHHRNLVQFLGYCQEEGKNMLVYEFMHNGTLKEHLYGVVPRDRRISWIKRLEIAEDAARGIEYLHTGCVPAIIHRDLKTSNILLDKHMRAKVSDFGLSKFAVDGTSHVSSIVRGTVGYLDPEYYISQQLTEKSDVYSFGVILLELMSGQEAISNESFGVNCRNIVQWAKMHIDNGDIRGIIDPALAEDDYSLQSMWKIAEKALLCVKPHGNMRPSMSEVQKDIQDAIRIEKEALAARGGISDEFSRSSAHSSSLNMGMLDLAGSQSYVSIDESVLQPTAR

SEQ ID NO: 15896 - protein, 628 aa, Bordetella parapertussis
MCGVLGAWWRHHDEHEDARFAAGLRKLAHRGPDDRGSEHFAASHGRLSLGHTRLAVIDLSAAGHQPMHADADRLAVVFNGEIYNYRELRSELRQIGAIFRGDSDTEVLLAAWQHWGVAALRRFKGMFAFALYDRRQQTLTLARDAFGIKPMYYHAAPERLLFGSELPAVQALLPHPPRLNWQRAYDYLAYGQYDQPPDTFIAGIRQLPAGHLLTLDLRTGQAGEPMAWDDPASQECRPIGFQEAAEELRARFLDNVRLHLRSDVPIGAALSGGIDSSAIVCAMRWLEPDLPIQTFSFISDDTHRSEERWVDLVNQHCGATGHKIHIAPHELLDDLDDLIRVQGEPVGSTSIYAQYRVFKLAREHGVVVTLDGQGADELLGGYGGYPTERLASLLETGRLGAAARLLRQQGRGAPARLLQAAALAAGGRHLANLRHATGRQHAPAWLDAQVLRDQGVTMREPAHAWAAATPLRGRRLVNELAHALYHRGLGALLRHGDRNSMRFSVESRVPFLTQDLAEFALRLPERYLVSDSGQTKHIFRKSMPRIVPDSNMDRDDKIGFATPEQQWMQATAPQMRQWLVDAADIPFLRNAEVTAQFDAMIAGATPFSWQAWRWVNFQRWMQHAQLCA

SEQ ID NO: 15897 - protein, 581 aa, Desulfitobacterium hafniense DCB-2
MKKKVLIVGGVAGGASAAARLRRLDEDAEIILFERDDYISFANCGLPYYIGGTITKRERLMVQTPEDMQARFNIDVRIRSEVIRLDAANKKVLVRSQSRGTYEESYDALILSPGAKALRPNIPGIDSERILTLRNIPDTDAIKGLVDQKGVQSAIIIGGGFVGVEMAENLREQGLNVTLVEAAPHILAPFDTDMVVLAEKKLVAHGIRLILNDGVKSFQDLENQVEVTLASNRKLQGDLIILAIGVIPDTGFLKESGLELGPKGHLIVNERMATNLPHVYAAGDAVEVLDYITKTKTAIPLAGPANKQGRIAADNIAGLNSTYKGTQGTSIIKIFELTAASTGANERTLQRANLPYHVIHIHPVSHASYYPNAYPMTLKLIFGADGRIFGAQGIGRDGVDKRIDVISTVIRLGGTVEDLTELELAYAPPFSSAKDPVNMAGYVAQNVLTGQAHMLVWDDLNKIDEEYTFVDVRTKIEFAKGHVEGAINIPVDDLRQRIQELDPGKLIVVYCEVGLRGYFAERILTQKGYRVLNLTGGYTTYSVQGFDPNQALDDYKKDFNPYPCCADEDIIDPDTQRIKHQ

SEQ ID NO: 15898 - protein, 331 aa, Arabidopsis thaliana
MFTCINCTKMADRGEEDEEDEARGSTTPNTKEAVKSLTTQIKDMASKFSGSHKQSKPTPGSSSSNLRKFPDFDTASESVPYPYPGGSTSSTPAWDLPRSSYHQSGRPDSRFTSMYGGERESISAQSCDVVLEDDEPKEWMAQVEPGVHITFVSLPSGGNDLKRIRFSREVFDKWQAQRWWGENYDRIVELYNVQRFNRQALQTPGRSEDQSQRDSTYTRIDSARESRDWTQRDNNFRPPGGSVPHHFYGPPMDAARITTSSRDEPPSMSNASEMQGEWVEEDEPGVYITIRQLPDGTRELRRVRFSRERFGEVHAKTWWEQNRDRIQTQYL

SEQ ID NO: 15899 - protein, 445 aa, Brassica juncea
MTKKTRKLGKYEVGRTIGEGSFAKVKFARNTDSGENVAIKIMAKSTILKNKMADQVKREISIMKIVRHPNIVRLYEVLASPSKIYIVLEFVTGGELFDRIVHKGRLEESEARKYFQQLIDAIAHCHCKGVYHRDLKPENLLLDTNGNLKVSDFGLSALPQQGVELLRTTCGTPNYAAPEVLNGQGYDGSAADIWSCGVILFVIMAGFLPFSETDLPSLYRKISAAEFSCPQWFSEDVKSLIQRILDPNPKTRIQIQRKLGKHSWFRLNYMPTRARKEEESNLDDVRAVFDGIEGSYVAENIERKYEGPLMMNAFEMITLSQGLNLSALFDRRQDFVRQTRFVSRREPSVIIANIEAVATSMGFRAHTRNFERRLEGLSSIEGKGEFAVVIEYEVAPSLFMVDVREAAGETLEYHKFYKKLCEKLENIIWRATEGMPKPELRTITF

SEQ ID NO: 15900 - protein, 461 aa, Mycobacterium smegmatis str. MC2 155
MTAIQESTLLPNGLTVDTAKAEAARAYELDRAHVFHSWSAQEEISPMTVTAAQGSYLWDGDGNRLLDFSSQLVNTNIGHQHPKVVAAIAEQAAKLCTVAPQHANAARSEAARLIAERTPGELNKIFFTNGGADAVEHAVRMARLHTGRYKVLSRYRAYHGGTDTAINLTGDPRRWPNDRGNSGIVHFNGPFLYRSSFYAETEEQESQRALEYLEKLIQMEGPSTIAAIILESIPGTAGIMVPPPGYLAGVRELCTRYGIVFIADEVMAGFGRSGKWFSINHFDVVPDLMTFAKGVNSGYVPLGGVAISPEIYETFAHRAYPGGLTYSGHPLACAAAVATINAMEDEGMVENAAKVGAEVIGPGLAELAAKHRSVGEVRGLGVFWAVELVKDQKTREPLAPYGSSSPAMNAVIAACKSGGLLPFANFNRIHVVPPCNVSADEAREGLAILDSALDVADEHTV

SEQ ID NO: 15901 - protein, 667 aa, Mycobacterium tuberculosis CDC1551
MSFVLVSPSQLMAAAADVAGIGSAISAANAAALAPTSVLAAAGADEVSAAVAALFSAHAGQYQQLGARAALFHEQFVQALTGAASAYASAEATNVEQQVLGLINAPTQALWGRPLIGNGADGTAANPNGGAGGLLYGNGGNGFSQTTAGLTGGTGGSAGLIGNGGNGGAGGAGANGGAGGNGGWLYGSGGNGGAGGAGPAGAIGAPGVAGGAGGAGGTAGLFGNGGVGGVGGDGGQGGNGAGAGASGTKGGDAGAGGAGGAGGWIHGHGGAGGDGGAGGAGGQASPGAPGPPSQPGGAGGAGGAGGRGGDGGSAGWLSGNGGDAGNGGGGGTAGGAGNGGQFGGDGGTGGTGGTAGAGGNGGRGAVLFGHGGNAGHGGAGGNGAAAGAGGEHVVATAGKGGTGGVGGDGGGGGAGGGGGLLYGNGGAGGAGNSGGDGGTGLNAALGGNGGGGGVGGNAGAGGTGGSAGWLSGNGGAGGSGGSAGAGGAGGKGGDTPNGLAINPGIGGNGGDTGNAGNGGNGGSAARLFGGGGAGGAGGTGSTAGSGGSGGTNPPTGLQAAGGNGGSGHAGGHGGNGGGAGLLGGGGTGGNGGGGGQGGLGAAAGGVDGNGGNGGNGGKGGDAQLVGDGGNGGNGGKGGAGLIAGLDGAGGAGGTRGLIFGNAGTPGQ

SEQ ID NO: 15902 - protein, 308 aa, Salmonella enterica subsp. enterica serovar Typhi Ty2
MARAMDNAILETILQRVRPLIGQGKVADYIPALASVEGSKLGIAICTVDGQHYQAGDAHERFSIQSISKVLSLVMAMRHYPEEEIWQRVGKDPSGSPFNSLVQLEMEQGIPRNPFINAGALVVCDMLQGRLSAPRQRMLEVARALCGVSDITYDATVARSEFEHSARNAAIAWLMKSFGNFHHDVPTVLQNYFHYCALKMSCMELARTFVFLANQGEAFHLDEPVVTPMQARQINALMATSGMYQNAGEFAWRVGLPAKSGVGGGIVAIVPHEMAIAVWSPELDPAGNSLAGIAALEQLTQTLGRLVY

SEQ ID NO: 15903 - protein, 1002 aa, Oryza sativa
  misc_feature (370)..(370): Xaa can be any naturally occurring amino acid
MATLKRKADSAAAELASPPPKAPRGSEALAESPSLAGGGSEPVACVHDVSYPEGYDPSAPATHLLNGVGGAEGAGPAKTFPFQLDPFQAEAIRCLDNGESVMVSAHTSAGKTVVALYAIAMSLRNQQRVIYTSPIKALSNQKYREFKEEFSDVGLMTGDVTIEPNASCLVMTTEIWRSMQYKGSEVMREVAWIIFDEVHYMRDRERGVVWEESIVMAPKNSRFVFLSATVPNAKEFADWVAKRVHKQPCHIVYTDYRPTPLQHYVFPSGGDGLYLVVDEKSKFREDSFQKGLNALVPASENDKKRENGKWQKGLLTGKPSEDSDIFKMVKMIIQRQYDPVILFSFSKRECEFLAMQMAKMDLNDDDEQGXIETIFWSAMDLLSDDDKKLPQVSNMLPLLKRGIGVHHSGLLPILKEVIEILFQEGLIKCLFATETFSIGLNMPAKTVVFTNVRKFDGDRFRWLSSGEYIQMSGRAGRRGIDQRGICILMVDEKMEPSTAKMILKGSADSLNSAFHLSYNMLLNQIRCEDGDPEKLLRHSFYQFQADRVLPDLEKQVKELELERNSMIIEEEENLKSYYDLLQQYKNLKKDVRDIVHSPKYVLPFLQPGRLARVQYSTDEQSTFSIDENITWGVTINFEKVKTHSEDRRPEDSDYTVDVLTRCSVSKDKSGKKTMKIIPLKDRGEPVVISLPLSQIDGLSSIRMHIPKDLLPVEARENTLRKVDEVISRFAKDGIPLLDPEEDMKVQSSSFRKASRRIEALESLFEKHDVHNSPHIKQKLKVLHAKQELSTKIKAIKRTMRSSTALAFKDELKARKRVLRRLGYITSEDVVEVKGKVACEISSADELTLTELMFSGTLKDATVEQMVALLSCFVWQEKLQDAPKPREELDLLFFQLQETARRVANLQLDCKIQIDVESFVNSFRPDIMEAVYSWAKGSKFYQIMEMTQVFEGSLIRAIRRLEEVLQQLILASKSIGETQLEAKLEEAVSKIKRDIVFAASLYL

SEQ ID NO: 15904 - protein, 195 aa, Bacillus licheniformis ATCC 14580
MKVTKSEIVISAVKPEQYPEGGLPEIALAGRSNVGKSSFINTMINRKNLARTSSKPGKTQTLNFYIINDVLHFVDVPGYGFAKVSKTEREAWGRMIETYLTSREELKAVVQIVDLRHAPSQDDVMMYDFLKHYEIPVIVIATKADKIPKGKWEKHAKVVKETLNIEKEDRLILFSSETKKGKQEAWSAIEQMIAR

SEQ ID NO: 15905 - protein, 393 aa, Campylobacter jejuni RM1221
MDYKEQSHIVPTYKRFDIVLEKGQGVYLFDDKAKKYLDFSSGIGVCALGYNHAKFNAKIKAQVDKLLHTSNLYYNENIAAAAKNLAKASALERVFFTNSGTESIEGAMKTARKYAFNKGIKGGQFIAFKHSFHGRTLGALSLTANEKYQKPFKPLISGVKFAKYNDILSVEKLVNEKTCAIILESVQGEGGINPANKDFYKALRKLCDEKDILLIADEIQCGMGRSGKFFAYEHAQILPDIMTSAKALGCGLSVGAFVINQKVASNSLEAGDHGSTYGGNPLVCAGVNAVFEIFKEEKILENVNKLTPYLEQSLDELINEFDFCKKRKGLGFMQGLSLDKNVKVAKVIQKCQENALLLISCGENDLRFLPPLILQKEHIDEMSEKLRKALKSF

SEQ ID NO: 15906 - protein, 640 aa, Corynebacterium efficiens YS-314
MPPVTHPEFRNVAIVAHVDHGKTTLVNAMLEQSGVFGDHGEVADRVMDSGDLEREKGITILAKNTAIRRKGAGKDGNDLVINVIDTPGHADFGGEVERALSMVDGVVLLVDASEGPLPQTRFVLSKALAAKMPVIIAVNKTDRPDARIDEVVEEAQDLLLELASAIEDEEAAAAAEQLLDLPVLYTSGREGKASTENPGNGNVPASPDLQPLFDTLLKVIPAPEANIDAPLQAHVTNLDSSSFLGRIGLVRIHAGSLKKGQQVAWIHYDEEGNQHTKTAKIAELLSTVGFSRVPAQEVIAGDIAAISGIEDIMIGDTLADVNNPVALPRITVDEPALSMTIGVNTSPMAGRGGGDKLTARVIKARLDQELIGNVSLKVKPTDRPDTWEVQGRGEMALSILVETMRREGFELTVGKPQVVTQTIDGKLHEPYEIIVIDVPSEYQGNVTQLLATRKGLMQSMTTTPGSDWIRMEFRVPSRGLIGFRTQFMTETRGTGIANSYSDGLDVWAGEIKGRAHGSLVADRSGQITAYALQQLADRGNFFVEPGTETYEGVVVGSNNREEDMDINPTKEKKLTNMRAASADTTVTLAKAHNLSLDEALEFCGVDECVEVTPDVLRVRKVILNATERNRARSRAKSLNK

SEQ ID NO: 15907 - protein, 379 aa, Zea mays
MESFGVPPAPVAAPEKRKKPLDLKDPVPAAAAAAANGGGATKASPAAKWAEKKKLVGGDAGYVLEDVPHLTDYLPQLPTYPNPLQDNPAYSVVKQYFVNPDDTVTQKIVVHKTSARGTHFRRAGPRQRVYFQPDEVNAAIVTCGGLCPGLNTVIRELVCGLYDMYGVTSVVGIEGGYKGFYSKNTVALTPRSVNGIHKRGGTVLGTSRGGHDTAKIVDCLQDRGINQVYIIGGDGTQKGASVIYEEVRRRGLKCAVVGVPKTIDNDIAVIDKSFGFDTAVEEAQRAINAAHVEAESAENGIGVVKLMGRNSGSFQEEAPFPDNSQVHRPDLHDPRRQFKRFRQRLLHSASPQRAPWRHGGVHRLHRRSGQWQTRLHPVL

SEQ ID NO: 15908 - protein, 343 aa, Rhodospirillum rubrum ATCC 11170
MSDPLTLFTRGGSSLPTIARPTSTLAGLHPEAAALFDSLERSGILSGRPESQPLATARARAQSFWYPWNTGGPRMRLRRDLSLDGSDGPVAARLFIPCSASSEPPVIVYFHGGGYALNGLDTHDRLMRTLADASGAAVLGVGYALAPEHPFPTQTAQALSAIDWLLRRGRRDFAIDARRMALAGDSAGAHLALWTAQSMREADWPAARMLLLAYGMMVPRFDSASHALYGGGAYGLTTERMRWFWNAVTPAQGRPFTPLTAGLDDLPSCLVVGASADCLRDDSRALAEALELRDAPVRFIEAEGLPHSFLQYAPALEPARRLLGDLASTLARSLESGAPVRWS

SEQ ID NO: 15909 - protein, 533 aa, Aspergillus nidulans FGSC A4
MADTIPHNTFDTILVLDFGSQYTHLITRRLREINVYSEMLPCTQKLADLGWKPKGIILSGGPYSVYEEGAPHADPAFFELGVPILGICYGLQELAHRLHADNVVAGTAREYGHADLKATKFGGHVDKLFENIEGDMTVWMSHGDKLRNLPEGFHTIGTTQNSEYAAIAHKSDPIYGIQFHPEVTHTPQGGQLLKNFAVGICGAEQKWTMAEFIGQEIQRIRSLVGPDGQVLGAVSGGVDSTVAAKLMTEAIGDRFHAVLVDNGCMRLNECEKVQEVLQEQLGINLTVVDAGEQFLAGLKGVHDPEQKRKFIGGKFIDVFEDEARKIEAKSNGKVEWFLQGTLYPDVIESISFKGPSQTIKTHHNVGGIAERLMRGHGLKLIEPLRELFKDEVRELGRQLGISPELVGRHPFPGPGIAIRVLGEVTREKVEMARQADHIFISMIREAGIYDEIGQAYAALDPSRAVGVMGDKRVYANIILLRAISTKDFMTATPYPFSYEFLSKVSTRIVNEVAGVCRVCYDYTSKPPGTIEME

SEQ ID NO: 15910 - protein, 1354 aa, Coprinopsis cinerea okayama7#130
MRALLRPFALHAAYTPIETIVFFSIIGTLAYFHILNAIKHSAFLSPSYTAHSQGHLTLRPSYVLHRMGEWVGVRETRWSREVEKTDRAQTVAFEVQQLVFNMDESWKRNVVPEDVLPVYAAFSASASNLTQYLTTDFPIEPEVTYSELCHRPSAKGQKSSCFVHTFKTAKPPAYYYGNSPTFSQSQTQALAFEPGAREEFVSALKEAGQFFDDAGIKFEVEQSTSSVVDEVDIGNMESSKWVAYAIRTLALRFWHLAKKADSLDIMLILAGYILMHITFYLLFTRSRRLGSSFWLPLAIFTSAILALLLAVPIAMALKIPIDPVALTEALPFLVCTVGFDKPLRLARAVFTHPHLVLPPGDSNAPLGASSQGPPSLSQLKPAPKIVTESLTLVYPPIIRDYFLEIAVLVVGAYSKVGGLREVCALAALILGIDCLLLCTYLSAILGVMIEVRRIKTFRALTKARADSISSLTPSGSSSSLSALANKPSAMVRPAAPATPPTLRKRISSALLGGEKGSSLPDYARGVGIRVKGGVDKVKELAKGEELVKEENPVARLKLLLIASFMTLHILNFIAPLAPSRTSNSNVGHAANHNLSVRKVDVTTPAIRSVLHAIEEAEGVKKTQSLVDQATNISEDEEYSLGLDQAPQQEKQLLVKIAPPVHIRVSPPATFASQGAPSAAGQPGKRSTSEMVDSFMSSWTRLVGDPVLSKWIVAVLAISIALNGYLLRGIALGAGVGSLGLLLVGRRAGGVRFEDGEDAKEETSVSQNTSSTATASVTRVESHASVSEHTVQRKPSFSAANVSTFNLEDVDRKLKAQRRLTITSKNMVLPSPNSNSSAPSSSDGSDEEEPVYPEGVRTLEECLEIFENGPRPLSKSLALLNDEEIIMLAQNGKIAAYALEKVLGNGPVELERAVRVRRALISRASSTKTLESSLVPLKNYDYGRVLGACCENVVGYIPIPLGIAGPLNVDGVSYHIPMATAEGTLVASTSRGCKALNAGGGVTTVLLQDGMTRGPAIDFPTIIMAAEAKAWIASEEGYGIIKEAFESTSRFARLLSLKTNLAGRTLFVRFKTATGDAMGMNMISKGTEKALEVMQTFFPEMVVLALSGNYCTDKKPAAINWIDGRGKSVVAEAVIPGKVVKTVLKTTVEALVNLNIKKNLIGSAMAGSVGGFNAHAANILTAMFLATGQDPAQNVESSNCMTLMEAINDGEDLLMTVTMPSIEVGTVGGGTVLAPQQAILEMLGIRGAHPTSPGENAQRLARIIASAVMAGELSLLSALAAGHLIRAHMAHNRSTANTPAASVPGTPGGPLGGAAAIAPPLPAEKDSKSEPASKGPAPGPLTPSSSMGSLPPYTR

SEQ ID NO: 15911 - protein, 444 aa, Ralstonia solanacearum GMI1000
MSKARFDTLALHAGAAPDPATGARATPIHLTTSFVFRDSEHAASLFNMERAGHVYSRISNPTVAVFEERMAALENGVGAIATASGQAALHLAIVTLMGAGSHIVASSALYGGSHNLLHYTLRRFGIETTFVKPGDIDGWRAAIRPETRLLFGETLGNPGLDVLDIPTVASIAHDAGVPLLVDSTFTTPWLLQPFAHGADLLYHSATKFLGGHGTTIGGVLVDAGTFDYVAAGRHPELTEPYAGFHDMVFAEESTVAPFLLRARREGLRDFGACMNPMAAWQLLQGVETLPLRMARHVENTRRVVAFLAGHPMVASVAYPELETHPDHALAKRLLPRGCGAVFSFDLRGDRRAGQQFIESLGLFSHLANVGDARSLVIHPASTTHFRMDAAALAAAGIGEGTIRLSIGLEDADDLIDDLKRGLKAAERAMSAASGKTAPAPTGAR

SEQ ID NO: 15912 - protein, 151 aa, Ralstonia solanacearum GMI1000
MKVSDILHVKGNTLYTVAPETKLQVAVQTMAEYDIGSLVVMEYGELVGMLTFREIILVLARNNGKVDDGTTIRKVMDDHPLTCTPETEVNEVRRMMLERHARYLPVLDNRTLMGVISFYDVAKAVFEEQNFENKMLKAYIRDWPKEEASED

SEQ ID NO: 15913 - protein, 418 aa, Neurospora crassa
MSLSNKLSIEDVDLKGKRVLIRVDFNVPLDAEKKVTNPQRIAGAIPTIKYALDHGAKAVVLMSHLGRPDRKPNPKYSLKPVVPELEKLLGKKVTFAPDCVGPEVEEIVNKADNGEVILLENLRFHIEEEGKGTDAEGNKVKADKAKVEEFRKNLTKLGDVYINDAFGTAHRAHSSMVGIDLPVKAAGFLMKKELQYFAKVLESPQRPFLSILGGAKVSDKIQLIDNLLDKVNTLIVCGGMAFTFKKTLQNMPIGNSLFDEAGAKIVPDLVKKAEKNNVKLVLPVDFTIADKFDKDANTGYATDKDGIPDGWMGLDCGEESVKLFTQAINESQTILWNPGAGVFEFDKFAKGTKATLDACVKAAEEGRTVIIGGGDTATVAAKYGVEDKLSHVSTGGGASLELLEGKALPGVVALSERQ

SEQ ID NO: 15914 - protein, 521 aa, Oryza sativa (japonica cultivar-group)
MGNSLPVESKFTFEEENDRIKYVVSSMQGWGEKMEDAHAAILNLDDATSTSFFGVYDGHGGAEVALYCAKQFHIELCNHEDYHNDLINALDNVFLSMDENLQQSDAWRELVIPHDNGCMYFLKAGVCAKPFPQATYTGPAYEGSTACVVVIRGNQMIVGHVGDSRCVLSRQGGLAIDLSFDHKPCTRTESERERVQNAGGRSLGLRCEQVMGNYVVKEQWVLGDFGGGVTISRSIGDFAFKKNKDLDREKQMLVCDPDILADDITDDMEFLVIASQGLWSCVDSADVVSYIHDRLSVEGAELRVICEEVVEFGLASGENTTVILVQFKPGAFQYQLVDPAGFGTAVSNIASTSAAPAGASDTSDEGVMADSSATADTSGSARAESGELVPTPSANNTVTDEVDPTGTVAADDKVDPNSSANADADDGAPKPSLGAVIESDEVALDATATGHQVAVRQQEEFDPKKCWICGKGYKKILLEPSSARARNPLLAHAKTCESEDKKAKKKITKYMMKANVTNQYH

SEQ ID NO: 15915 - protein, 327 aa, Glycine max
MSSSSADVFPAIQEVMLEFRAGKMFLEEKRVVPDTRKGLVRIARCLLLFQGEEGLVHFQWLDRTQNVVEDDQIIFPNEAIFEKVNQTSGRVYILKFNSDDRKFFFWMQESNADGDSQLCSSVNDYINRPLELLGEEEPDGSLPLQISEDMTEDDISSRAANLGIPNLGVEATSDVTSSGPVKLEDLQRILSNIGPADSIVDPDGGLGLGDILKPDLIMPLMDMLPLEQRLAPYLPEGKWSPEEILELLQSPPFRQQVDSFTYVLRTGQIDLSQFGIDPSKYKFTVLSFLEALEDSVSKSVESEEARQDDQDLRSQSCNRHDPMDESQ

SEQ ID NO: 15916 - protein, 625 aa, Pseudomonas syringae pv. phaseolicola 1448A
MSFASLGLSEALVRAIEAAGYTQPTPVQQRAIPAVLQGRDLMVAAQTGTGKTGGFALPILERLFPNGVPDKSQRHGPRQPRVLVLTPTRELAAQVHESFKLYARDLKFVSACIFGGVGMNPQVQAMSRGVDVLVACPGRLLDLAGQGSVDLSHVEILVLDEADRMLDMGFVHDVKKVLARLPAKRQNLLFSATFSNDITSLAGKLLHNPERIEVTPPNTTVERIEQRVFRLAANHKRSLLAHLITVGAWEQVLVFTRTKHGANRLAEYLDKHGLAAVAIHGNKSQNARTKALADFKAGDVRIMVATDIAARGLDIDQLPHVVNFELPNVDEDYVHRIGRTGRAGRSGEAISLVAPDEEKLLKSIERMTKQKIADGDLMGFDITAVEAEKPEVRERPDVRNSRGARPAGDKNNGGRRDKGKDKGKEKPAAAAATGERPARQPREKKPREGTPRSEQRASQPSIPRPAADRAPDEFRDDEVDNFGNRADYVSPYQGKGQNRGRRPAAAPGAAPAAGGAARPANSGRPAGGARNGSGTGAPKRNGSGSSAPRSRDGQPRGRRPAREDQPLPREGQEPAVRAPRDGQPQPKIVHKESKIDRFPSAEQLDQLPTRPRGEKPALLTRNRDS

SEQ ID NO: 15917 - protein, 194 aa, Desulfitobacterium hafniense DCB-2
MREAHIERQTKETRIRVKLNLDGAGTAQVDTGIGFFDHMLEALARFGYLDLEVAAEGDLQVDPHHTIEDCGIVFGQAIREALGERRGIERVGDTLLPMDEALVQVALDLSNRPYLVWDVECPEGMVGGFPVEMAEEFFRAVSVQAGITLHMRLFSGKNRHHILEAIFKGFGRALGLALRENPRFQGVLSTKGVL

SEQ ID NO: 15918 - protein, 324 aa, Prosthecochloris aestuarii DSM 271
MDIKEVTVSVSQELETFRQRYKVALKSDNSLIDKVMRYILKQQGKQVRPLLVMLGAKVCGGVADASYRAAIMVELLHSATLVHDDVVDGAEMRRGLASINAVWKNKIAVLIGDYMLSKGLLYSLDHKDYRSLHMVSDAVRRMSEGEILQIQKTRSLDISEEDYLKVISDKTASLLSTSCAMGGASVTDDEEKIEALRNYGEFLGLAFQIRDDLLDYTGDSNKTGKQLGIDIQDKKITLPLIYALGQAERSEQKRIRSILKSSKKRAMKSGEVMDFVRKSGGLEYSSEVAEGFASKATAALEVFDDSEARRSLELLVDFVMKRQH

SEQ ID NO: 15919 - protein, 370 aa, Bacillus licheniformis ATCC 14580
MKKRIALLPGDGIGPEVLDAAVDVLKSVAEHYQHEFEFEYGLIGGAAIDEAGAPLPEETVAACKAADAILLGAVGGPKWDQNPSELRPEKGLLAIRKQLDLFANLRPVKVFESLAGASPLKTEYIEGVDFVIVRELTGGLYFGKPSEQYVNQNGEEEAVDTLFYKKSEMERVIREAFQMAQSRKGKVTSVDKANVLESSKLWRKTAEEVAKEFPDVKLEHMLVDNAAMQLIYAPGQFDIIVTENMFGDILSDEASMLTGSLGMLPSASLSSSGLHLYEPVHGSAPDIAGQNIANPLAAILSAAMMLRTSFGLEAEAQAVEHAVDQVLRAGKRTKDLAKGSEHCTTQSITGEVKAALADDNAISNIMTAYV

SEQ ID NO: 15920 - protein, 303 aa, Candida glabrata CBS 138
MSVLLVSAGYDHTIRFWEALTGVCLRTIQHPDSQVNRLEITNDKKLLAAAGHQNIRLYDIKTSNSNPVASFEGHRGNVTSVSFQQDNKWMVTSSEDGTIKVWDIRSPSVPRNYKHNAPVNEVVIHPNQGELISCDRDGNIRIWDLGENQCTHQLTPEDDVPLQSLSVASDGSMLVAANNKGNCYVWEMPNHTDASNLKPATKFKAHPSYITRVLLSSDVKHMATCSADHTARIWSVEDNFNLESTLDGHQRWVWDCAFSADSAYLVTASSDHYVRLWDLSTRDIIRQYGGHHKGAVCVALNDV

SEQ ID NO: 15921 - protein, 211 aa, Campylobacter jejuni RM1221
MENLISGAIKFMQEDFKEHEELFESLKNKQNPHTLFIGCSDSRVIPNLITNTGPGELFVIRNIANIVPPYRIGEDYLATTSAIEYALNSLHIKNIVVCGHSNCGGCNALYYSDEELNKIPNVKKWLTMLDPIKKDVMIFARDDLAMRSWLTEKLNLVNSLQNILTYPGVQEALDEGKIEVHAWYYIIETGEIYEYDFKAKIFTLIQDRKVQ

SEQ ID NO: 15922 - protein, 460 aa, Bacillus licheniformis ATCC 14580
MHTLEKMEQTNFQTARDYVTQAYETVQKRNFYESEFLQAVKEIFDSLVPVLARHPKYIEHRILERIAEPERMITFRVPWVDDEGNIRVNRGFRVQFNSAIGPYKGGIRFHPSVNASIIKFLGFEQIFKNSLTGLPIGGGKGGADFDPKGKSDREIMSFTQSFMNELYRHIGPDTDIPAGDIGVGAREVGFMFGQYKKIRGRYDAGVLTGKGLEYGGSLTRKEATGYGLVYFVEEMLKDQGMRFENSTVVVSGSGNVALYAMEKAAQFGAKVVACSDSDGYVYDEKGICLETVKRLKEDGNGRIREYVSEHPEAHYFEGCTGIWSIPCDIALPCATQNEIDEEAAEVLISNGVKAVGEGANMPSEEGAVKRFLDAGVLFGPAKAANAGGVAVSALEMAQNSARLHWTAEETDAKLRAIMADIHKRSVEAASEYGRPGNLLDGCNIAGFIKVADAMIAQGVV

SEQ ID NO: 15923 - protein, 758 aa, Kluyveromyces lactis NRRL Y-1140
MAHRKLQQEIDRVFKKVNEGLEIFDMYYERHENCVNNPSQKDKLESDLKREVKKLQRLREQIKSWQSSPEVKDKDSLLNHRRSVEVAMEKYKAVEKASKEKAYSNISLKRSDVLDPLEKERRDVEEFLSNQIEELERQFDLLQIDVDRLILLQKKRKTATPENEKELQRFKDLQGRYRYHQQQMELALRLIANEELEPQQVRDIEEEILFYVEENQTEGFVEDDSIYEGLDLQSNEAIAHEVAAAFASRAAGDASGDDNESKDGKLSKKELRRLEREAKKNAKAAAKTTALDENPTPVITGKKLPDLANEMQEADSQDSITIPETPTPPPSKSVSPSPPVTAGSANVPLTTANTTAPSKPHTPLAKSAHLSSNPTSQASLSPDSQPHGFTHIHQSLNGLTTTTLKPAPVKPISENKWALATEKKLASLKAKSLASAPVTTKVSLTPTNMLPGASTVALPMVSKPLEPTLSISNSIKIIPQELQGNNTVKQHTGDATEPDLILDDYDAESTDDELENEPTPEIFTAEQISSRLTLSNEVQDSLYSDLELLTLPAGIKDFVMGSVISKNKLYPNDGKLGGYRRYYDICQPCRLNEIPSGVFPPQPLDVARCTQQWDQVILSLNIDGLTVETVPKEFENLETFTLFYHYYFSVTPLEQRICALLLKQREWRVLKTGDCWFLRQGAVKFSNDQCEVADYKIFKMDIWTVVDKLNFKLDYSLLADVASLGQVDHADHADSSVNLPTFGKQLLQTLKHGKVEQQ

SEQ ID NO: 15924 - protein, 167 aa, Oryza sativa (japonica cultivar-group)
MASAAVAADGAADGKKMILLVSSDGVKFELSEAAASLSKTLGNMIEDDCATNGAIPLANVAADILAMVVEYCNRHAAAAANASGQEELIRKFDAEFVNIDRKKLFGLINAANFLNMPCLLELTCQRTADLIKDMMPEQVREVFGIENDFTPEEEAEVRNENAWAYEM

SEQ ID NO: 15925 - protein, 1495 aa, Oryza sativa (japonica cultivar-group)
MASNPSSSAARAAGSQGGGHGGARLEDLALDKVAEAADAVAAASSAGEVVRAIHAVAALVFPVDSAAVAGTVDEPFRSQIINGVSLSNDERGSWRHAFYHGPAFPTISKILLGHVALKWLRQIRASARKEIYDSFFVKGPPTEVIQALVPALSHKGGSKEDHNIMCSNIERLLILCLVENKGVSQIIAEFTLLVATEQAAMELAAGEDANGLDASNSVFLFVGEVISRVSRRGSTGILVAELIPRIRSHLKRCMESDHKTISPDKIKHVSQFWFNVVEAIRDQHSVERLAEEMLRQLASQHTSDEEAYWILWTLFNQSFMHKTVLRAMFVDKFLRWKTFPLCCLRWILHYAVFELPPNSGIETQKQRTSSFLAIGLCLEKMSKRELETTKDVLNNILEGVSCRLESPIDLIRKMASAIALTFSKVVDPNNPLYLDDNCCENVEWDFGVLSPKEITAPSKDVELISKLKPSLPENKKHAGERRAKAIKHDTSENRAKIIEIKSLDSCETSGSAVNGHFGEEECDEEIMNIDASSDSSLEPYDLSDDDSDLQKKFTQLKDLAAALRKPDDPDGVENALSSAEKLVRASPDELRHNSGDLVRALVHVRCSDVAMEGEEDSAEEKRQKALVALLVTCTFEPLDVLTKLLYSSSVDVSQRILIIDVMTEAAQELAETKIVRRELRHGNLISDTSPSWLVPSDQGPAGAGPWREVSESGTLLNWSHRYEREVPSRSGQVKSGKSRKWGLGKAKDLQTEWSKNRFPLYAAAFMLPVMQGYDKRSHGVDLLNRDFVVLGKLIYMLGVCMKCMAMHPEASAVAPALLDMIRSRYAKPKTSISVLKTFLVITKWAVSQHPEAYVRRSVLFAASCILIALHPSYVASSLIEGNQDVSTGLEWIRTWALHVAETDPDTECTSLMMMSKRELDESCRGEVSVGTTSHRMGPLLERWISREGRSDGGDSSGPAQPLFRISLSLASQEQRQSKASSAMGNSLPVESKFTFEEENDRIKYVVSSMQGWGEKMEDAHAAILNLDDATSTSFFGVYDGHGGAEVALYCAKQFHIELCNHEDYHNDLINALDNVFLSMDENLQQSDAWRELVIPHDNGCMYFLKAGVCAKPFPQATYTGPAYEGSTACVVVIRGNQMIVGHVGDSRCVLSRQGGLAIDLSFDHKPCTRTESERERVQNAGGRSLGLRCEQVMGNYVVKEQWVLGDFGGGDFAFKKNKDLDREKQMLVCDPDILADDITDDMEFLVIASQGLWSCVDSADVVSYIHDRLSVEGAELRVICEEVVEFGLASGENTTVILVQFKPGAFQYQLVDPAGFGTAVSNIASTSAAPAGASDTSDEGVMADSCATADTSGSARAESGELVPTPSANNTVTDEVDPTGTVAADDKVDPNSSANADADDGAPKPSLGAVIESDEVALDATATGHQVAVRQQEEFDPKKCWICGKGYKKILLEPSSARARNPLLAHAKTCESEDKKAKKKITKYMMKANVTNQYH

SEQ ID NO: 15926 - protein, 746 aa, Ralstonia solanacearum GMI1000
MNSKTDRPAEGAGATADRAAREAAVARALECLADHAGDHQTLTGEPLVSHARGTVAILEGLRVDAPSLQAAALFLLPILATDNEKAIEPAFGGEVARLVHDVRQLLRIGAIAGMASPAEAGVTRKNEAEARRAQVEALRKMLLAFAQDIRVVLIRLASRLQSLRWLAQNKLPAPEGMARETLDIYAPLANRLGIWQLKWELEDLGFRFEDPDTYKRIARLLDEKRIEREQFIGEAIARLQQTLRDAGIHAEVSGRPKHIYSIWRKMRGKDLDFADLYDVRAFRVIVDDIKDCYTVLGFVHHMWQPIPKEFDDYISRPKTNGYKSLHTVVIGDDGRALEVQIRTREMHHFAEYGVAAHWRYKEAGSKGYAGQFSASERYDEKIAWLRQLLAWKDDAEHTVAQEDSPWEQLKHTELDDHIYVLTPQARVIALPQGATPVDFAYYLHSDLGHRCRGARVDGTMVPLNTPLKNGQTVEIVTVKQGGPSRDWLNPELHYLASNRARAKVRAWFNALELEETLAQGRILIDKTLQREGKTAVNLEELAAKLGFKTPDELYAMVAKDEFSLRHVEAVLRTDGAPPAPADDEASITKKSRATSVARGAKSGVLVVGVDSLLTQMSRCCKPAPPDLIVGFVTRGRGVSIHRQNCATFQQLAARAPGRVIQTEWGNRGEAVYPVDIHVEALDRQGLLRDISEILSREKINVTGVRTLSSKGVAKMQFTAEVSEATQLQRALILIEEVTGVLSARRK

SEQ ID NO: 15927 - protein, 371 aa, Bacillus cereus ATCC 10987
MSKRDYYEVLGLSKGASKDEIKKAYRRLAKKYHPDVSKEENAIEKFKEVQEAYEVLSDDQKRAQYDQFGHAGANQGFGGFGGGGDFGGGFGFEDIFSSFFGGGGGRRRDPNAPRQGADLQYQVTLDFEEAIFGKELNVEIPVEDPCDTCKGSGAKPGTSKETCKHCSGSGQVSVEQNTPFGRIVNRQACGHCSGTGQIIKEKCTTCHGSGKVRKRKKINVKIPAGIDNGQQIRVSGKGEAGVNGGPAGDLYVVVHVRNHEFFEREGDHIICEMPLTFAQMALGDEVEVPTVHGKVKLKIPAGTQTGTEFRLKGKGAPNVRGYGQGDQYVVVRVVVPTKLTSQQKDLLREFAGQEEQDDSLFGKLKRAFKGE

SEQ ID NO: 15928 - protein, 171 aa, Triticum aestivum
LGDNPMRRTTSLTEVAPPSVLAVVLEEEDEDEQVKAVVQAEEGGAGGGQDWLAALGGGSGAPGTDWLAAYRARAAPARAGLRRNSADYSKVETAAFLRHCGLCRRLLGPGRDTFMYKGEAAFCSLECRQQHITHEEWKDKRTSRSMSEAAAPATSRGRSGKTDTGGTVAAA

SEQ ID NO: 15929 - protein, 426 aa, Triticum aestivum
MSSAMESSYLPATTESIEKAQEAKDASESISILYRVIQDPSSSADALRIKELAITNLTNYLTKENRAEDLRNLLTQLRPFFSLIPKAKTAKIVRGIIDAVAKIPGTSDLQISLCKEMVEWTRAEKRTFLRQRVEARLAALLLENQEYTEALTLLTGLIKEVRRLDDKLLLVDIDLLESKLHFSLRNLPKAKASLTAARTAANAIYVPPAQQGTIDLQSGILHAEEKDYKTAYSYFFEAFEAFNALDDPRAIFSLKYMLLCKIMVNQADNVAGIISSKASLKYVGPDVDAMKAVADAYSKRSLKYFETALRDFKAQLEEDPIVHRHLSSLYDTLLEQNLCRLIEPYSRVEIEHVAQMIELPVDHVEKKLSQMILDKKFAGTLDQGAGCLIIFEEQKTEAIFPATLETISNVGKVVDSLYMRSAKIMA

SEQ ID NO: 15930 - protein, 1520 aa, Oryza sativa (japonica cultivar-group)
MASNPSSSAARAAGSQGGGHGGARLEDLALDKVAEAADAVAAASSAGEVVRAIHAVAALVFPVDSAAVAGTVDEPFRSQIINGVSLSNDERGSWRHAFYHGPAFPTISKILLGHVALKWLRQIRASARKEIYDSFFVKGPPTEVIQALVPALSHKGGSKEDHNIMCSNIERLLILCLVENKGVSQIIAEFTLLVATEQAAMELAAGEDANGLDASNSVFLFVGEVISRVSRRGSTGILVAELIPRIRSHLKRCMESDHKTISPDKIKHVSQFWFNVVEAIRDQHSVERLAEEMLRQLASQHTSDEEAYWILWTLFNQSFMHKTVFELVDVLGKVNDSLQIPCIETQKQRTSSFLGTLQTLVSVWSKKEFVQAYSVEQQAYITAAIGLCLEKMSKRELETTKDVLNNILEGVSCRLESPIDLIRKMASAIALTFSKVVDPNNPLYLDDNCCENVEWDFGVLSPKEITAPSKDVELISKLKPSLPENKKHACERRAKAIKHDTSENRAKIIEIKSLDSCETSGSAVNGHFEEEECDEEIMNIDASSDSSLEPYDLSDDDSDLQKKFTQLKDLAAALRKPDDPDGVSFYLVLPVLSRANYCKILIILPSFLPKVENALSSAEKLVRASPDELRHNSGDLVRALVHVRCSDVAMEGEEDSAEEKRQKALVALLVTCTFESLDVLTKLLYSSSVDVSQRILIIDVMTEAAQELAETKIVRRELRHGNLISDTSPSWLVPSDQGPAGAGPWREVSESGTLLNWSHRYEREVPSRSGQVKSGKSRKWGLGKAKDLQTEWSKNRFPLYAAAFMLPVMQGYDKRSHGVDLLNRDFVVLGKLIYMLGVCMKCMAMHPEASAVAPALLDMIRSRSAKPKTSISVLKTFLVITKWYDFDIGFCFCRAVSQHPEAYVRRSVLFAASCILIALHPSYVASSLIEGNQDVSTGLEWIRTWALHVAETDPDTECSSMAMTCLRLHSEMALQTSRALESADHSKASSSSSSKASSAMGNSLPVESKFTFEEENDRIKYVVSSMQGWGEKMEDAHAAILNLDDTTSTSFFGVYDGHGAALGNVGYHCSCDCCSMDENLQQSDAWRELVIPHDNGCMYFLKAGVCAKPFPQATYTGPAYEGSTACVVVIRGNQMIVGHVGDSRCVLSRQGGLAIDLSFDHKPCTRTESERERVQNAGGRSLGLRCEQVMGNYVVKEQWVLGDFGGGVTISRSIGDFAFKKNKDLDREKQMLDDITDDMEFLVIASQGLWSCVDSADVVSYIHDRLSVEGAELRVICEEVVEFGLASGENTTVILVQFKPGAFQYQLVDPAGFGTAVSNIASTSAAPAGASDTSDEGVDDAATARPTVMGYDADSSTGSADATVDSDEVDPNATADSYNPRGHAEIVASHTDDEVYTSGSARVESGELAVPTPSANNTVADEVKVDAAVVAGGSTTAMAADEATVVSLLSTIVDNYYSINTSEEPARRLIPLPLSQPTTRSPTAAPAPRPAASCTPAILHSILSWSKMMCDDACTAACAG

SEQ ID NO: 15931 - protein, 380 aa, uncultured gamma proteobacterium
MIASKLPNVGTTIFTRMSALANACGALNLSQGFPDFDAPPALLEAMARHVRAGHNQYAPMPGVPALREQITNQLLRHRGVVCDPEDEITVLPGATEGIFCAVMACIHPGDEVLVFDPCYDSYEPAILLAGGHARHIPLEPGSFRIDWQQVAGAINARTRLVIINSPHNPSGATLSREDLLHLQSLAEEHDLLVISDEVYEHLVFDGQQHHSALQHPGLRQRSFVMFSFGKTFSVTGWKTGYCVAPAALTAELRKVHQFVCFVAVTPVQMAIADFMAAEPDYPATLPAFYQRKRDLFCGALWDSRFRFTPSAGTYFQLLDYSGITQTPDCQLAEDWTREKGIAAIPVSVFYQEPPDQHLLRFCFAKNDQVLLEAAERLCKI

SEQ ID NO: 15932 - protein, 245 aa, uncultured gamma proteobacterium
MVYWQGESVMSMSKKLGAEFIGTFWLVLGGCGSAVLAAAFPEVGIGLLGVSLAFGLTVLTMAFAIGHISGCHLNPAVSVGLMLGGRFSSTELLPYVTAQVLGGIAGAAVLYVIATGQPGFEITEGFEKAIFASNGYGAHSPGGYSLTAALVTEVVMTFMFLIIILGATDKRAPAGLAPIAIGLGLTLIHLISIPVTNTSVNPARSTGVALFEGGWAISQLWLFWVAPIVGAALAGLVYNWLGSED

SEQ ID NO: 15933 - protein, 607 aa, Bacillus cereus ATCC 10987
MNKEERAKRQSKIRNFSIIAHIDHGKSTLADRILEKTNALTQREMKAQLLDSMDLERERGITIKLNAVQLNYKAKDGEEYILHLIDTPGHVDFTYEVSRSLAACEGAILVVDAAQGIEAQTLANVYLALDNNLEILPVINKIDLPSADPERVRQEVEDVIGLDASEAVLASAKAGIGIEEILEQIVEKVPAPTGDSEEPLQCMIFDSLYDPYRGVIAYIRVVNGTVKVGDKVRMMATGKEFEVTEVGVFTPKTTQRDELTVGDVGFLAASIKNVGDTRVGDTITHAKRPAAEPLPGYRKLNPMVFCGLYPIDSARYNDLRDALEKLELNDSALEFEPETSQALGFGFRCGFLGLLHMEIIQERIEREFKIDLITTAPSVIYKVFLTNGEDMIVDNPSNMPDPQTIDRVEEPFVKAAIMVPNDYVGAVMEICQGKRGTFIDMQYLDETRVTLTYEIPLSEIVYDFFDQLKSNTKGYASFDYELIGYKPSKLVKMDILLNSEQVDALSFIVHRDSAYDRGKVIVEKLKELIPRQQFEVPIQATIGNKVVARSTIKAMRKNVLAKCYGGDISRKRKLLDKQKEGKKRMKSVGSVEVPQEAFMAVLKMDDN

SEQ ID NO: 15934 - protein, 426 aa, Yersinia pseudotuberculosis IP 32953
MTPSDLVFDQQHIWHPYTSMTEPLPCYPVVGAEGVELQLADGRRLIDGMSSWWAAIHGYNHPVLNFAAHQQLDKMSHVMFGGITHPPAVKLCRQLVAMTPPPLECVFLADSGSVSVEVALKMALQYWQAKGEQRQRILTLRHGYHGDTFGAMSVCDPQNSMHSLYQGYLAENLFANAPQCGFDDPWDPQDIANFVALITQHANEIAAVILEPVVQGAGGMRIYHPSYLREVRALCDKHQILLIADEIATGFGRTGKLFACEHAQIVPDILCLGKALTGGYLTLSATLTTRAVAETISKGDAGCFMHGPTFMANPLACAVASANLSLLAENSWQQQVSKIEDQLKRELLPLAQEDTVADVRVLGAIGVVEMKKPVNVARLQRSFVEQGVWIRPFGKLIYLMPPYIISQHALTRLTAAVAAAVVDRGS

SEQ ID NO: 15935 - protein, 303 aa, Nicotiana tabacum
MEKYEKLEKVGEGTYGKVYKAKDKATGQLVALKKTRLEMDEEGIPPTALREISLLQMLSNSLYIVRLLCVEQIDKNGKPLLYLVFEYLDTDLKKFVDSHRKGPNPRPLPPSLIQSFLYQLCKGVAHCHSHGVLHRDLKPQNLLVDKEKGILKIADLGLGRAFTVPIKSYTHEIVTLWYRAPEVLLGSTHYSTAVDMWSVGCIFAEMVRRQALFPGDSEFQQLLHIFRLLGTPTEKQWPGVSSLRDWHVYPKWEPQNLASAVPALGPDGVDLLTKMLQYDPADRISAKAALDHPYFDSLDKSQF

SEQ ID NO: 15936 - protein, 406 aa, Zea mays
  misc_feature (129)..(129): Xaa can be any naturally occurring amino acid
  misc_feature (160)..(160): Xaa can be any naturally occurring amino acid
  misc_feature (170)..(170): Xaa can be any naturally occurring amino acid
  misc_feature (198)..(198): Xaa can be any naturally occurring amino acid
MEVGDARNGSAAAALTKGSADDAARKPLPPCCVKAKARVPETEANCHDTVVSGWFTEPRSRFGKTSKVQYFNNPMWPGEAHSLKVEKILFQGKSPYQEILVFESSTYGNVLVLDGIVQLTDKDECAYQXNGCYFATEQIELKDVLPTLRLLMSSNFMGSXPYDISLLTDXVLVVGGGDGGVLREIARHDSVETIDICXKEFFPNLSIGFKDPRVRLHVGDAVDFLRNSPEGKYDAIIVDSSDPIGPAQALVEKPFIQTIARALKPGGVLCNLAESMWLHTHLIQDMLAICRQTFKGAVHHAWTSVPTYPSGVIGFLLCAKEGRAVNFLTPVNPIEKIEGTAKAGRELRFYNSEIHRAAFVLPTFVRRELEAYTTPSASAENEKPKESVSEPQKIKILSNNAILTAT

SEQ ID NO: 15937 - protein, 504 aa, Glycine max
MSSTTQNRRSSFTPSTASSLAKAKRHPSSVSSSSSGKAKVVSTQNLAVKRAPLANLTNQRNAPYSSSSSSLVQGSNKVAKTKKEAPARTSVSKSTISGNKSSQLKSVNSSSVVIPKANSLSQKKDAAPTVATFAVPVRSGIDVSPSKSDGRFVSMDETTSSCDSIKSPDEVEYLDNRDVSDVDSIQKKIISNLNISDTTEPEGNVCSREIIVELEERVDKIVNIDNIYSDTQLCATYVCDIYKHLRESEEKKRPSTDFMDTIQKDINVSMRAILVDWLVEVAEEYRLVPETLYLTVNYLDRYLSGNAMNRQRLQLLGVSCMMIASKYEEICAPQVEEFCYITDNTYLKEEVLQMESAVLNYLKFEMTAPTVKCFLRRFVRAAAHDVQEIPSLQLEYLTNFIAELSLLEYSMLSYPPSLIAASVIFLARFILFPSKKPWNSTLQHYTLYRPSDLCACVKDLHRLCCSSHDSNLPAIRDKYSQHKYKCVAKKHIPPSIPREVFQIN

SEQ ID NO: 15938 - protein, 488 aa, Corynebacterium efficiens YS-314
MTIRAAVSHPVGPSGRNPGTGQMRDAMQCGHGAGCGSRPPRCPRRPSIRGAVTHPRLTPWPPQKKYLFTGFKREQVFRFMVECVKGRPNVLAIVLAGGEGKRLFPLTEDRAKPAVPFGGTYRLIDFVLSNLVNAGYLKIAVLTQYKSHSLDRHISVSWNVSGPTGQYIASVPAQQRLGKRWFTGSADAILQSLNLISDEKPDYVIVFGADHVYRMDPSQMVDEHIKSGKSVSVAGIRVPRHEATAFGCIQSDDEGNITEFLEKPADPPGTPDDPDVTFASMGNYVFTTEALVRALKDDSENEDSEHDMGGDIIPYFVDRGDAHVYDFSRNIVPGATERDKGYWRDVGTIDAFYECHMDLISVHPIFNLYNKEWPIHTTVEGNLPPAKFVQGGIAQSSMVAPGSIISAGTVRNSVLSTDVIVEEGATVEGAVLMPGVRIGKGAVVRHAILDKNVVVRDGELIGVDHDRDSQRFKVSAGGVVTVGKNQVV

SEQ ID NO: 15939 - protein, 336 aa, Arabidopsis thaliana
LAFSSHPLTSSVLFRGSKSIGTITKIASTIRTVKMAAFAGSDSETTSSTSRVIDSHLHIWASPQEAETYPYFPGQEPTLTGDVNFLLKNMEEARVDGALIVQPINHKFDHSLVTSVLKRYPSKFVGCCLANPAEDGSGITHLENLVLESNYRAVRFNPYLWPSGQKMTNAVGKALFSKAGELCVPVGFMCMKGLDLHIAEIEELCTEFPKTTVLLDHAGFCKVPESGEAKLAYSQLMKLSRFPQVYVKFSALFRISRTGFPYQDLSPLLSQLVSHFGANRVMWGSDFPFVVLECGYKEAKEAVTIIAKEASLSSSEMDWILGKTLMQLFPGQWVLP

SEQ ID NO: 15940 - protein, 346 aa, Lactobacillus plantarum WCFS1
MKAATFIEPGKVEVKEYDKPTIQKPTDAIIRVLRACVCGSDLWWFRGISQRQAGSTVGHEAIGIVESVGSAVKDVQAGDFVIAPFTHGCGHCAACLAGFDGDCLNQEAGGNGGYQGEYLRFTNANWALVKIPGQPEDYSDDMLNNFLALADVMATGFHAATSAEVKKDDTVVVMGDGAVGLSGVLSAKLLGAKRIIAMSRHEDRQKLAKAFGATDIIAERGDEAVAKVMALTETGADAVLECVGTEQSVDTAVKVGRPGAVVGRVGVPQKAEMNTNNLFWKNIGLRGGIAAVTTDDKQVLLDAVLTGKIQPGQVFTKRFMLDDIQAAYEAMDQRNAIKSLVIVSDK

SEQ ID NO: 15941 - protein, 532 aa, Prunus persica
GYWVLKEKFRGGINVQEKVKIQKEPMKLFMENGIEELAKTSFEELEKSKDSKDDIDVRLKWLGLFHRRKNHYGRFMMRLKLPNGVTTSAQTKYLASVIRKYGEDGCADVTTRQNWQIRGVVLPDVPEILKGLAEVGLTSLQSGMDNVRNPVGNPLAGIDPEEIVDTRPYTNLLSQYITANSLGNPTVTNLPRKWNVCVVGSHDLFEHPHINDLAYMPATKDGRLGFNLLVGGFFSPKRCAEAVPLDAWVSADDVIPLCKAVLEAYRDLGTRGNRQKTRMMWLIDELGIEGFRAEVAKRMPFQELERASSEDLVQKQWERRDYVGVHPQKQEGLSYVGLHIPVGRLQADDMDELAHVADKYGTGELRLTVEQNIIIPNVENSKLEALLKEPLLKNRFSPEPSILMRGLVACTGNQFCGQAIIETKARALKVTEEVERHVAVTRPVRMHWTGCPNTCAQVQVADIGFMGCMARDENGKPCEGADVFLGGRIGSDSHLGDVYKKSVPCKDLVPLVVDILVKHFGAVPREREEGED

SEQ ID NO: 15942 - protein, 454 aa, Vibrio fischeri ES114
MFGVFKPKAHIAQLPTGEINSTYKRLRWQLFLGIFFGYAGYYLVRKNFSLAMPYLIEQGYSRGDLGVALAAVSIAYGLSKFLMGSVSDRSNPRYFLSAGLVMSALVMFCFGFMPWATGSITAMFILLFLNGWFQGMGWPACGRTMVHWWSRKERGEIVSVWNVAHNVGGGLIGPMFLLGLWAFNDDWRTAFYVPAFFALLVAFFVWLTVRDTPQSCGLPPIEEFKNDYPDDYDSAYETEMTAKEIFFKYVFSNKLLWSIAIANAFVYLIRYGVLDWAPVYLKEAKEFTVDKSSWAYFLYEWAGIPGTLLCGWISDKLFKGKRAPAGILFMALVTIAVLVYWFNPAGNPTVDMIALVAIGFLIYGPVMLIGLYALELAPKKAAGTAAGLTGLFGYLGGAVAANALLGYTVDHFGWDGGFMILVASCVISIVCLTYALIGEQKHHKEKIEKESHMA

SEQ ID NO: 15943 - protein, 342 aa, Oryza sativa (japonica cultivar-group)
LCWDSLLCPPIHFFFFQATYTEPAYEGSTACVVVIRGNQLIVGHAGDSRCVLSRNGQASALSVDHKPDSESERERVQNAGGVAVGHSYRKIMGRWVTKKQWGFTDFKGRVSISRSIGDFACKKNERLPPEDQMLTCNPDILTMDITDDMEFLVIATEGLWCNMTNQNVVDHTHDRLLEGAEARVICEELVQFGLPSGDNTTVILVLFKPGAYPAVPPVDTDTDTDSHTGDDVDNNDPANEVDPTANAGSDDSNTSDEVKVDATATAVGSSSTTAVAADEATVVSLSTATITIVDNYFFINTSEEVDPTANAGSDDSNTGDEVKVDATASSGLSDWELIYSEF

SEQ ID NO: 15944 - protein, 161 aa, Narcissus pseudonarcissus
LKKGSSTDQDVEVYRGEEFDDDGRPRRTGTVWTASAHIITAVIGSGVLSLAWSMSQLGWIAGSVTLFLFSIVTFFTSSLLTDCYRSPDPVHGKRNYTYMSAVKSNLGSTKVWFCGICQYVILVGTAIGYTITASISAAAISKSGCFHKKGHEADCAVSDSL

SEQ ID NO: 15945 - protein, 627 aa, Frankia sp. EAN1pec
MATPVSEVVGVADLETVRELAQQLRVDSVRSSTSAGSGHPTSSMSAADVMAVLLTRHLRYDWDTPDDPANDHLIFSKGHASPLIYSMFKAVGVVTDDELMTGYRRFGHRLQGHPTPVLPWVDVATGSLGQGLPDAVGVALAGKFLDKVPYRVWVVCGDSEMAEGSMWEALDKAAFYGLSNLIAIVDVNRLGQRGPTEFGWDMDAYARRVEAFGARAVVIDGHDLGAIDAALADAEDATRPTVILARTRKGEGFSEVADAEGWHGKPLPEDMATRAIIELGGERNLRVRGPVPPADMARPAPAQKPAIKLPTYELGAKVATRRAYGQALAAVGAHTDVVALDAEVSNSTYAEDFAKAHPDRFFEIFIAEQQLVAAAVGLSVRGYVPFASTFAAFFSRAYDFIRMAAISQVDIRLAGSHAGVEIGADGPSQMALEDLAMMRAVGGSTVLYPSDATSAAKLIEAMVGISGVSYMRTTRGAYPVLYGPDETFAPGGSKVLRSSDADTVTLIGAGVTLHHCLAAADVLAAEGVSARVIDLYSVKPVDTATLAEAARATGGRLVVAEDHYAEGGLGGAVLEGLAGVLRDGSVSLRLAHLAVGELPGSGTPDELLDFAGISTPHIVEAARGLLR

SEQ ID NO: 15946 - protein, 258 aa, Synechococcus sp. CC9311
MDLQLKGKVALVTGGSRGIGRATALRFGSEGCNVAICARGEEGLNKTLGELKDLGVMTFGVVADMSIAGEAARFVDEAADALGGVDMLVNNVGGSSNSTFSEACDEDWLKAFNLNLFHAVRATRASLPYFRKRRGGSVVTIASISGWRPAPDKAIYGATKAAEIFLSSSLAWELSPQNERVNTVSPGSIDFPGGVWERFRKQNPEQFAAFAGREFPAGRLGNAEEVANVIVFLSSPKANWINGAHIPVDGAQGRPSVF

SEQ ID NO: 15947 - protein, 331 aa, Glycine max
MEVERIQTLSLNQLKELPPQFIRPANERPENTKAIEGVIVPLISLSQSHHLLVKEIAEAASEWGFFVITDHGMSQTLIQRLQEVGKEFFALPQEEKEAYANDSSEGKFEGYGTKMTKNLEEKVEWVDYFFHLMAPPSKVNYDMWPKHPSSYREVTQEYNKEMLRVTNKVLELLSEGLGLERKVLKSRLGDEEIELEMKINMYPPCPQPHLALGVEPHTDMSALTILVPNEVPGLQVWKENSWVAVNYLQNALMVHVGDQLEVLSNGKYKSVLHRSLVNKERNRMSWAVFVAPPHQAVIGPLPSLINDQNPPKFSTKTYAEYRYRKFNKLSQ

SEQ ID NO: 15948 - protein, 472 aa, Candida glabrata CBS 138
MSLSSAARATPALRAQAYKALTSTRAFSATSISSEKTLKDTFADIFPKQAEEIKQFKKEHGKTVIDQLLLEQAYGGMRGIKGIVWEGSVLDPEEGIRFRGRTIPEIKKELPTIGGSSEPVPEALFWLLLTGEVPTESQVKAFSADLASRSEVPEHVLKLLDSLPKDLHPMAQLSIAVNALETESKFAKAYARGVNKKEYWSYTFEDSLDLLGKLPVIASKIYRNIFKDGKICQVDPNADYGKNLAHLLGYTNKDFVDLMRLYLTIHSDHEGGNVSAHTTHLVGSALSSPYLSFAAGMNGLAGPLHGRANQEVLEWLFTFREEVKGDYSKETVEKYLWDTLNGGRVIPGYGHAVLRKTDPRYTAQREFALKHFPDYELFKLVSTIYDVAPKVLTKHGKTKNPWPNVDSHSGVLLQYYGLTEASFYTVLFGVSRAFGVLPQLIIDRAVGAPIERPKSFSTEKFKELVKSIESKK

SEQ ID NO: 15949 - protein, 45 aa, Desulfitobacterium hafniense DCB-2
MTADWVRLPYDLMEKISTRIVNEVKGVNRVVYDITSKPPGTIEWE

SEQ ID NO: 15950 - protein, 361 aa, Arabidopsis thaliana
MAENLACGETSESWIIDNDDDDINYGGGFTNEIDYNHQLFAKDDNFGGNGSIPMMGSSSSSLSEDRIKEMLVREIEFCPGTDYVKRLLSGDLDSSVRNQALDWILKVCAHYHFGHLCICLSMNYLDRFLTSYELPKDKDWAAQLLAVSCLSLASKMEETDVPHIVDLQVEDPKFVFEAKTIKRMELLVVTTLNWRLQALTPFSFIDYFVDKISGHVSENLIYRSSRFILNTTKAIEFLDFRPSEIAAAAAVSVSISGETECIDEEKALSSLIYVKQERVKRCLNLMRSLTGEENVRGTSLSQEQARVAVRAVPASPVGVLEATCLSYRSEERTVESCTNSSQSSPDNNNNNNNSNKRRRKQ

SEQ ID NO: 15951 - protein, 215 aa, Vibrio fischeri ES114
MSKTIHYQKTHFITSAPDIRHLPEDEGIEVAFAGRSNAGKSSALNRLTNQKSLAKTSKTPGRTQLINLFKVEENCHIVDLPGYGFAQVPLEMKKKWQKSLGEYLQKRQCLQGLVVLMDIRHPLKDIDQQLVFWAVDQNIPVQILLTKADKLKSGARKAQVLKVREAAVDFGGEVEVDAFSSLKGIGVDKLRAKLDEWFAPAFELDDEFIEDLDAE

SEQ ID NO: 15952 - protein, 607 aa, Xanthomonas campestris pv. vesicatoria str. 85-10
MAVIEIKVPDIGDYSDVPVIEVLVAVGDSVAKDQGLVTLESDKATLEVPSSAAGVVKELKVKVGDTLSEGALVLLLETEGEAAAPAKAEPKAAPAAAAPAAAPGSKPPVTPSHRAPAEPAAPKPALASGKPADIECKMVVLGAGPGGYTAAFRAADLGLETVLIERYASLGGVCLNVGCIPSKALLHAAAVIDEVAHAGDFGVDFGQPKIALDKLREYKEKVVGKLTGGLASMAKQRKVRTVTGVASFVSPNELEIVGDDGKTQLLRFEHCIIAAGSQAVKLPNFPWDDKRVMDSTDALELHDIPKTLLVVGGGIIGLEMATVYSALGSKVTVVEFMDQLMPGADKDLVKPLADRLKKQGVEVHLKTKATDVKADKAGITVSFEAAVEGEKPGLQATTYDRVLVAVGRSPNGKKIGAEKAGVTVTERGFIPVDRQMRTNVPHIFAIGDIVGNPMLAHKATHEGKLAAEVAAGEKKEWVARVIPSVAYTNPEIAWVGVTETEAKAKGLKVGVAKFPWAASGRAIGIGRTEGFTKLIFDEQTHRVIGGAIVGVHAGDLLAEIGLAIEMGAEAEDIGHTIHAHPTLSESVGMAAEVYDGTITDLYIPKKK

SEQ ID NO: 15953 - protein, 298 aa, Glycine max
  misc_feature (187)..(187): Xaa can be any naturally occurring amino acid
  misc_feature (207)..(207): Xaa can be any naturally occurring amino acid
  misc_feature (212)..(212): Xaa can be any naturally occurring amino acid
  misc_feature (229)..(229): Xaa can be any naturally occurring amino acid
MTLLSSHLLVFSAVHHRAPPTTTTRNSPTTNHTVRFLCSPGVPPAVRLDQRLPRFVVPGAGAEDLLYNAGATVGVLGGGYALVRAFDELTRRNILQQGLSRKLVHILSGLLFLVSWPIFSNSPKARYFAAFVPLVNCLRLLVNGLSLASDEGLIKSVTREGDPLGPHYYVLILIFCALVFWRESPVXVVSLAMMCAGDGIADIIGRXYGSLXIPYNQHKSLAGSMSMLXFGFLVSIGMLYYYSVLGHVQLDWASTVPRVAFISFVATLVESLPITKVIDDNISVPLATMVVAFFTFHH

SEQ ID NO: 15954 - protein, 512 aa, Coprinopsis cinerea okayama7#130
MKDTENATARATRATVRGKVAGATTAVTSRVTAPTVASKAKAVSTDAEGNVGKRKRGALVEVTGVNKNSTHTTAAKGKEAAPTKPTTGATQRVLRRAPASSTAARTAKVAESAAIKKKESSKPPSRTLAPKVYRDDAPVEEQAPADDDEADVERVSKRRHMEAVPEDTSQRDAERVARDLVAAAKEEEIAVDQQETFEPEPQLWEDLDADDWDDPLMVSEYVHDVCAYWKKTELATLPKANYMEGQQELTWDHRGILIDWILQVHARFNLLPESLFLTVNLLDRFLSARPISLNKLQLVGLACFFIASKFEETCAPSVNEIVFLADNQYTVAEVLKAEMYILRVLDWDLSCPGPMSWLRRGSKADECESTARTVAKYLLEIGCLEHRLVGIVPSHMAAAALWLGRLAVGREEWTPTLEHYTTFTEKEILPVATIMLEYIITNPIQHESLYKKYAHKRYLKCSAYMRQWALERWPENSDVHLKRDLKRIKAEIRQHNEELAAEAAAEAVRPAH

SEQ ID NO: 15955 - protein, 554 aa, Coprinopsis cinerea okayama7#130
MWSLVLRALAAVFLTHIALKWVQTRLKYRSIRNLPGPPPENYFIGNFKQLFSPNAWSFHRSISETYGGVVKISGLFGVSASSTVVRRAGNSKLRVGEATDQHIYEETAEFTAGNLVLFGPGLGSTHGEVHRKQRKMLNPVFSPAHLRGMVPIFWEVSSKLAAALERKISNNGEQEINMYSWLGRTATELIGQSGLGYSFDSLLDDEDGAHPFTKAMHALEAPARRILWFLHFVFPWAQKIGTPKFQRFLVNIVPWKDLHLIRDLIDTFYATSCEIFERKKRAIEQGEEAMAGEVGRGKDIISVLMAENMKASEEDRLPDEEVLGQISTLAFAAGDTTTNALSRVLWLLCQHPEAQEKLRAEIQAAQSEFGNLDYDRLGALPYLEAVCRETLRLYSPVTFLLRKAKQDAILPFSKPTRGLDGEKITEVHVPKGTMLFISIVSANQNPDLWGPDSYEWKPERWLSTLPEAVTEAKIPGIYANLMTFLGGGRACIGIKFAQLELKVVLCTLLQQFQFSLPKDSSIYWKMATIAKPYLPGEDTVPQLPLIVSRCRAMA

SEQ ID NO: 15956 - protein, 490 aa, Yersinia pseudotuberculosis IP 32953
MSRYGLQKLYINGAYTDSTSGDTFDAVNPANGECIAQLQAANAQDVDKAVAAAKQGQPVWAAMTAMERSRILRRAVDILRDRNDELAAIETADTGKPLSETRSVDIVTGADVLEYYAGLIPALEGQQIPLRGSAFVYTRREPLGVVAGIGAWNYPLQIALWKSAPALAAGNAMIFKPSEVTSLTALKLAGIYTEAGLPAGVFNVLTGSGDQVGQMLTEHPGIAKVSFTGGIASGKKVMANAAGSTLKDVTMELGGKSPLIIFADADLDKAADIAMMANFYSSGQVCTNGTRVFVPLALQAAFEQKIVERVKRIHIGDPSDERTNFGPLVSFQHRDSVMRYIDSGKREGATLLIGGYSLTEGALAHGAYVAPTVFTHCRDDMQIVREEIFGPVMSILSYQSEEEVIRRANDTEYGLAAGVVTQDLNRAHRVIHQLQAGICWINTWGESAPEMPVGGYKHSGVGRENGISTLEHYTQIKSIQVELSSFNSVF

SEQ ID NO: 15957 - protein, 277 aa, Bacillus cereus ATCC 10987
MKQLYGVIGNPIGHSLSPVMHNDAFEHLNMDAHYHAFLVKEEVLGEAVRGLKALGISGFNVTTPHKVAIMDYLDEIDPLAKQIGAVNTVVHKDGKLIGYNTDGIGFVRALQSISSKPLQEKRILLLGAGGASRAIYFSLADVGVKEIDVANRTVDKAKELITACKATVHSVALSLEKATEEQGNYDIIIQTTTIGMHPRVEHTPLQISSLNKGTIVSDIIYNPFETKILCEAKEQGAMIQNGIDMFVYQGALAFEMWTGRTPNIERMKQLVIRKLGG

SEQ ID NO: 15958 - protein, 393 aa, Selenomonas ruminantium
MKNFRLSEKEVKTLAKRIPTPFLVASLDKVEENYQFMRRHLPRAGVFYAMKANPTPEILSLLAGLGSHFDVASAGEMEILHELGVDGSQMIYANPVKDARGLKAAADYNVRRFTFDDPSEIDKMAKAVPGADVLVRIAVRNNKALVDLNTKFGAPVEEALDLLKAAQDAGLHAMGICFHVGSQSLSTAAYEEALLVARRLFDEAEEMGMHLTDLDIGGGFPVPDAKGLNVDLAAMMEAINKQIDRLFPDTAVWTEPGRYMCGTAVNLVTSVIGTKTRGEQPWYILDEGIYGCFSGIMYDHWTYPLHCFGKGNKKPSTFGGPSCDGIDVLYRDFMAPELKIGDKVLVTEMGSYTSVSATRFNGFYLAPTIIFEDQPEYAARLTEDDDVKKKAAV

SEQ ID NO: 15959 - protein, 426 aa, Oryza sativa (japonica cultivar-group)
MADELDELLGFLSSPQPNVRGAAAGIVRGLTGDADGLRALSARADRALPALLRLLASAGGELGTGGAAADSLVNLSQDGALSARLVSLGAVVAAMDVVAKRGGEQPGLARSLVMLLANLTQVDSGVAALLQVAHCSFSQIKFHRVNTDILNPDYTLKVGDEKMQGLYVAKLVRSFCRSSSESEEEDIFEHVASILVNISKVEAGRRILMEPKRGLLKQIIRQSDSTNQLRKKGVVSTIRNCCFEADTQIQNLLSLAEYIWPALLLPVAGKKIYSEEDRSKMPPELANALSHEREAVENSEIRQQALEAIYMIVLQDEGRRAFWSVNGPRILQVGYEDEEDPKVMEAYELIGSLVFPWLKAIKSSPYNYVRTWRNMHKQSNLPTFHRKIRKLVNVHMSPLTGGFASGQRNIQPPVGKTTGFWINVPF

SEQ ID NO: 15960 - protein, 377 aa, Saccharum officinarum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 15961 - protein, 383 aa, Arabidopsis thaliana
MEYGEEPPIKRTRRSFLMLPDDLVLNCLARISRLHYPTLSLVSKTFRSLLASTELYQTRILLGRTESCLYACLRLRTDSELLHWFILCHRPHSSKNVLVPISSPSFTSPSLPGVVVVGPDVYAIGGGSKNKNVSIYATGSKTYNALSSVMIMNSRSHTWHEAPSMRVGRVFPSACTLDGRIYVTGGCDNLDTMNWMEIFDTKTQTWEFLQIPSEEICKGSEYLSVSYQGTVYVKSDEKDVTYKMHKGKWREADICMNNGWSLSSSSSYCVVENVFYRYCEGEIRWYDLKNRAWTILKGLGRLPSLPTSHSNVKLADHGGKMAISWEEYMFVDREKKIWCAEIAIEKHQNGEIWGTLEWFDNVFISKTPNGYVGLVHALTATVW

SEQ ID NO: 15962 - protein, 352 aa, Debaryomyces hansenii CBS767
MTTKQNIGVFTNPKHELYVTEIDTPQAADLTEDEVLVHVKCTGICGSDIHFQKHGCIGPTMVVEGEHILGHESSGEILAVGNKVTNLKTGDKVALEPGVPCKSCKACLTGKYNGCEKVLFSSTPPVAGFLRRYIKHPAQFCHKINSLTYQQGALLEPLSVLYCGVRHIGLQLGQSVLVCGAGPIGYVTAKCAELAGAFPIVVTDIEQSKLDFIKKEIPSVTTVLVTGSLQENLKKVASATESFDVAIDCTGVEPSLELATHALDFGGKLHIIGVGREFQKFPFMILSVKEIHVTFQYRYANTWPTVVKLMQAGIINLDKLITHSFALEDAEEAFKLAADPKSGAMKIIIEDA

SEQ ID NO: 15963 - protein, 484 aa, Bordetella parapertussis 12822
MENLGYPARLELYVAGQWRGVEGRRTQVVVNPSTQQPLGELPLASAEDIDDALAAADQAFGDWARTTAWERADILQRAAALIEARRDRLAVVLTLENGKPLADSHGELDRVVETILWCAEEGKRTYGRVLPARAQRLSQSSLKRPVGPVAAFVPWNFPAALAARKLAAAMAAGCTVVLKPAEETPAICIELVRAFVDAGTPAGVVNLLYGVPAQVSERLIASPIIRKVSFTGSVAVGRLLASMAAGHLKPATMELGGHAPVVVFDDVDADRVAKMCVGFKYRNAGQVCLSPSRFYVHERIADRFAESFVRHAGLLRVGDGMEEGVQMGPLNNVLRLQAAERLVEQAVGAGASLALGGRRIGQRGYFYPPTVLEGVPDAADILAEEPFCPVAPIMRFGSMDEVIGRANHPSLGLAAYAFTNRMATSAEFAERIEAGWIGINNFVPALADAPIGGMKDSGLGYEGGPEGLDAYLHARFVSQLNVEV

SEQ ID NO: 15964 - protein, 437 aa, Actinosynnema pretiosum subsp. auranticum
MTLAELLPSVGMTGEPALETGLWPLGTRLERGELLLGGVPATELAARFGTPCQVLDEGTVRARARAFREALPEAEVVFAGKALPCREVYRWVADEGLSLDVCSAGELAIARSVGFPAERVLLHGNVKTPEDLKAALGYGVGRVVVDSFDEIEQLGALAEGPQDVLVRVTPGVDPRTHRAVATGVEDQKFGFSLAGGDALEAVLRVVEQPSLRLVGLHCHVGSQVRHVAVYEEAARRVVGLIASCGVRIEQLDLGGGFAVPYLPGEGEFDLGGFAHRVRVALSHECALRRVPVPRLSIEPGRAVVARAGVTLYRVAAVKRGVRRVFVAVDGGMSDNPRPALYGSRYAVRLVRRGGRRAPVTVVGRHCEAGDVLAEDVPLPEDVRAGDLLAVPVTGAYHHALASNYNAVGRPPVVGVRDGVARVLVRRETEEDLLRREV

SEQ ID NO: 15965 - protein, 214 aa, Bordetella parapertussis 12822
MHDISSLTTRTKTLPPLRVGVGGPVGSGKTTLLEMVCKAMYPQFDLIAITNDIYTKEDQRLLTLSGALPPERILGVETGGCPHTAIREDASINLIAIDQMLEQFPDADIVFVESGGDNLAATFSPELSDLTLYIIDVASGEKIPRKGGPGITKSDLFIINKTDLAPYVGADLAVMEADTRRMRGDKPFVMCNLKTGDGLDQVIAFLKTEGLFRG

SEQ ID NO: 15966 - protein, 794 aa, Idiomarina baltica OS145
MKFSENWLRSWVNPDISSEALSEQLSMAGLEVDGLEPVAADFHTVVVGKVVECGPHPDADKLQVTKVDVGENELLDIVCGAPNCRKDLMVVVAKVGAVLPGDFKIKKAKLRGHPSHGMLCSFKELGLIDDHDGIIELPSDAPIGKDYREYLGLDDLSIDIDLTPNRGDCLSIRGIAREVGVLNNIDVSEPTVDAVEATLEDAKAIHLDAPVGCPRYLGRVVKNVDVKQQTPLWMSEKLRRSGIRSIDPVVDITNYVLLELGHPMHAFDLDRIQGDVHVRYANKGETLTLLDEQEVKLDDDVLVIADDKQALAMAGVYGGLGSGVTRESKDIFLESAFFAPDAILGKARRFGLHTDASHRYERGVDPELQRQAMERATQLLIEICGGEAGPIVEAKSDEHLPKPAEVTLRAARLTSVLGIDIEAARVTEILERLGFDVKVETGEWLVKVPTYRFDIAIEEDLIEEVARVFGYNNFQAAAPAAQLRMRPQQESLISTHRLVDAMIERGYQEAITYSFVDPKHQAALFDESASLTLPHPISVDMSSMRLSLWPGLLNALAHNQKRQQSVLAFVETGLRFIPDEAAENGVVQQPMFSGVRSGKAYGEHWSAEDRGVDFYDVKGDVEALLKKTGINDVRFVASEHSALHPGQSAAIYRGERCIGYMGALHPKFEKTFGLNQRAFVFELQLDAINQRSIPSAQPVSRFPSIRRDLAVVLDERIAAGEVLTTLKNIGVNQLIDLNLFDVYQGDNLPEGKRSLALSVTLQDNEKTLEETEINGIMEKLVSTLQSEFDATLRD

SEQ ID NO: 15967 - protein, 199 aa, Oryza sativa (japonica cultivar-group)
MATTSRRSLHALLGGGAVADLVLWRRRNVSAAAVAGATAVWFLFERAGYSFPSVMANALLLLVAILFFWAKSASLLNRPLPPLPKLEVSDVVVEKAADRALVWINKVLAVGHDIAIKRDRSVFIKVILILWVVSYIGMLFNFLTLIYIGVMFSLLVPPLYEKYQDQVDEKIGMAHSVLSRHLDTIISKTGESTKQKKTE

SEQ ID NO: 15968 - protein, 335 aa, Pyrococcus furiosus DSM 3638
MDKMKIIMEKGTERLKRGFAKMVKGGVIMDVTNAEQARIAEEAGAVAVMALHKVPADIRKAGGVARMAPVEKIQEIMDAVTIPVMAKVRIGHEAEARILEALGVDMIDESEVLTPADPFFHIYKKKFTVPFVCGARNLGEAVRRIWEGAAMIRTKGEAGTGNIIEAVRHVRLVNENIRLIQRMTDEEIYGVAEKFAEPYLRLAFSVKEISGLPKRVLENEPIYEGFTYREIVDGLYKILLEIKKLGRLPVVNFAAGGVATPADAALMMAMGMDGVFVGSGIFKSSNPPAMARAIVEAVNHWDEPDVLAEISREIGEPMRGQDIAELEVRMEERGV

SEQ ID NO: 15969 - protein, 95 aa, Zea mays
FFFFQEERRNAHFRTIQGLVTSKHAHTKVDLSKLELTALLRYWRHFNLDACPNPSREQLVDAVQRHFTAQQLDELQVIVGFVQAAKRLKTTMKVA

SEQ ID NO: 15970 - protein, 429 aa, Pyrococcus furiosus DSM 3638
MTQMEEAKRGVITEEMKKIAKIEKIDPEKLRRSVAKGHTVIFRNVNHDWVVPVAVGQGVRVKVNANIGTSRDIVNVEEEIEKAKIAVKYGADTIMDLSTGGDLDFIRRKIMKAVNVPVGTVPIYQAAEEMLARGKAIIEMTEDDMWKAVEKHFKDGVDFVTIHAGVTKEVVEKLKRVNRVVGMVSRGGTFLAAWILHWGEENPFYKNYEYLLELAKEYDVVLSLGDGLRPGGLPDAGDELQIAELYTIGRLVKRAREFGVQTMVEGPGHVPIDQIPTHIRLMKIASDNAPVYVLGPIVTDIFPGYDHISAAIGGAIAALNGADFLCYVTPAEHLGLPTIEHVKEGVIATKIAAHAVNLTRFEEDFKIDYQMSLARGKLNWKEQFKIAFDKEKFIEIRKERPTKSEACSMCGDLCAIKIVREMLGHKARS

SEQ ID NO: 15971 - protein, 438 aa, Pyrococcus furiosus DSM 3638
MRIVVIGSGTAGSNFALFMRKLDRKAEITVIGKEETMQYSPCALPHVISGVIEKPEDVIVFPNEFYEKQRIKLLLNTEAKKIDRERKVVVTDKGEIPYDKLVIATGSKAFVPPIKGVENEGVFTLKSLEDVRKIKEFIKKRNPKNAVVIGAGLIGLEGAEAFAKLGMKVTVVELLEHLLPTMLDKDIAKIVEENMRKYGVDFKFGVGVDEIIGDPVEKVKVGEEEIDADIVLVATGVRANVELAKEAGLEVNRGIVVNEYLQTSDPDIYAIGDCAEVIDAVTGKRTLSQLGTSAVRMAKVAAENIAGRNVKFRPVFNTAITEIFDLEIGAFGITEERAKKEEIEVVVGKFRGSTKPEYYPGGKPIVVKLIFRKEDRRLIGAQIVGGERVWGRIMTLSALAQKGATVEDVVYLETAYAPPISPTIDPITIAAEMAMRKL

SEQ ID NO: 15972 - protein, 959 aa, Bradyrhizobium sp. BTAi1
MSLIHETDYGTPRSKSETMVTLTIDGQSITVPAGTSIMRAAMEAGTQIPKLCATDMVDAFGSCRLCLVEVEGRAGTPASCTTPVAPGLVVHTQTERLKKLRKGVMELYISDHPLDCLTCAANGDCELQDMAGAVGLRDVRYGNQGENHVFADACGEANPAWLPKDESNPYFTYDPSKCIVCSRCVRACEEVQGTFALTISGRGFDSRVSPGMSESFLGSECVSCGACVQACPTATLTEKSVIEIGQPEHSAVTTCAYCGVGCTFKAEMRGEEIVRMVPYKDGKANRGHSCVKGRFAYGYATHKERILKPMIRESIDQPWREVSYDEAFTFAAQKMRGIQAKYGRDSIGGITSSRCTNEETYLVQKLIRAGFGNNNVDTCARVCHSPTGYGLATTFGTSAGTQDFDSVEDSDVIMVIGANPTDAHPVFGSRMKKRLRQGAKLIVVDPRKIDLVKSAHIEADYHLPLLPGTNVAIMTAMAHVIVTEGLVNETFVRERCDWSEFQDWAEFVALEKNSPEAIAAISGVDPEAIRGAARLYATGGNGAIYYGLGVTEHSQGSTTVIAIANLAMATGNIGRRGVGVNPLRGQNNVQGSCDMGSFPHELPGYRHISGDAVRDQFEAMWNVKLNPEPGLRIPNMFDSAIDGTFKGLYVQGEDILQSDPNTTHVVQALSAMECVIVQDLFLNETANYAHVFLPGSTFLEKDGTFTNAERRIQRVRKVMTPRNGLADWEVTIGLAKAMGFEMKYNHPSEIMDEIAALTPTFTGVSYQKLEEMGSVQWPCNETYPEGSPIMHVDGFVRGKGKFVVTEYVATDERTGPRFPLLLTTGRILSQYNVGAQTRRTDNVVWHGEDVLEIHPHDAEQRGIRDGDWVRLTSRAGETTLHALISERVAPGVVYTTFHHPLTQANVITTDYSDWATNCPEYKVTAVQVSQSNGPSDWQKAYDEQARNSRRIAPIVEAAE

SEQ ID NO: 15973 - protein, 299 aa, Glycine max
  misc_feature (245)..(245): Xaa can be any naturally occurring amino acid
  misc_feature (293)..(293): Xaa can be any naturally occurring amino acid
MADTEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQITFETFNTPAMYVAIQAVLSLYASGRTTGIVLDSGDGVSHTVRIYEGYALPHAILRLDLAGRDLTDFLMKILTERGYSFTTSAEREIVRDVKEKLSYIALDYEQELETARTSSSVEKSYELXPDGQVITIGDERFRCPEVLFQPSMIGMEASGIHEITYNSIMKCDVDIXRKDLYG

SEQ ID NO: 15974 - protein, 380 aa, Frankia sp. EAN1pec
MAVDYYATLGVRRDATGDEIKRAYRKLARELHPDVNPDPEAQQRFRNVTNAYEVLSDPEKRQIVDLGGDPLAPGGGAAGAGSPFGAGFGGLGDIMDAFFGGGASRGPRSRVRRGNDALLRLELDLAETAFGATRDITVDTAVVCATCTGAGAAPGTQPSTCSTCHGRGEVQQVTRSFLGQMVTSRPCPRCSGTGTVIEHPCRDCSGDGRVRKRRTLTVKIPSGVEDGMRIRLSGEGEVGPGGGPPGDLYVEVSERQHAVFSREGDDLHCDLRLPMTAAALGTMATLETLDGSETITVKPGTQPGEVLRLAGRGVPHLRAVGRGHLHIHIVVETPTKLDAEQERLLRELAKLREEETPAVVGGSSSGSGLFSRRRGGRRNR

SEQ ID NO: 15975 - protein, 269 aa, Corynebacterium efficiens YS-314
MVNHVDRDTTLCISLAARPSNHGVRFHNWLYAELGLNFLYKAIAPADITAAVAGIRGLNIRGAGVSMPYKGDVIPLIDALDPSAERIRSVNTIVNDDGHLTGYNTDYTAVLNLLRAHQVNPDLHVALRGSGGMANAVIAALTDHGMRGTVVARNHTTGAALAQRYGWEYSAQVPEHAQVLVNVTPLGMNGPDEDVVAFDRDEIDRAEVIFDCVAFPVETPLIRLARSQGKKTIDGGEVAALQAAEQFHLYTGVRPTDEQIIAAEEYAAP

SEQ ID NO: 15976 - protein, 780 aa, Bradyrhizobium sp. BTAi1
MAAMDPIFDGTANAPISCVSEADLTLCDREPIRTPGAIQPHGLLLGLDPEELRITHAGGDVAGLLTAAPQTLLGDSASRLFSPDQMRQLRMLAGGAGPQRAVHAFSMAGHSEANADVIAFRSGAVLVVEIELRREQAPDNPLAAVKGMLRNIQQTETAPSFCQAVVDEVRHLIGFDRVMFYRFLDDGSGAVIAEAAAPDVESFLGLHYPASDIPKQARELYRTNWIRAIPDARYAPAPILSLGDAPPAAALDLSQSTLRSVSPIHRQYLANMGVVASMSMSIIMRGRLWGLIACHHREPRYLPYGLREACELFAEMVSSHLEARLAAESFELQKRSAKIHEELLNRLSRESELAAGLVRFRPNLLDLIPAGGVGLWIDGQFTNIGATPDREATEAIVGWLNATVKEGVFQTDCLALLYPPAEHFADVASGLLALSVSKSPRDYVLWFRPELVQTVNWAGKPAKPAQGGSDHEMLTPRTSFAMWQELVRLHASPWLAAEVEAAHRLRVALLEVVLRRIDQLAREREAARQRQERLTSELNERLAQSERLARALRKETELRAAVEGDLTQVLRRTVADQETERQRIARELHDTLGQSLTMLQLGLQAIGHEIAGGPKLQQRFDGIKTIADSLGRDVHRIATEIRPSAIDDLGLQKAIESLLETWSENAALNYYLHLSPKDMRLPKAIEATLYRVLQETLTNVVRHAEARKVGVILNVTDREVSMIVEDDGRGFPADADDPTASPAMRLGLLGIRERLALVGGSLEIESSPGRGTTVFARVPL

SEQ ID NO: 15977 - protein, 278 aa, Brassica napus
  misc_feature (200)..(200): Xaa can be any naturally occurring amino acid
MAIISEVEEETSSSQPSTLPFRATFDSSNPLGFLEKVFDFLSQQSDFLSKPSAEAEIAAAVRAAKEKLRKAEKKGVEKKPVEKESVAASSSEPMEVEEEKKKQEAAPIAPNKGNGYDLENYSWVQTLQEVTVNVPVPSGTKARSVVCEIKKNRLKLGLKGQDPIIDGELYRSVKPDDCYWNIEDQKMISILLTKQDQMEXWKCCVKGEPEIDTQKVEPENRKLADLDPETRSTVEKMMFDQRQKQMGLPTSDELQKQDILKKFMSQHPEMDFSNAKIN

SEQ ID NO: 15978 - protein, 366 aa, Vitis vinifera
MGKGGNSEDAVSSKEHGEENMAAWLLGIKTLKIQPYILPSLGPHDVKVRIKAVGICGSDVHHFKTMRCANFIVKKPMVIGHECAGIIEEVGSEVKNLVVGDRVALEPGISCNRCSLCRNGQYNLCREMKFFGSPPTNGSLANQVVHPSNLCFKLPDNVSLEEGAMCEPLSVGIHACRRANVGPETNVLIMGSGPIGLVTMLAARAFGAPRIVLVDVDDQRLAIAKDLGADDIIRVSTNIQDLDEEVAKIQSTMVTGVDVSLDCVGFNKTMSTALNATRAGGKVCLVGLAQSEMTVPLTPAAAREVDIVGIFRYRNTWPLCLEFLRSGKIDVKPLITHRFTFSQKDVEEAFETSARGGNAIKVMFNL

SEQ ID NO: 15979 - protein, 618 aa, Coprinopsis cinerea okayama7#130
MATNIPTRRVATRTTTRSTSAAVKENENALARPSRITRSKLTATSGALAPAGGMTRTTIASRAKALANQAENSGKPTDNAPVKRKREALGEVAVAGNRPTRSTTLKGKEKENGVTGKAGASESAGKDKFDGVVIKTKPLAVRQPLRTVATRQVASTRTTRAAAEKEKEKERERVPVKEKVKEPATSDHAMAVDAPQIPSIAVRRSEVVKDQKVMGPKRHGSQRALRPTQPKIEEEDEEEQERVFKKRRTSSDAPEPEPKIEEPRVEEQDPEALLMARLEAEMEAFANEPEHDPETSAWDDLDADDGDDPLMVSEYVGEIFNYMKKLELTTMANPNYMESQKELAWKMRGILTDWLVQVHVRFRLLPETLFLCVNIIDRFLSARVVSLAKLQLVGITCLFIASKFEEIVSPGVSHFLSVADSTYTEAEILQAERYVLKTLDWNLSYPNPVHFLRRVSKADDYDVAVRTVGKYLLEIGCLEWRLIAAPPSLMAAAAIWLARLAMGHEEWTPNLAHYSSYRESALVPTANLMLNYILKPIKHEAFFKKYAGKRFSKASVYMREWALSQWPENSQVDLGKELPRIKASIKLQREAEELALARAGNSEAEFFEGETFAKPRAR

SEQ ID NO: 15980 - protein, 184 aa, Rhizobium etli
MIVAVPNSGASRINQSGVEALREFPNFPIGGILFKDIAPMLAGRGALGEVVSTVASQVSGTEIDAILAVDARGFILGASLADRLGCGFIMVRKPGKLPGDVLSFEYSCEYCSGTLEVTAGLIGDGLRCLIADDLLATGGTARATGNFVKSQGGEIAGYAFILEIEVLKGRRQLDDAPVISAMTC

SEQ ID NO: 15981 - protein, 965 aa, Coprinopsis cinerea okayama7#130
MSKKPQEFTIKVQAQDPEKKEKPDDKPNYEGSSRLLQDSKEGEENELSEEDQQLKDQLEMLVERLKESNKDLYRSALESLRTLIRTSTSSMTSVPKPLKFLRPHFPKLQELYETWEPSPNKSLFADILSVLAMTYSDTEPRGTLRYRLLSDELRAADTSIVDPSSWGHEYIRHLSAELGEEYNYREEASGKDYEKGADQPKEDLPGTIEDLRKLGKTCATFLLRHNAEPDAVDLMQELEIIKDIIELVDENTYSRVCQYMIRMVHFLVPPDDKLFLRVAHDIYVQHHKFPEALALSLRLNDPELIREDFNAPGNPLMKRQLAFLMARSQVPLEWLQPPSSEDGEGEDVDFQEELPEDLLECLSNARLSHHFREFGKEVGVAEAKSLEDVYKSHLENTRPGTTANIDSARGNLAGTFVNAFVNAGFGNDKLMVEAEEGSSWIYKNKDHGMLSAAASLGLSLLWDTDIGLSHVDKYTYSSEENIKAGALLATGILNTGVRTEADAALALLGEYVENNSIPLKTSAIIGLGLAYAGSHREDLLALLLPLVEGSNSMEILSLAALALGFIFVGSGNGEITGSILQTLMEKAEGEDKSLDEKWTKFLALGLGLLYLGLQDASDATVETLKAIEHPASQTARVLVEACSWAGSTNVLKVQSMLGYCYEHIDTSGKDEKKDEKEGDKKDGEKKDEEEKDKKKKDDSFQAFAVIGISLIAMGEEIGSEMILRQFNHLMHYGEPVIRRSVPLAIGLVSASNPQLPILDTLSKYSHDNDLGVALNAIFAMGLVGSGTNNARLAQMLRQLAGYYQKEPDCLFMVRIAQGLVHMGKGTIGLNPFYSDRSIMSRPAVAGLLATLTAFTDAKGFVLDKYHWMLYFLTPAMYPRFLITLDEELNALPTTVRVGQAVDVVGQAGKPRTISGFQTHTTPVRMGITERAELATEEYIPFAHVLEGFVILQKNPGYDKDDRMDI

SEQ ID NO: 15982 - protein, 154 aa, Narcissus pseudonarcissus
KVMKKASFIGVSTTTTFYLLCGCLGYAAFGNKAPGNILTGFGFYEPFWLVDIANLCIIIHLVGAYQVFSQPIFSAVETWITNRHPNINFLNHDRVLVIGKCFRYKINLFRLIWRTLFVIACTFIAILMPFFNDILGFLGAVGFWPLTVYFPTEM

SEQ ID NO: 15983 - protein, 555 aa, Mycobacterium avium subsp. paratuberculosis K-10
MTTARPAKARNEGQWALGNREPLNPNEEMKQAGAPLAVRERIETIYAKNGFDSIDKSDLRGRFRWWGLYTQREQGYDGSWTGDENIEKLEARYFMMRVRCDGGAISAAALRTLGQISVDFARDTADITDRENIQYHWIEVENVPEIWRRLDAVGLRTTEACGDCPRVILGSPLAGESLEEVIDPSWAIAEIARRYIGQPDFADLPRKYKTAISGLQDVAHEVNDVAFIGVNHPEHGPGLDLWVGGGLSTNPMLAQRVGAWVPLHEVPEVWAAVTSVFRDYGYRRLRSKARLKFLVKDWGIEKFREVLETEYLKRPLIDGPAPEPVAHPIDHVGVQRLKNGLNAVGVAPIAGRVSGTILLAVADLAQQAGCDRIRFTPYQKLVLLDIPDDKLDEVVAGLEALGLQSQPSHWRRNLMACSGIEFCKLSFAETRVRAQGLVPELERRLADVNRQLDVPITINLNGCPNSCARIQVADIGLKGQMVDDGEGGSVEGFQVHLGGSLGQDSGFGRKLRQHKVTSDELGDYIERVARNFVKYRGEGERFAQWAMRADEDDLR

SEQ ID NO: 15984 - protein, 451 aa, Yersinia pseudotuberculosis IP 32953
MSFDSLGLNADILRAVEEQGYLVPTPIQRQAIPVVLEGRDLMASAQTGTGKTAGFTLPLLQLLSQDQQPIKGRRPVRALILTPTRELAAQIDENVQSYSKYLKLRSLVVFGGVSINPQMMKLRGGVDILVATPGRLLDLEHQNAVDLSKIEILVLDEADRMLDMGFIHDIRRVLAKLPAKRQNLLFSATFSDEIKGLASKLLHNPASVEVARRNTASEQIAQSVHFVDKNRKRELLSQMIGEGNWQQVLVFNRTKHGANHLAEQLNKDGITAAAIHGNKSQGARTRALADFKDGKIRVLVATDIAARGLDIDQLPHVVNYELPNVPEDYVHRIGRTGRAERTGEAISLVCVDEHKLLRDIERLLKREIPRIALDGYEPDPSIKADPIQNGRQGRGAQRPGMGRGSSAGRPQNGGGAAGRGDSRNSRPRSQADGQRRPAGPSSRGRSRNPGE

SEQ ID NO: 15985 - protein, 355 aa, Oryza sativa (indica cultivar-group)
MDFKVASFLLLLLIVTCGAAQGQGNDFVVLDLKTTEIGEDASPMYKEQIASTKIPVTLLRSKHSSLCSACENITSEAVNFLSEKQIQDKIRTILHDTCSQTFSFEQKCLETMDSYATLVFAKIAEIKPAAFCKQYGLCRDMALLSAVKSESTCLFCHHIIDEITSKLKDPDAEFEIIQLLLKECNKIEGHQQQCKRMVLQYVPLVLVNGEKFLEKNDVCAMIQACDAGKRKALNLFSARKLILSAYFVVLPLRDEGAISLGLSTLPGLFAGSLLLTLVAAPVASLAFSLPSIPKPRALVFIHRFFSLSLLVFFVLWFASTPGHSPSISQVSLLNLIAISSTWARVIDVMDNEVSG

SEQ ID NO: 15986 - protein, 332 aa, Idiomarina baltica OS145
MSQYKAIKLVKRPQPGPVSKDIFEIVELDRPSVDDGQILIKQTHMSLDPAMFGWMSPDKESYIPPVELGSVMRSSGVGEVVASKHPDFAEGDRVMGMMGWQEYALSDGQGINKVQTGAPDEMVLSVFALPGLTATQGLLNVGKPKQGETLVVTGAAGSVGSIVGQMAKADGLSVIGVVGSDEKAEWIVNELGFDGAVNYKTDDIPAKLAELTPNGIDLYFENTGGPIQHAVMGRMNAHGRIVVCGMIADYDKEQPSPGPSWIPIIKKRLTIQGFTMPDHFDQIPTLLKQLTPYVTNGDIKYRAHVLEGLESAIEGLNMFLSGENQGKLLVKL

SEQ ID NO: 15987 - protein, 202 aa, Shewanella sp. ANA-3
MYTEFDGIIFDMDGTLVDSGQLHEQAWRQTLNHFGIPVEPALMRSLAGVPTIGTLEILIAHFGVTPTASCEAMNEYKEALVRDTMHLYVKPTALAEFAKQNQGKRPMAVGTGAYTEEAIQILTLCGLLELVDYVVGADQVASPKPAPDTFLRCAELMGIAPERCIVFEDAKAGIQAAEAAGMFVVDVHAELQIENDYFLGTR

SEQ ID NO: 15988 - protein, 454 aa, Saccharomyces bayanus
MSEPEFQQAYDEVVSSLEDSTLFEQHPKYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRTYKNSWEGVLTGKGLNWGGSLIRPEATGYGLVYYTQAMIDYATNGKESFEGKRVTISGSGNVAQFAALKVIELGGTVVSLSDSKGCIISETGITSEQVADISSAKVNFKSLEQIVGEYSTFTENKVQYISGARPWTHVQKVDIALPCATQNEVSGDEAKALVAQGVKFVAEGSNMGSTPEAIAVFETARATASTLKESVWYGPPKAANLGGVAVSGLEMAQNSQRITWSSERVDQELKKIMVNCFNECIDSAKKYTKEGNALPSLVKGANIASFIKVSDAMFDQGDVF

SEQ ID NO: 15989 - protein, 117 aa, Magnaporthe grisea 70-15
MADPKIQELLTKPRNELTEYEIAQLEEHEFSAGPLSILQTAVRSHTQVLISIRNNRKLLARVKAFDRHCNMVLENVKEMWTETPRLASGKKGRPVNKDRFISKMFLRGDSVILVLLS

SEQ ID NO: 15990 - protein, 306 aa, Thermus thermophilus HB8
MRFFVLGDVSVDLLFFLERIPEPGEEVPSRRALMKPGGAGGTLAAQLASLGHRVFLAGRVGKDPFAELALSRVREVGVDLRHLQEDPEHTTSSVLILVVPGGERAMVSAEGASRYLDPALFKPRFLDQVDAVVLSAYALVGGPSRSYAAEVLEAARRRELPVFADLGAGAVRAAGKELLKHLRGVGWLLMNEGELKTLTGASSISQGVARLRQEGFQHLAVKVGAMGSIVVTPEGEELIEPFPVEDIVDSTGAGDAYTAAFAHAILEGLSPVEAGRLANLAGALAATAIGAQGRLVTLEDLKVAAG

SEQ ID NO: 15991 - protein, 409 aa, Pseudomonas syringae pv. phaseolicola 1448A
MKKLKLVMIGNGMAGVRTLEELLKLSEDLYDITVFGAEPHPNYNRIMLSPVLAGEQNFEDIVLNDLAWYESNGIQLLLNRRVVKIDRIKRVVIADDGTQASYDRLLIATGSRPFILPVPGNTLEGVIGYRDIGHTRQMIDTAVTHKRAVIIGGGLLGLEAANGLSLRGMQVTVIHNGQTLLERQLDKTSGLMLQAALEKRGLGFRLNEQTEALLGDDLGRVRAVQFKSGEVIDTDLVVMAAGIRPNTELAEQAGLPCNRGILVNDTLQTYDPRIYAIGECVSHRGIAYGLVAPLFEQARVCANHLAQLGFARYPGSVTSTKLKVTGIDLFSAGDFLGAEGTESITLSDPIGGVYKKLVIKNDVLVGVCLYGDTADGSWYLQQIRDGQGIDAIRNHLMFGKPAAPEAACA

SEQ ID NO: 15992 - protein, 338 aa, Idiomarina baltica OS145
MVNDSQLDLSTEFAVVADIGGTNARFGRINLKTFELDRIQVFPCADYLNLTDALIAYREQQDVALEHVAIAIACPAEGDSIQMTNHHWQFSVRGTREALGLTSFIVLNDFAAAAMSLLTLDKSEMKKIGGGKKVETAPCAVLGAGTGLGVGHLVHMPNGDVMPLPGEGGHADWAPLNDKEWAIHEFLARRFDGRVSAERLLSGPGIENLYQAIAHYHDRAVPPLRAKTIGARALTNCDAIATETVNQFFASLGSFAGNLALTLNTRGGVYIAGGVVPKLLPLMAASEFRTRFEQKGRFCNLAESIPCYVITAEHAGMRGVAQYLKQTLRKAPATADID

SEQ ID NO: 15993 - protein, 576 aa, Oryza sativa (japonica cultivar-group)
MGAVGVEAGVFDTVDGLVGEVMRLHRSLPARPAVEEVEAAEALAAAADREERARADAVARLRRSPAVPDELLCVAQEMHRALAGFQCREQKRDAARLLELEALHTLFDDLIQRASQCLPSTSTRAAPRIAAPAAATTTTSTAAAGSSSSSAVGNAERHASSGTNGFTASRVAGTSTSTGRVSMDDSYVRKAKAAMWDGGAAATNSHLPRGPVEANSVAVRADGNYGDDNEKLSLIKLASMIEVSAKKGARDLNLQGKLMAQIEWLPDSIGKLTGLVTLDISENRLLALPDAIGKLFSLAKLDIHANRISQLPESIGDLRSLIYLNMRGNQLSSLPSSIGRLLNLEELDVGSNGLSSLPDSIGSLTRLKKLIVETNDLDELPYTIGHCVSLVELQAGYNHLKALPEAVGKLEPLEILSVRYNNLRSLPTTMASLTKLKEVDVSFNELESIPENFCFATSLIKLNVGNNFADLQYLPRSIGNLEMLEELDMSNNQIRVLPDSFGNLKHLRVLRAEENPLQVPPRDIALKGAQAVVQYMSDASKRTTKSEPMKPKKTWVHFCFFSRPNKRKHDRIDNAT

SEQ ID NO: 15994 - protein, 260 aa, Salinibacter ruber DSM 13855
MLVAGNWKMNTDVPEGRALADAIAEGLSSTAADRGDVDFLVCPPYVHLPAVREALADVPVAVGAQDMHAQDEGAYTGDVSAPMLSSIGCDAVILGHSERRTYYDETDAEVNAKAQQARAHDLVPIVCVGETLEQRKAGEADTVVRSQVDGALSDVSIDGADELIVAYEPIWAIGTGESAAAEQAQAMHAVIRDDLRERYGGDVADEVPLLYGGSMKPHNAYGLLSQPDIDGGLIGSASLEAESFLGIAEKAAEVLETSGH

SEQ ID NO: 15995 - protein, 215 aa, Brassica napus
  misc_feature (19)..(19): Xaa can be any naturally occurring amino acid
RHEDQVPSVSAIFSLYTSXSAITMLFRTILNEIVPKRIREYVALKAMDFFSSYFQSNFTFVIEQRWEFVENQTFRAAEVYLPTRLAGLSTGKLLVGSSNLKNPAAEPKLGIPVNTKIIDEFEGIHLEWTLHSVETKKYLPEKRYFHLTCKKEFREKIMTDYFTYLAKSAEKIMSHRENLKIYTYNQDRSKWESAIFEHHTTFETLAVEPQLKNTL

SEQ ID NO: 15996 - protein, 226 aa, Xanthomonas campestris pv. vesicatoria str. 85-10
MTHSAALPFRPQAVIFDMDGLMLDSERAITACLAQAADDQGLQIEPAFWLRMVGTGDAACRRLLGERIGEAAADTMLAHAQRLYAAAVERGIPHRPGIVALLDYLAAQRMPRAVATSTQRPLALRKLEAADLLWRFDAVCTASDVVHPKPAPDIYLLAARTLAVDPAHCLVLEDSPTGVRAALAAGMTPIQIPDLLEPDATVRALGHRILPSLSDAQRLLEARLSG

SEQ ID NO: 15997 - protein, 85 aa, Zea mays
HIYLFSICRYNIQNLVDHFHERGLYRSIFLSIMEGEESLPHYSPEIVAKKLSAETISLLPQIVLLHGTADYSIPSSARFIIFVLG

SEQ ID NO: 15998 - protein, 576 aa, Saccharomyces cerevisiae
MSEEAAYQEDTAVQNTPADALSPVESDSNSALSTPSNKAERDDMKDFDENHEESNNYVEIPKKPASAYVTVSICCLMVAFGGFVFGWDTGTISGFVAQTDFIRRFGMKHHDGTYYLSKVRTGLIVSIFNIGCAIGGIILAKLGDMYGRKMGLIVVVVIYIIGIIIQIASINKWYQYFIGRIISGLGVGGIAVLSPMLISEVSPKHIRGTLVSCYQLMITLGIFLGYCTNYGTKTYTNSVQWRVPLGLGFAWALFMIGGMTFVPESPRYLVEVGKIEEAKRSIALSNKVSADDPAVMAEVEVVQATVEAEKLAGNASWGEIFSTKTKVFQRLIMGAMIQSLQQLTGDNYFFYYGTTVFTAVGLEDSFETSIVLGIVNFASTFVGIFLVERYGRRRCLLWGAASMTACMVVFASVGVTRLWPNGKKNGSSKGAGNCMIVFTCFYLFCFATTWAPIPFVVNSETFPLRVKSKCMAIAQACNWIWGFLIGFFTPFISGAIDFYYGYVFMGCLVFSYFYVFFFVPETKGLTLEEVNTLWEEGVLPWKSPSWVPPNKRGTDYNADDLMHDDQPFYKKMFGKK

SEQ ID NO: 15999 - protein, 324 aa, Glycine max
MAPNITTVTDAQAKAAGGRGRAYVTFLAGNGDYVKGVVGLAKGLRKVKSMYPLVVAVLPDVPEHHRNILTSQGCIVREIEPVYPPENQTQFAMAYYVINYSKLRIWEFVEFSKMIYLDGDIQVFDNIDHLFDLPDNYFYAVMDCFCEPTWGHTLQYQIGYCQQCPHKVQWPTHFGPKPPLYFNAGMFVYEPNLDTYRDLLQTVQVTKPTSFAEQDFLNMYFKDKYRPIPNVYNLVLAMLWRHPENVELEKVKVVHYCAAGSKPWRYTGKEENMEREDIKMLVKKWWDIYEDETLDYNNPFNVDRFTAALLEVGEVKFVRAPSAA

SEQ ID NO: 16000 - protein, 604 aa, Capsicum annuum
MDVRRRSEEAVYSSKVFAADEKPLKPHKQQQEEDNTLLIDASDALPLPLYFTNGLFFTMFFSVMYFLLSRWREKIRNSTPLHVVTLSELGAIVSLIASVIYLLGFFGIGFVQTFVARGNNDSWDEEDENDEQFILEEDSRRGPCAAATTLGCAVPTPPAKHIAPIVPQQPAVSIAEKPAPLVTPAASEEDEEIIKSVVQGKIPSYSLESKLGDCKRAASIRKEVLQRITGKSLEGLPLDGFNYESILGQCCEMTIGYVQIPVGIAGPLLLNGREYSVPMATTEGCLVASTNRGCKAIYASGGATSILLRDGMTRAPCVRFGTAKRAAELKFFVEDPINFETLANVFNQSSRFARLQRIQCAIAGKNLHMRFVCSTGDAMGMNMVSKGVQNVLDYLQNEYADMDVIGISANFCSDKKPAAVNWIEGRGKSVVCEAIITEEVVKKVLKTEVAALVELNMLKNLTGSALAGALGGFNAHASNIVSAVYIATGQDPAQNIESSHCITMMEAVNDGKDLHISVTMPSIEVGTVGGGTQLASQSACLNLLGVKGANREAPGSNARLLATIVAGSVLAGELSLMSAISAGQLVNSHMKYNRSTKDVTKASS

SEQ ID NO: 16001 - protein, 486 aa, uncultured Chloroflexi bacterium
MPIHFGTDGWRAVISDTFTFHNLRLVSQAIADAVRSERWNTGVPLPENADPHTMVVGFDTRFLSDRYAADVARVLAANGFTVYLAQSDAPTPAISFSVRHLGAIGGVMITASHNAPRYNGVKLKAAYGCSALPEQCRHVEVYLNDNEQRGRGPNQMDFDQARQAGLIQRFNPLPAYYDHLRQLINFDAIAENPQRVVVDSMFGSGRGVIKGILQGTGCEVQEIRGELNPGFGGVHPEPIGRYLGALASAISAGMGDVGLATDGDGDRIGAMDGRGNFVDPHRIMALSLRYLVETRGWKGPVVRTVSTTRMVDRLADRYGLPMYETPVGFNHIADYMLKGDVLIGGEESGGISFRGHIPEGDGAIMGLLLLEIVATAGVSLYELVEDLLKQVGPAFYQRTDLRLNHPVEKKEMSRLLVDEAPASIGGEAVDGIATIDGVKYLIADGSWLLIRPSGTEPVLRVYAEGRTPDMVRALLDFGEQVAQRAA

SEQ ID NO: 16002 - protein, 243 aa, Oryza sativa (japonica cultivar-group)
PPSSPPNPQIPKSNPPPPKPSLSQPQEPRRDHSRSSNAPLMTDLDGNIVAIPNPSGRGPGYRYFGAAKKLPGVRELFDKPPEVRKRRTRYEIHKRINAGYYGYYDDEDGMLERLEAVAEKRMRNEVITEWHRVERVRREAMKGVVSGEVASAGGRGGEAAREVLFEEVEEEVEEERRLEEEKREREKGEEAGKEFIAHVPLPDEKEIERMVLERKKKELLSKYTSDALQVEQEEAKEMLNVRR

SEQ ID NO: 16003 - protein, 490 aa, Mycobacterium tuberculosis CDC1551
MTRITRANGCPDGTLENAVVALDGGANYPREILGNKGHGIDMMRRHHLPVPPAFCITTEVGVRYLAAPESTIAAIWDDVLDRMSWLETETSCTFGRGPNPLLVSVRSGATQSMPGMMDTILDVGMTDAVERVLARPGAADFAHDTRRRFTSMYRRIVGSAGPITDDPYAQLRASIEAVFASWNSPRAVAYRDHHGLDDQGGTAVVVQAMVFGNLTANSGAGVLSSRNPITGANEPFGEWLPGGQGDDVVSGLVAVAPITALRDQQPAVYDQLMAAARSLERMAGDVQEIEFTVEDSQLWLLQTRGAERSAQAAVRLALQLHHEGLIDDTETLRRVTPTHIETLLRPSLQTETRLAAPLLAKGLPACPGVVSGTAYTEVDEALDAADRGEPVILVRDHTRPEDVMGMLAAQGIVTEVGGAASHAAVVSRELGRVAVVGCGPGVAAALAGKEITVDGYEGEVRQGVLALSAWSESDTPELRELADIAQRISS

SEQ ID NO: 16004 - protein, 400 aa, Staphylococcus aureus subsp. aureus MW2
MRIVQPVIEQLKAQSHPVCHYIYDLVGLEHHLQHITLSLPSNCQMYYAMKANSERTILDTISQYVEGFEVASQGEIAKGLAFKPANHIIFGGPGKTDEELRYAVSEGVQRIHVESMHELQRLNAILEDEDKTQHILLRVNLAGPFPNATLHMAGRPTQFGISEDEVDDVIEAALAMPNIHLDGFHFHSISNNLDSNLHVDVVKLYFKKAKSWSEKHRFPLKHINLGGGIGVNYADLTSQFEWDNFVENFKTLIVEQEMEDVTLNFECGRFIVAHIGYYVTEVLDIKKVHGAWYAILRGGTQQFRLPVSWQHNHPFEIYRYKDNPYSFEKVSISRQDTTLVGQLCTPKDVFAREVQIDAISTGDVIVFKYAGAYGWSISHHDFLSHPHPEFIYLTQTKEDE

SEQ ID NO: 16005 - protein, 196 aa, Pantoea stewartii subsp. stewartii
LTDKLTSLRQLTTVVADTGDIAAMKLYQPQDATTNPSLILNAAQIPEYRKLIDEAIAWARQQSNDKEQQLQLVSDKLAVNIGLEILKLVPGRISTEVDARLSYDTEASIARARSLIKLYNDAGISNDRILIKPASTWQGIRAAEQLEKEGINCNLTLLFSFAQARACAEAGVYLISPFVGRILDWYKANTDKKDYA

SEQ ID NO: 16006 - protein, 142 aa, Mycobacterium avium subsp. paratuberculosis K-10
MRIADVLRNKGAAVVTINPDATVRELIAGLTEQNIGAMVVVGAEGVLGIVSERDVVRQLHVHGASVLSRPVSKIMTTTLATCTKTDTVDEISVLMTRNRVRHVPVLDGKKLIGIVSIGDVVKTRMEELEAEQQQLQSYITQG

SEQ ID NO: 16007 - protein, 202 aa, Zea mays
  misc_feature (181)..(181): Xaa can be any naturally occurring amino acid
MAIAGQCSSCYYTSPTLQLQLHRRHSHLPRQPQAARRARRPRLQVAAAAGSGPIRAATDTEFFQPSDTRPIMLFDGVCNLCNGGVRFVREHDPNRSIRYVPLQSESGRKLLQRSGRSPDDISSVVLVEKNTSFIKSEAVLRILASLHLPFSGLMEYLNLPFPQLADFLKFVPRFLRDFAYXRVATNGYAILGRPEPEACEIL

SEQ ID NO: 16008 - protein, 329 aa, Glycine max
  misc_feature (161)..(161): Xaa can be any naturally occurring amino acid
MSSSSADVFPAILEVMLEFRAGKMFLEEKRVVPDTRKGLVRIARGEEGLVHFQWLDRTQNVVEDDQIIFPNEAIFEKVNQTSGRVYILKFNSDDRKFFFWMQESNADDDSQLCSSVNDYINRPLELLGEEEPDGSLPLQVSEDMAEDDISSSQLDTKCIEXAFLGAPNLGVEATSDVTSSGPVKLEDLQRILSNIGPADSIVDPDGGLGLGDILKPDLIMPLMDTLPLEQRLAPYLPEGEWSPEEILELLQSPPFRQQVDSFTYVLRTGQIDLSQFGIDPSKYKFTVLSFLEALEDSVSKSVESEEARQDDRDLRSQSCNRHDPMDESQ

SEQ ID NO: 16009 - protein, 352 aa, Idiomarina baltica OS145
MPIRIAINGFGRIGKNIVRALYERGLTDHIELVAINDLGSPDVLAHLLQFDTVHGRFAAQVEAGIDSLSIDNHTVSVYAERDPSQLPWQALNIDVVLECTGLFTERDKAKAHIDAGAKKVIISAPGKNVDATVVFGVNDEILTADMDIISNASCTTNCLAPVAKILHESLGIESGLMTTVHAYTNDQRLTDSYHSDLQRARAAAQNMIPSKTGAAAAVGLVIPELQGRFDGLAVRVPTPNVSLVDLNFIAARDTTVEEVNAIVKAATNQAPMSQVLAINELPLVSSDYNHNDHSSIFDARQTRVNGRLVKVMAWYDNEWGFSNRMLDNTIALMNAASKKVVTNSKQEVNTTH

SEQ ID NO: 16010 - protein, 303 aa, Cicer arietinum
GVALAGLLGTVRSQGRPLSDFVNQKIVVAGAGSAGLGVLKMAINAVAKISGCSETAAKSQFFLIDKNGLVTTERNNLDPAAAPFAQNPRDIDGLTEGASIVEVVKKVKPHVLLGLSGVGGIFNEEVLKAMRESVSTKPAIFAMSNPTMNAECTAIDAFNHAGEHIVFASGSPFENVDFGNGNVGHVNQANNMYLFPGIGLGTLLSGAHLITDGMLQAAAECLASYMSEEDILKGILYPSVDSIRDVTAEVGAAVLRAAVEEDLAEGQGDVGPRELAHMSKEETVEYVRRNMWFPVYSPLVHEK

SEQ ID NO: 16011 - protein, 610 aa, Magnaporthe grisea 70-15
MSMTADGSSPAGNASTTHGSFRMNGLGIEGLLMPLLGGGMHANPLMRTFMLVNQTLGAYLGIDPTALVTAMGFVWATYRLTRQFWSLVWHGLVLEYMTSSVSVVSDDEIFDHVMVWLAAQPRTERSRLLMAETALQSAWEGDRGEYAATRQAVPVTVSEDGKEYVNFSQQKASTPPRYIPAFGIHGFWFRHRYFSLHRRQKPVMEGSNIAPAAVTIRDKETMVISCFGLSPEPIKELLAHAREHYYKDHYAKTLIKRPNSSLIRRHGRHSWTSVANRPVRPMNTVVLDQKQKTAVLSDMNEYLQPETPRWYANRGIPLRRGYLFHGPPGTGKTSLSFALAGVFGLDIYVVSLLEPQLSEEDLSNLFNCLPRRCVVLLEDIDTAGLTRTEEKIGHSVRTNTKTTTTTGSNATSPPSGPNEWKVTDLARALKGGRGSDGEQKGISLSGLLNAIDGVASHEGRVLIMTTNRPESLDDALIRPGRVDLQVAFSNATQEQASELFQRMYTPDQSTKSPPFTDLQPQKETRLFLGKQDAIDGKDDSETPITDADELSRIAAEFGSKIVSGQLSPAEIQGFLLKRRKWPRKALRDVEGWVKAMVEQKASKSKVTQAQ

SEQ ID NO: 16012 - protein, 231 aa, Halobacterium sp. NRC-1
MDRPRIALVNAAHEPGETARNFRRELDAELVEFHAKGGRVPGHTEFDGVVVTGSKSSVYWDEPWIEALCDYVEDVHAAGVPVLGVCFGHQVLAEALGGTVEDMSGFELGYRTVERVADDPLFEGLPESMTAFTTHGDVVTELPAAATLLAENDYGIHAFRVGQSVGVQFHPEYDTETAERIATEKDVSEARRDAVLAGITPEAYAAACETKRLFENFTRQLGRGTDGGAEN

SEQ ID NO: 16013 - protein, 463 aa, Idiomarina baltica OS145
MKKITLPYQSRLNHPSFTFGVATSSFQIEGDIAGREPCIWDSFCQQPNAIKDGSNGNVACDHIHRWQEDVELISELGVDAYRFSIAWGRVIKANGEINRSGLNFYIKLVEALAERGIQSHITLYHWDLPQYLEDQGGWLNRATAYRFADYARVIADALGHQVSSIATLNEPFCSAYLGYEAGIHAPGPQAGDASRRKQGRQAAHHLLLAHGLALQALRDSFADGKAPALGVVLNFSPCHPLTSQQADRDAAEFAHQYHNLWYLQPMLSGTYPDVIEQLAVTDRPQINAGDMAIINQPLDFLGVNYYTRTVFKANQQHGFSDVPASGDGLTTMGWEVYAKGLTEILLTLDRQYDNLPPIYITENGIATADSCNKGEVDDVMRIDYFQSHLLAVHDAINHGVDIRGYFAWSLMDNFEWAEGYTQRFGIIYVDYNTQQRTFKNSAKALQKLFLARQSQHHAVEDIC

SEQ ID NO: 16014 - protein, 567 aa, Halobacterium sp. NRC-1
MPVVDIDPDELRRLTGHRSKDDDELRQDLFGLGIEYEGETEDGDFKLEFEADRLDRLSVEGIARSLRYHAGDDRGVDIPDTNAPEWAIDVTDVPADRPYVTGAVIRGVDLDADALDSLIQLQEKLHATMGRKRAKGAIGIHDLAMLKGDTVDGDGTAARSLTYTGIDPDGDTFVPLDDDAERTPADVLTEHPTGETYADLLADHDTYPAIYDDIGLFSFPPVINGRRTEVTTDSRELFVELTGTDQWTIDRMCAIICYALDARGATIEDVTVDYPDRELHRPDFAVRTKHVSHDRIETLLGVEFTTEAVVDLAERAGLDATPTDDGYDVEIPPYRVDVRHPVDVVDDLGRAYDFNDLTPRYPDVNTIGGRTESSRLERSVRQALVGLGFEDLLNFNMTSEAENFDRMRLTPDHDAVGAAQPATIAEPYSQDFTILRTWALPSLAMVLETNTHHAYPQDLAEVGFAAHADGDTQTGVAERRTVAAVLARNDASYEDAKARLQALCDEFAVALETPPTTHPSFIDGRAATIEIDGQPAGVIGELHPGVIVEHDVEVPVAGFEFELDALR

SEQ ID NO: 16015 - protein, 586 aa, Glycine max
  misc_feature (144)..(144): Xaa can be any naturally occurring amino acid
MADEPLYPIAVLIDELKNDDIQLRLNSIRRLSTIARALGEERTRRELIPFLSENNDDDDEVLLAMAEELGVFIPYVGGVEHASVLLPPLETLCTVEETCVRDKAVESLCRIGSQMRESDLVEYYIPLVKRLAAGEWFTARVSAXCGLFHIAYPSAPETSKTELRSIYSQLCQDDMPMVRRSAASNLGKFAATVEYAHLKADVMSIFDDLTQDDQDSVRLLAVEGCAALGKLLEPQDCVAHILPVIVNFSQDKSWRVRYMVANQLYELCEAVGPEPTRTELVPAYVRLLRDNEAEVRIAAAGKVTKFCRILNPDLAIQHILPCVKELSSDSSQHVRSALASVIMGMAPVLGKEATIEQLLPIFLSLLKDEFPDVRLNIISKLDQVNQVIGIDLLSQSLLPAIVELAEDRHWRVRLAIIEYIPLLASQLGVRFFDDKLGALCMQWLQDKVHSIREAAANNLKRLAEEFGPEWAMQHIIPQVLEMNNNPHYLYRMTILRAISLLAPVMGPEITCSNLLPVVLAASKDRVPNIKFNVAKVLESIFPIVDQSVVEKTIRPCLVELSEDPDVDVRFFSNQALQAIDHVMMSC

SEQ ID NO: 16016 - protein, 436 aa, Rhodospirillum rubrum ATCC 11170
MIAVEIAVIVLLMLLNGLFAMSELAMVSSRRARLQAMADRHVPGARIALRLTEDPGRFLSTVQIGITLVGVVAGAYGGATLGDRAGECLETIPALAGWGRFLGVGGVLLLITFLSIVLGELIPKRIALTNPERTACVVAGLMRALSRIAAPFVWLLAASTEMALRLLGIHGSEGTTVTEEEVRALISEGTEAGVFAPEEQEMIRGVLRLGDRTVRAVMTPRPEVVWLDLEEPTQALLLQIGSGSHSSYPVCRGQLDEIVGIVHTRDLLAAAVRGKPLNLEAAMVRPLVVHDGMAILRLLDLMKANRSYLAVVVDEYGSVEGVVTLTDILESIAGDLPDADEDSEVAAVPRADGSWLVEGWMPIDEFEDTLHLRDLRDGDDFQTVAGLVLRELGRIPSAGDVFERDGIRFEVVDMDRRRIDKILVTPLPSSQAEGDI

SEQ ID NO: 16017 - protein, 689 aa, Arabidopsis thaliana
MEKHFSAVTSIALSEDGLTLFSAGRDKVVNLWDLHDYSCKATVATYEVLEAVTTVSSGTPFASFVASLDQKKSKKKESDSQATYFITVGERGVVRIWKSEGSICLYEQKSSDITVSSDDEESKRGFTAAAMLPSDHGLLCVTADQQFFFYSVVENVEETELVLSKRLVGYNEEIADMKFLGDEEQFLAVATNLEEVRVYDVATMSCSYVLAGHKEVVLSLDTCVSSSGNVLIVTGSKDKTVRLWNATSKSCIGVGTGHNGDILAVAFAKKSFSFFVSGSGDRTLKVWSLDGISEDSEEPINLKTRSVVAAHDKDINSVAVARNDSLVCTGSEDRTASIWRLPDLVHVVTLKGHKRRIFSVEFSTVDQCVMTASGDKTVKIWAISDGSCLKTFEGHTSSVLRASFITDGTQFVSCGADGLLKLWNVNTSECIATYDQHEDKVWALAVGKKTEMIATGGGDAVINLWHDSTASDKEDDFRKEEEAILRGQELENAVLDAEYTKAIRLAFELCRPHKVFELFSGLCRKRDSDEQIVKALQGLEKEEFRLLFEYVREWNTKPKLCHIAQFVLYKTFNILPPTEIVQVKGIGELLEGLIPYSQRHFSRIDRFVRSSFLLDYTLGEMSVIDPETVETEYPKDEKKKEKDVIAAMEQDTDELKQETPSRKRKSQKSKGKSNKKRLIAEAQGSVIAV

SEQ ID NO: 16018 - protein, 580 aa, Solanum lycopersicum
MKYLFSKNGGLLEDENSGLYTRDGSVDIKGNPVLKSETGNWRACPFILGNECCERLAYYGIAANLVTYLTKKLHEGNVSAARNVTTWQGTCYITPLIGAVLADAYWGRYWTIATFSTIYFIGMCTLTLSASVPAFKPPQCVGSVCPSASPAQYAIFFFGLYLIALGTGGIKPCVSSFGADQFDDTDPKERVKKGSFFNWFYFSINIGALISSSLIVWIQENAGWGLGFGIPAVFMGIAIASFFFGTPLYRFQKPGGSPLTRMCQVLVAVFHKWNLSVPDDSTLLYETPDKSSAIEGSRKLLHTDELRCLDKAAVVSDNELTTGDYSNAWRLCTVTQVEELKILIRMFPIWATGIVFSAVYAQMSTMFVEQGMVMDTAVGSFKIPAASLSTFDTISVIVWVPVYDKILVPIARRFTGIERGFSELQRMGIGLFLSMLCMSAAAIVEIRRLQLARDLGLVDEAVSVPLSIFWQIPQYFILGAAEIFTFIGQLEFFYDQSPDAMRSLCSALSLLTTALGNYLSSFILTVVTSITTRGGKPGWIPNNLNGGHLDYFFWLLAALSFFNLVIYVFLCQMYKSKKAS

SEQ ID NO: 16019 - protein, 387 aa, Debaryomyces hansenii
MVSDGEFTRTQIFGTVFEITNRYTDLNPVGMGAFGLVCSAIDKLTGQNVAVKKIMKPFLTSVLAKRTYRELKLLKHLRHENLITLDDIFLSPLEDIYFVTELQGTDLHRLLTSRPLEKQFIQYFTYQILRGLKYVHSAGVIHRDLKPSNILINENCDLKICDFGLARIQDPQMTGYVSTRYYRAPEIMLTWQKYDTEVDLWSVGCILSEMIEGKPLFPGKDHVHQFSIITELLGSPPPDVIETICSENTLRFVQSLPHRDPIPFSERFAQCTHVEPEAIDLLAKMLIFDPKKRISALDALSHPYMEPYHDPTDEPVCEVKFDWSFNDADLPVDTWRVMMYSEILDFHQIIGAGANGTTQEQMAQIQQEGIQAPSSQYQQTNQEQKVE

SEQ ID NO: 16020 - protein, 187 aa, Prunus armeniaca
EYCSFYYKNDEMVQNDSELQSWWKELREEGHGDKKDEPWWPKMQTCEELIESCTIIIWLSSAYHAAINYGQYSIGGYVPNRPTISLHFMPEEGTPEYEELKTNPDKAFLKTFTPQLQTLLGMASIEILSRHPVDELYLGQRGTPEWTTDADMLQAFEDFRKKLEGIEKRIIKMNKDEKLKNRVGPAK

SEQ ID NO: 16021 - protein, 523 aa, Magnaporthe grisea 70-15
MADPFAPRTMKRRNVKGLALTPAAPKPPPTAENAPIHRDSDQHAQLEIGIEFNLDLRPEDLEVIKDLGSGNGGTVSKVRHIPTNTVMARKVIHVEAKREMRKRIVRELQIMHSCNSEYIVTFYGAFLNENNDVIMCMEYADVGSLDRVSRVFGPIRVDVLGKIAEATLGGLTYLYAKHHIMHRDIKPSNILVNSRGSIKLCDFGVSGELINSIADTFVGTSTYMAPERIQGEKYTVKSDVWSFGLSIMELAIGKFPFAASEQLSDAESAPAGILDLLQQIVHEPAPKLPKSDAFPQILEDMIQKCLYKNPDDRPTPEELFERDPFVQAAKRTPVDLREWAFGLMERDNRKSHLAPQLSPATADLLRSSDSPTATYHGDDRPLETPTSGEIPILGAIVSPRDQYGSISSRSPTRAGGGIGGLGRPGGSALHPGLGPRMATTSSVPMSSGASYHGVSSSSADYASAIPAQPSSASKATFSLPMRPAPAGTIPPPPPRKETPDESKKESRRQALFGPPSSTGSYGF

SEQ ID NO: 16022 - protein, 107 aa, Triticum aestivum
  misc_feature (58)..(58): Xaa can be any naturally occurring amino acid
  misc_feature (90)..(90): Xaa can be any naturally occurring amino acid
  misc_feature (95)..(95): Xaa can be any naturally occurring amino acid
  misc_feature (99)..(99): Xaa can be any naturally occurring amino acid
MAPTVMASSATSVAPFQGLKSTAGLPVSRRSNGASLGSVSNGGRIRCMQVWPIEGIKXFETLSYLPPLSTEASSSRSDYLIRSKWVPCLXSTSWXIFPXHNASPGVL

SEQ ID NO: 16023 - protein, 504 aa, Mesorhizobium sp. BNC1
MADITDTNRDEWKAAAQKASIEGRAFIGGRYIDAADGDSFDCINPATGRVLGKIASCKSTDIDLAVRSARRAFDGGAWSCCDPSERRKVLIRLADLIEAARDELALLETLDTGKLIRDSVTLDIPSSAAVFRFYGEACDKLLHEVVPVGPYAFASITKEPVGVVGAVIPWNFPLKMAAWKCAPALAVGNSVVLKPAEQSPLTALKLAQLAVEAGVPEGVFNVVPGFGPEAGAAIGLHSGIDCVGFTGSTEIGKRFLAYAGQSNMKRVWLECGGKSACIVFPDAKNLEAAAKAAALGIFFNQGEVCSATSRLFVHRDLLDDFTTLLVEASNSFKPGDPLEVSSGMGSMISEEQTTRVMSYIEKGKEEADLIAGGSRVLQETGGYFIEPTIFRNVDPRSVIACEEIFGPVLSIIPFGSESEAVELANASIYGLGASVWTGDLDRAFRLSRRLHAGSISINAVDHVDLRTPFGGVKQSGNGRDLSLHALDKYCDLKTTWMAVQGSAA

SEQ ID NO: 16024 - protein, 763 aa, Zea mays
MPLSPSPPPNAAAAAALPLLLLLVCASSIAAQPLASSQAKALLRVRRLLFYPPALEPLRGAPDPCALPPAPALAVACEGGQVTALSVLGDRDPDAAWRAALPASFSSEALFTTLTRLPALARLSLVGLGAWGPLPGAKLRRLQALQQLNLSSNYFYGAVPDGLARLYSLQSLVLSWNWLNGTVPSLSGLQFLEELDLSHNRLGPAFPDVGRSVARLVLDDNNFTGGIPAGVSSLGLLQYFDVSGNQLQGWIPSSVFALPALRYINLSRNRLAGQLPATTACAEALAFVDVSANLLTGARPPCMRGNSSARTVLVAGNCFADAKQQRASSYCNPGALAAVLPPPQGNGGGGGQGTGKGREIGMVLAIAGSVVGAALLIALAMVVVLRRARRQRPEATILPKSPAATPTNKADGWKAPAKATQKIITPADKRHASQAARVNTLEVPAYRVCTLEELQEATDNFSSSNLIKTSPLAQDYNGQLQDGSRVLVRCLRLKPKYSSQSLVQYMEIISKLRHRHLVSIIGHCIVSDEENPNNASSVYLVSECVTNGSLRSHLTEWRKREMLKWPQRVCAAIGIARGVQFLHNLTAPGFVQNNLNIEHILLDKTLTSKISNFSLPMISTSKNGKILSETPFAVHEDNDIGSAQNAAQGDKEDIYQIGLILLEVITGKPTESQSQLESLKAQLSEALTEDPDRLKDMADPAIHGTFAVDSLSTVAEIALKCTAGDPSDRPSIDDVLWNLQYSMQVQDGWASSESLGLSVKSQV

SEQ ID NO: 16025 - protein, 378 aa, Oryza sativa
MTTPLAAPRTPHRMRALSLARASSPPPLLLHLRRALAPASSSSPAPVLLLRPAVSCSSLFVSDRAAAARRSSGSSRRSMASQQFPPQNQETQPGKEHAMDPRPEAIIQSYKPANKLKDKVAIVTGGDSGIGRAVCLCFALEGATVAFTYVKGQEEKDAEETLRALRDIRARTGAKDPMAIPADLGYDDNCRKVVDEVAGAYGGAIDILVNNAAEQYERPSITDITEDDLERVFRTNIFSYFFMSKHAVKRMRDRRGGAGAGGCSIINTSSINAYKGNKTLLDYTATKGAIVAFTRALALQLAEEGIRVNGVAPGPIWTPLIPASFAEEKVRQFGSQVPMGRAGQPSEVAPSFVFLASDDASYMSGQMLHVNGGVIVNG

SEQ ID NO: 16026 - protein, 290 aa, Candida albicans SC5314
MAACLVTHPLDLAKVRLQTATKPGQSLLSMIYQIITKEGFFKIYSGLTASLLRQATYSTTRFGIYEFLKEQYMESIATTGGTEQKKPSTAVLLPMSMIAGALGGLVGNPSDVVNIRMQNDSTLPINQRRNYRNAFDGIYKICQQEGINSLFRGLTPNLIRGVLMTASQVVTYDIAKSILVDHIHMDPSKKSTHFSASLIAGLVATTVCSPADVVKTRIMNSKGSTGGGSGGDGVNGNAISILKNAVKHEGIGFMFRGWLPSFIRLGPHTIVTFLVLEQLRKFKLGMSRSD

SEQ ID NO: 16027 - protein, 335 aa, Bacillus cereus ATCC 14579
MCGITGWVDYKRSLEGERDVVTKMAETLAKRGPDDNKVWIKGNVAFGHKRLIVVDPEGGKQPMTCLKDETNYAICYNGELYNTEDIRKELLRRGYRFKGHSDTEVLLASYIEWKEECVDHLNGIYAFAVWDEQKEQVFIARDRLGVKPLFYKYDSGRLLFGSELKAILSHPDVKAEVTLEGLSEIFGLGPSRTPGHGIYAGIKELRPGHAMTFSKNGLCIWRYWNVESKKHEDSFEETVEKTRFLLQDAITRQLVSDVPLCTFLSGGVDSSAITAIAAKEYERSGKGQLHTYSIDYEDNDKYFKANAFQPNSDAPFINLMTETFQTNPSSLRHFE

SEQ ID NO: 16028 - protein, 265 aa, Bacillus cereus ATCC 14579
MPGMADIDSSLLWFCREIKQDFVVGLSGECADEIFGGYPWFYREDDLQSSAFPWMRSTEAREQLLKKEWRNKLNLQQYVQRRYEESIQEVPILEGESPLEAKRRQLFYLNMIWFMTTLLDRKDRMSMGASLEVRVPFADHRLVEYAWNIPWEMKMYKNREKGLLRKALEGILPHDILYRKKSPYPKTHNPHYTKAVTVWLQNLLTDKGSILHELFDKEQLSGLIQSGGSAFQTPWFGQLMTGPQLLAHLAQIHVWFKEYGVNIKE

SEQ ID NO: 16029 - protein, 152 aa, Staphylococcus aureus
NFNSLGLADTYEALNIPIEDFHLIKEIISKKELDGFNITIPHKERIISYLDHVDEQAINAGAVNTVLIKDGKWIGYNTDGIGYVKGLHSVYPDLENAYILILGAGGASKGIAYELAKFVKPKLTVANRTMARFESWNLNINQISLADAEKYL

SEQ ID NO: 16030 - protein, 514 aa, Rhizobium leguminosarum bv. viciae 3841
MKRLKLLHSIYLAGSAIVPFALATAAHAAPAGYDKIDNVVVIYAENRSFDNLYGSFPGVDGLSNATADRARQLDRDGQPLSELPPAWGGLTAKGVTPAVTEAQSAHLANAAFAIDDPKGFAEAPSVITRDLWHRFYQEQMQIDGGKNDKFVAWADSGSLVMGHYDGSILPMWHVAKKYVIADNFFQGAFGGSFLNHFALVCACTPYYPDADKSPAKPTIAKVDADGTSLTVAENAPKSALEGAPKFVSDGNLTPDFYAVNTMQPPYQPSANPPAKNGDPAYADPAAATTLPPQHEITIGDLMSLKGVSWAWYSGAWQAVLDGKNATPVPNFQFHHQPFNYFANFAPGTPARSEHLKDGGLGGEAFLRDIDDGKLPAVSFYKPQGNLNEHGGYADVSSGDQHLADIVSHLEKSPQWGHMLVIVTYDENGGFWDHVAPPKADRWGPGNRIPAFIISPFAKGGMVDHTQYDTTSIIRFITARYDLPVLPGVIARDKALRNNDRPPMGDLTAALDLSH

SEQ ID NO: 16031 - protein, 1005 aa, Shewanella sp. ANA-3
MNRRQFFKLCAVGAATSTISALGLMSEKAFASVRGFKLLRAKETRNNCCYCSVGCGLLMYSQSSNGKNAEQSIFHIEGDADNPINRGALCPKGAGLVDYVNSPHRLKYPEVRLPGSDKWQRISWDEAFKRIARLIKDERDANLVEKNAQGQTVNRLVSLGMMTSSAQANEGCYITHKFGRAIGMLGIDNIARVCHAPTPAAMAPTFGRGAMTNHWADMKNTDLAIVMGGNAAEAHPVGFGWVTEAMEHNNAKLIVVDPRFNRSAAVADLYAPIRSGTDIAFLLGMIRYLLETQQINLNYVKAYTNATFIVREDFEFNDGLFSGYDEANHKYDQSTWFYELDEEGYAKVDPSLSHPRCVINLLKKHVDRYDPYTVSSITGTPKEAYLEVCQQIGATHVDHKAATFLYALGWTQHSVGAQNIRTMAMIQLLLGNMGIMGGGVNALRGHSNVQGATDLGLLCQGLPGYLKLPQDRDVDLQNYLAHYTPKALRPNQTNYWHNYPAFTVSLLKAFFGEHATAENDYGYNWLPKWDQQYDINKQIDMMVHGEVNGYFIQGINALNSQPDKQKVSKGLSNLKFLVVLDALANETSSFWRNAGQFNDVDTASIQTEVFRLPTTCFAEESGSIANSSRWLQWHFKGANPPGEALSDPAILSGIMLELKRLYREEGGRLPAPIEAIKWDYAIEHEPSSEEIAREMNGYDLTTGKLLNGFSELKSDGSTSCGIWVYSGMWTEAGNLMARRDNSDPSGKGITPNWSFAWPANRRILYNRASCDVQGKPRDPSRVLLEYKDNKWQGIDVPDFNAKLNAEESAHPFIMQADGVGHLFALRDLKDGPFPEHYEPFESPLASNPLHPKVTNNPVARMFKGLRESFGTNEEFPYVGTTYSMTEHFNNWTTHCHLAAITQPQHFIEIDETLAAEKGINNGDWVKVSSKRSHIVTKAYVTKRLQPMMVQGKKVHTIGIPRHGSYEALTQKSYIVNELTSSVGDANTQTPEYKAFLVNIAKAEGF

SEQ ID NO: 16032 - protein, 152 aa, Staphylococcus aureus
NFNSLGLDDNYEALNIPIEDFHLIKEIISKKELDGFNITIPHKERIIPYLDHVDEQAINAGAVNTVLIKDGKWIGYNTDGIGYVKGLHSVYPDLENAYILILGAGGASKGIAYELAKFVKPKLTVANRTMARFESWNLNINQISLADAEKYL

SEQ ID NO: 16033 - protein, 419 aa, Oryza sativa (japonica cultivar-group)
MPEEDEEIVSSVVAGKVPSYVLETKLGDCRRAAGIRREAVRRITGRQIEGLPLDGFDYASILGQCCELPVGYVQLPVGIAGPLLLDGQRFYVPMATTEGCLVASTNRGCKAIAESGGAVSVVLRDGMTRAPVARLPTARRAAELKAFLEDSVNFNTLSMVFNRSSRFARLQGVQCAMAGRNLYMRFSCCTGDAMGMNMVSKGVQNVLDYLQDDFPDMDVISISGNFCSDKKPAAVNWIEGRGKSVVCEAVIKEDVVKKVLKTNVQSLVELNVIKNLAGSAVAGALGGFNAHASNIVTAIFIATGQDPAQNVESSHCITMLEAVNDGRDLHISVTMPSIEVGTVGGGTQLASQAACLDLLGVKGANRESPGSNARLLATVVAGGVLAGELSLLSALAAGQLVKSHMKYNRSSKDMSKVIS

SEQ ID NO: 16034 - protein, 804 aa, Bacillus licheniformis ATCC 14580
MFVSYKWLQEYVNLDGMTPEILAEKITRSGIEVEGIEYKGEGIKGVVIGHVLEREQHPNADKLNKCLVDIGEEEPVQIICGAPNVDKGQKVAVATVGAVLPGNFKIKKAKLRGEASNGMICSLQELGIQGKLVPKEYAEGIFVFPGDAETGADALQSLALDDAVLELGLTPNRADAMNMLGVAYEVAAILGREVKLPETAYQAGAEKAADYISVKIEDPEANPLYAAKIIKDVKIGPSPLWMQTKLINAGIRPHNNVVDVTNFVLLEYGQPLHAFDYDRFGSKEVVIRKAYENETITTLDEQERTLTTEHLVITNGSSPQAVAGVMGGAESEVREDTATVLLEAAYFNGQTVRKASKDLGLRSESSVRFEKGIDPARVRLAAERAADLISRYAGGTVLEGTVEENHLDIKENVIRLSVDKVTKVLGMSISKEEMVNIFERLGFAVEDAERELVVTVPSRRGDIAIEEDLIEEVARLYGYDNIPSTLPEVTGFAGGLTPYQDKRRKVRRFLEGAGLSQAITYSLTNDKKATAYALEKSFKTILSLPMSEERSVLRHSLLPNLLDSVAYNLARQADSAAFYEIGSVFLKAEEHTKPVEKEHVAGAVTGLWHKNLWQGEKKPVDFFVVKGIVEGLLEKLGITEGIEFAQSERKELHPGRTANILHNGSLVGFIGQLHPSVEKELDLSDTYVFELDLHELLRLDVPEITYTPIPKYPSVTRDIALVVDKQTTAGQLEDVIKTAGGKWLKEVHVFDVYEGEHMEEGKKSVAFSLQYLNPEQTLTEEEVTKVHDQVLKALEDKYQAVLRG

SEQ ID NO: 16035 - protein, 234 aa, Aegilops speltoides var. ligustica
SELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTI

SEQ ID NO: 16036 - protein, 244 aa, Oryza sativa
  misc_feature (119)..(119): Xaa can be any naturally occurring amino acid
MADRLELQGRHGKSRVRVSRVWRRPAAAGGHVIVEWNVAVSVVSDCLPSYTSDDNSAIVATDSIKNTVYVKAKECTEIVSMEEFAVILGRHFTSLYPQVSEATVTIAERPWERVVVDGXPHSHGFKLGVEKHRHRGQLRRSLETLLINSGIKDTPAKTLSPVDTCEDASTFPDQKRLGPRTPGGPERFQSKVCSQLAYSFNLAPRRTTHHRGDAPKCQAPVEPVFCSPSVYNISKMQRHHEHQR

SEQ ID NO: 16037 - protein, 234 aa, Aegilops speltoides
SELLGIAVKKAEDVIGPEVEKLVADLENGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTI

SEQ ID NO: 16038 - protein, 434 aa, Frankia sp. EAN1pec
MDRVVVVGGGLAGGRAVVELREQGFAGAITLVGAEEHRPYDRPPLSKAVLSGRTDDTTLPFDLDGVELLLGRHATGLRPGVLETDGGAVEFDGLVLATGAAPVRLPGPGEQRVLRTIDDALALREALTPGIRLAIVGAGWIGAEVATHAASAGAAVTVVEAGSAPLLALGAEIGGYTVPWYAKVGIDLRLGAAVDEIRADGLALAGGEFVPADVVVVGVGVRPDVAWLESSGLPLDRGVVVDEWLSAVPGARVADAGGPGTADGAGGYRPDSVVAVGDCAAWWSRRYDRRLRVEHWECAQESPRVAVATLLRSLAGGDGPALAGDQAEIYDPVPYFWSQQFGRMIQFAGMPGADSTLVLRGDPTAVAPEGAKRAPGWSAGWFAPDGELVALVTVARPLDMVAGRRMLLAGVAPDVERFADPAVALKELQPAQPV

SEQ ID NO: 16039 - protein, 303 aa, Halobacterium sp. NRC-1
MAAVVAVGSAVLDRVYGLSNLPAPDGGAFVRDYTERAGGVAANVACALAALDHDAAVVSRVGRDDAGDRVRASLAEWGVDATRVRRGDDATSYALVLRGPEGNRMIVAGGDAVPGVALTSSDRDALRAADCVFTSAYAPDGVVRDLVALRRSGAVSALAFDLAGPRAELDGRGAAADTVDAAAATADLFVANAGAADSHVGVGPERAASEFAAMGASRVAVTDGSDGAFLATPATTVHAPARAVDVTDTTGAGDAFTAALVHAWVLGDAGVRDAGRIAAAAAAQNCTREGARGGLASPSDLPD

SEQ ID NO: 16040 - protein, 234 aa, Aegilops speltoides
SELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQIVPASAIPDGWMGLDIGPDSVKTFNDALDTTQTI

SEQ ID NO: 16041 - protein, 437 aa, Haemophilus influenzae R2866
MEILMKSGDLNKYDLVKNTLVLVLAGGRGSRLHELTDKRAKPALYFGGNRRIIDFALSNCINSDLNRIGVVTQYAAHSLLRHLQTGWSFLPQERGEFIDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEREVNTPQTSHDFGKDVLPKCLAEETLYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVNMEEDKKRFRISSTGKVILVTSKMLKILEGHEIGEEGHLD

SEQ ID NO: 16042 - protein, 514 aa, Salinibacter ruber DSM 13855
MSVPDALLKQLYTFGSLENTDRGVEFALKNRLQDATLTGLLDVKIDGDTVPPERVHLFMGEGETHAADEISDEDALDFPLRRTLHLRADRPALESGTHNLELTFRADPFGTLTFSVEDSISEQDEALERIPRDPDDNCSQAIIDERQQFVEDYGDTSLDHVPHYSFDPAVTEGNVENFTGVAQIPLGFAGPLTVHGEHAQDDVLIPLATSEGTLVASYNRGIKVCNLSGGIEATVSRDCMQRAPVFIFDNARAARDFTHWVDDHMDAIRAEAESTSSVAELLYIDHYLSNHFAYLRFNYRTGDAAGQNMVGRATFAACGWIMDQYPGPVEHFYLESNFATDKKASQVNVMRTRGKRVTAEATIDRDTLAQHMRVEPEALHHHWSVSTVGAFLSGANNNGAHSPNAITALFIATGQDVANVSESSAGVLYTDITDDGDLDISLTIPSLIVATYGGGTGLPTQRECLEVMGCYGKGKVHKFAEIVAAATLAGELSLGAAISSSDWVSSHETYGRNR

SEQ ID NO: 16043 - protein, 222 aa, Brassica napus
MAHILNTQHLLTTSGKKRNDRDDEDGVSTVAKKSSLMACEADPAVALASIRHEFGEHGGVNMSIEASATFTVMEPDTMRRMFAGELGPENDFFVYSRHFNPTVLNLSRQMAALEGTQAAYCTSSGMAAISSVLLQLCSSGGHVVASKTLYGGTHALLSHFLPRTCNITTSFVDITDHGAVADAIVEGRTQVLYFESMANPTLTVADTPELSRIAHEKGVAVV

SEQ ID NO: 16044 - protein, 208 aa, Triticum aestivum
MTSVWKTKVLPGLNKIFDKDGKKAAAAEFLKSFNKEEIDKEIEDKKTELEPKVVETIEASPPEIKGLMKDKKTSKIKKNSVAVTKFLDDLAKIDFPGAKLVSDAVAKSGTTPLSPAIVFILDKVAPFVPAPKEEPKAEPEDAAPAEETTTREVAVEEKKEEAEPSAAPAEAAAPVEAAAPAAEVVEEKKEEEKPAEAAAPAAEEPEKK

SEQ ID NO: 16045 - protein, 373 aa, Zea mays
MATNSPALTKRPSRHAPTHQTDRGEEKGQKATPPATTTMAASLQVQAAATLMQPAKIGGRAPSASLPSSRPSSQLARAFGVDAGAARITCSLQSDVRDVASKCVDAAKLAGFALATSALLVSGASAEGTPKRLTYDEIQSKTYLEVKGTGTANQCPTIDGGVDSFPFKPGKYQMKKLCLEPTSFTVKAEGIAKNAPPEFQKTKLMTRLTYTLDEIEGPLEVASDGTLKFEEKDGIDYAAVTVQLPGGERVPFLFTVKQLVATGKPDSFGGPFLVPSYRGSSFLDPKGRGGSTGYDNAVALPAGGRGDEEELQKENIKNAASSTGNITLSVTKSNPDTGEVIGVFESVQPSDTDLGAKAPKDVKIQGVWYAQLE

SEQ ID NO: 16046 - protein, 628 aa, Legionella pneumophila subsp. pneumophila str. Philadelphia 1
MKQFPGFYFDKNRAIDLICMGRVAVDLYAEQIGLDLKDVASFKKYLGGCAGNIAVGAARLGLKSQMFSCVGSDELGKFLKEELEREGVNIELLLETDNHLTGLVLLGIKPPSNFPLLFYRNDCADMQIKSDQISFTDLKNAKSLLITGTGLSTESMKNTTLEVVHLARKAETTIVFDLDYRPVLWRLTVIGNGESRYCQNEYVTQVYQQILPLCDLIVGTEEEICIAGGSNDIEVSLINIRQRTDAPIVVKLGEKGARVHFGADKGLLQAKSFPVEVLNVLGAGDGFMSGLLAGLLQGKSWEQAVTYANACGALVVTRHGCAPAIPYKEELNYFIQEYDHEPEIWNSSQLTQLHEKLSKNRKTQLLIKNPCGFADGLNSIVTMQDSPTAMSFSSLKLNKGQSHQFNSSYEFAALLMTGKVVFQYGCYSQEVERTDYFSQSPYVLHCSKNEVSSVIALTDCEILLMETENENLFSPILFDASNMLELDNRGEGVLENTSYRLVRTVFDKRNRPESNLVVGEIITFQGRWSSYPSHYHQQPEIYHYRFSEPQGYAFGENGKEVMRIEHYDTYQIANNQEHAHCTAPGYALYTLWFIRHLNNNAYTLPTFTKDHEWTRTSRANLRTWQHKQ

SEQ ID NO: 16047 - protein, 392 aa, Triticum aestivum
KNKQCTKKAPKPPLPAVSGTSFVVNDSHNVEESQKAELLPPKEEPTALLENKGSLSLWNIARNRESGVHEPFFQGRNTRDKSETADSNTGYYVGLNVIDIDKDNGNPQMCASYAAEIYRNLMAAELIRRPKSNYMETLQRDITKGMRGILIDWLVEVSEEYKLVPDTLYLTVYLIDQFLSRKYIERQKLQLLGITSMLIASKYEEICAPRVEEFCFITDNTYTKNQVLKMECEVLNDLGFHLSVPTIKTFLRRFLRAAHASQKAPCATLGYLGNYLAELTLTDYSFLKFHPSVVAASAVFLARWTLDQSDLPWNCTLEHYTSYKSSDIQGCVRDLWELQQGNTSGSPPLNAIREKYRQEKFECVANMLSPAMPVSLFHRQSNGTSPLLINNS

SEQ ID NO: 16048 - protein, 269 aa, Brassica napus
MGRGKVELKRIENKINRQVTFAKRRNGLLKKAYELSVLCDAEIALLIFSNRGKLYEFCSSPSGMTKTVEKYRKHSYATMDPNQSAKDLQEKYQDYLMLKSKVESLQHSQRHLLGEEIAGMGVNELEQLEHQVDASLKQIRSRKAGAMLDQLSDLKTKEEMLLETNRDLRRKLEESDAALTQSMWGAASAGEHSHQQQQQYHQQQQQQQHQQGMSSYQANPPSQENGFFRPLHGNVALQMSHYNPGVTNASNSATTSQNVINGFFPGWML

SEQ ID NO: 16049 - protein, 460 aa, Ralstonia metallidurans CH34
MSDMQEHKVTPYDQFNYEVPENVFPREGISANAAAAIVISDEWTDTNPMLNMSSFVTTFAEPEAREVAARNIFKNYIDHDMYPRLFAMEGRMVRWLHELWNGPKGVEPYGTCTVGSSEACMLGGLAHKWNWRQRRQAEGKDATRPNMVTGGNVQIVWKKFLRYFDVEPRIVPLKPGNYCLTAEDLDKYVDENTICVVAIAGQTFTGEDDDIQGIHDWLDAYEKRTGISIPMHIDGASGGFVNPFLYPDYKWDFRLPRVQSINASGHKYGLTPPGLGWVVFRERKIFNEELVFYVNYLGGEMPTATLNFSRNAFQVAVQYYQFLRLGFDGYKRVMQHTLDNAIFLRQQLVDSGYFDIMNTTQRIPVVAVTLNKKYKNFNEFDVSNKVREKGWVLSAYTMPPNAESVTSLRVVVRPHVNHNVAQLLANDIINACKFLEANGGNAKPPALHKHAEAQSTSLKC

SEQ ID NO: 16050 - protein, 568 aa, Frankia sp. EAN1pec
MWAAVSSTTPSSSSATTAAITGSTWSASGSSARTGRGSSTPSRRSSTPRAPSPGCAATSWTACHRRPARPGCRGSGSGTRWRSSSRRTARRSCGPGTPPTTMSCSASSSGRCPRCRAGCRGSPETCASSGRTSAAPACPRRRPTRTTRWPTRGTTWPAGPSSRRCVPSSPRRRPGTPPTDGTISRRNVVDWPRRVYGEGLVGVSGELGCRRQMCRRSGATRAERPWGVKIGVLTGGGDCPGLNAVIRAVVRKGVGVYGHSFVGFRDGWRGPLENDTVPLDVTAVRGILPRGGTILGSSRTNPFASADGPSRIRETLDRTGVDAIVAVGGEDTLGAAARLHAEGIPVVGVPKTIDNDLSATDYTFGFDTAVNIAMEAIDRLHTTAESHHRVLVVEVMGRHAGWIALHSGMAAGANVILIPERPFDIDKVCAFVEQRFATRYAPIIVVAEGARPIAGTAMAREGELDAFGHVRLQGISGLLETEIRGRTGRETRATVLGHVQRGGTPTAFDRWLATRFGLHAVDAVHEGDFGTMVALHGTRIDRVPLSEATGELKTVPEHLYGEAEVFFG

SEQ ID NO: 16051 - protein, 234 aa, Aegilops speltoides
SELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVAASAIPDGWMGLDIGPDSVKTFNDALDTTQTI

SEQ ID NO: 16052 - protein, 495 aa, Staphylococcus aureus subsp. aureus MSSA476
MAVNVRDYIAENYGLFINGEFVKGSSDETIEVTNPATGETLSHITRAKDKDVDHAVKVAQDAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPKGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGDPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 16053 - protein, 370 aa, Magnaporthe grisea 70-15
MSASGLEKATGGGLHPALYIATILFNKWILDNKDTPFKYPVILTCWHMILSTVATQVVARTTTMLDGRKEVKMTGRVYLRSVVPIGLLYSGSLVCSNMVYMYLSVSFIQMLKAAAPVAVLLCSWAWRLKEPSAKTFANVCVIVLGVMIASLGEISFSWMGVFYQLGGIIFEALRLTMIEVMLAGDSEQKKMDPLVSLYYYAPVCAVTNVFVALIVEARTFQVEDLISVGIVMLVLNALVAFMLNVASVMLIGKTSSLVLTLSGILKNILLIVVAVLFYAEKVSLMQFVGYSIALGALTYYSLGWDVIKSRSVAAADWTRAMFSSSGDAGLSPAVRRALILGVVMLLLVLVTFGMFYDGTYSLKETIVGRR

SEQ ID NO: 16054 - protein, 498 aa, Bacillus halodurans C-125
MQKISTNDSKLNPRLVAFLNGGPKKLFINGEWVDSFSGQSFETMNPATGETLALVAEAGSEDIDFAVKAARKAFDEGPWSKMSAAERSRLIYKLADLIEDHKEALAQLETLDNGKPIRETANADIPLVIEHFRYFAGWATKIVGQTIPVQGHYFNYTRHEAIGVVGQIIPWNFPLLMAAWKLGAALATGCTVVLKPAEQTPLSALYLGELINEAGFPKGVVNIVPGFGHSAGTPLVNHPAVDKVAFTGSTDVGKLIMKQASESLKRVTLELGGKSPNIILPDADLSKAVPGSLMGIMFNQGQVCCAGSRLYVQKKQYDHVVADLVSLTNEIQQGDGLLEQTTMGPLISNQQQSRVKNYIDRGVEEGAELLTGGNIPYDQGYFVAPTIFADVDHSMTIAKEEIFGPVVAAMPFDSIDDLIDKANDSDYGLAAGVWTQDIKKAHYIAHRIKAGTIWVNCYNVFDAASPFGGYKQSGIGREMGSYALENYTEVKSVWVNMD

SEQ ID NO: 16055 - protein, 316 aa, Shigella flexneri 2a str. 2457T
MNELDGIKQFTTVVADSCDIESIRHYHPQDATTNPSLLLKAAGLSQYEHLIDDAIAWGKKNGKTQEQQVVAACDKLAVNFGAEILKIVPGCVSTEVDARLSFDKEKSIEKARHLVDLYQQQGVEKSRILIKLASTWEGIRAAEELEKEGINCNLTLLFSFTQARACAEAGVFLISPFVGRIYDWYQARKPMDPYVVEEDPGVKSVRNIYDYYKQHHYETIVMGASFRRTEQILALTGCDRLTIAPNLLKELQEKVSPVVRKLIPPSQTFPRPAPMSEAEFRWEHNQDAMAVEKLSEGIRLFAVDQRKLEDLLAAKL

SEQ ID NO: 16056 - protein, 667 aa, Shigella flexneri 2a str. 2457T
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLAAQFNQPDHEIVDHFTYVFMGDGCLMEGISHEVCSLAGTLGLGKLIGFYDHNGISIDGETEGWFTDDTAKRFEAYHWHVIHEIDGHDPQAVKEAILEAQSVKDKPSLIICRTVIGFGSPNKAGKEEAHGAPLGEEEVALARQKLGWHHPPFEIPKEIYHAWDAREKGEKAQQSWNEKFAAYKKAHPQLAEEFPRRMSGGLPKDWEKTTQKYINELQANPAKIATRKASQNTLNAYGPMLPELLGGSADLAPSNLTIWKGSVSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQMEAAVGWKLAVERHNGPTALILSRQNLAQVERTPDQVKEIARGGYVLKDSGGKPDIILIATGSEMEITLQAAEKLAGEGRNVRVVSLPSTDIFDAQDEEYRESVLPSNVAARVAVEAGIADYWYKYVGLKGAIVGMTGYGESAPADKLFPFFGFTAENIVAKAHKVLGVKGA

SEQ ID NO: 16057 - protein, 471 aa, Legionella pneumophila subsp. pneumophila str. Philadelphia 1
MNKGMNAFVFLIAVIAGFGGFLFGFDSSVIADVKDQVISQLALTDWQWAQVVSSSLLGCILGIPISGLVADKLSRRSLLKVVALGFILGSSLCALAPGFVSILLGRFIIGICIGIASYIAPLFIAEIAPPHQRGTLVLINGLTITFGQAIAYLIGYFLHDYSLMSWRYLFWIGSLPALVLFSGMYFVPHSPRWIMIKYGADATLKTLKQIRPVGYNIQQELTEISNNLVNPAPAYIQMFKKPIVFVLLLGVGLGLFQQFSGINALMYYGPVVFESFGFSPVKNAILATFFLGLVNFIFTVVTLFYVDKLGRRFLLISGTLIASISLYFVSLLSCHSLFVNKFWILGGLSFYVMGYCISLGSLFWVLISEIYPLSVRGLAMSIATMFQWGANFVVSLLFLPIYQFSGQTVTFAMFATFCLLACWFIYYFVPETTSVSLEKLEENLSSGKKVRDIGQPVSKNIKIAKFNLIMD

SEQ ID NO: 16058 - protein, 484 aa, Cyanophora paradoxa
LEEKIKAMAAGEHINNSEDRAVLHMALRAKRDEVFNVDGKNVVKDIYEVLDKIKDFSERVRSGKFVGATGKPIKDIVAVGIGGSYLGPKFVYEALRTDAKGAKGGHGRKLRFLANVDPVEVARCVEGLNPETTLVIVISKTFTTTETLLNAKTMKDWFNKAGIMDVSKNMVAVSTNAEKVKEFGISTDNMFGFWDWVGGRYSVCSAVGVLPLALVFGYDVAEEFLMGARDIDRHFLSAPLEKNIPVLMGLIGIWNASFLGHSSRALLPYAQALLKLAPHVQQVAMESNGKRVCKDGTLLDYEVGEIEFGEPGTDGQHSFYQLIHQGRVVPCDFLGFAKSQYPVYLPDEHPVSNHDELMSNFFAQPDALAFGKTEAQVVAEGAPAELVPHKVFEGNRPSVSILFPESVTPFAVGQVLSLYEHRTAVEGFVWGLNSFDQWGVELGKVLATQVRMQLAKTRKEKAAIEGFVAPTTRLMERYINLTKN

SEQ ID NO: 16059 - protein, 341 aa, Glycine max
MSSTAGQVIKCKAVSWEAGKPLVIEEVEVAPPQAGEVRLKILYTSLCHTDVYFWEAKGQTPLFPRIFGHEAGGIVESVGEGVTHLKPGDHALPVFTGECGDCPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNG

SEQ ID NO: 16060 - protein, 728 aa, Zea mays
  misc_feature (173)..(173): Xaa can be any naturally occurring amino acid
  misc_feature (202)..(202): Xaa can be any naturally occurring amino acid
MPPRGAALLLLLVVLCVQLGTSSSTSLASYLFGFWSRTHQHRFPALAPGPAPSPQPEGAIIAHPVHRHHRRRHHASPPPSSFSPERQDCSRTTCSAPLTSTPIGSPCGCVYPMQIQLDLGVAPYQLFPRIDELEIEVAAGTFLKQSQVRIMGAGSSLQDPEKTTVSIVLVPLXGQKFDRTSALLISNRFLQRKVPIYSSTYXVDYVATYVHYPGLASLVPIPGSLGPVSSNEDPFGANIHNRRHHKINSKTVAIIALSAVVFVLTCLAIGITWRFNARRDSHAMGPISSSSITRKGAMRSSFSGTSSSAASFGSTIGTCPSTVKTFTITELEKATENFSFNKIIGEGGYGRVYRGVIEDGVEVAVKLLTRKHQNRDREFIAEVEMLSRLHHRNLVKLIGICIERSTRCLVFELVPNGSVESHLHGSDKIYGPTDFDTRMKIALGAARGLAYLHEDANPHVIHRDFKASNVLLENDFTPKVADFGLAKEASDGMDHISTQVMGTFGYVAPEYAMTGHLLVKSDVYSYGVVLLELLSGRKPVDMTQPPGSENLVTWARPLLTTREGLQRLVDPSLPAGYDFEKLAKAAAIASMCVHVEASHRPFMGEVVQALKLIHSGGGGDETCSGSFVGGATEESPWNDVSRSSWNDDPPATPGPALPLGYGSDPAGADERRPRSASSAVLDKIESLAMYDWSGPLRTKGRGSFYRLRGSMSEHGRPSDDGSVEGYLM

SEQ ID NO: 16061 - protein, 322 aa, Mycobacterium avium subsp. paratuberculosis K-10
MTVCRDADPRQKARAPGLVWPPGRRLTSAPMTDVCVVGSVNLDLSLAVDALPRPGETVLASSLRQAPGGKGGNQAVAAARAGARVQFVGAVGDDAAAGQLRAHLQANGVGLDGAVEIPGPSGTAIVVVDANAENTIVVAPGANGRFTLNDERARAVLAGCDVMLTQLEIPVATAVAAARHARSGGAVVVVNASPAGRDPDSLSELAAAADVVITNEEEASEWPWRPRHLVVTLGSHGARYVGADGEYSVPSPDVDAVDTTGAGDVFAGVLAANWPLEPGSPDQRRLALRRACAAGALATLVPGAGDCAPRAEEIERALRGKS

SEQ ID NO: 16062 - protein, 170 aa, Oryza sativa (indica cultivar-group)
MAAAAQAPAAAKVVVSTSPRAGGGGGGGGDRKVVPVVVAAAAGDEAQSEMHVLAVDDSSVDRAVIAKILRSSKYRVTTVESATRALELLCLGLVPNVNMIITDYWMPGMTGYELLKRVKESSQLKEIPVVIMSSENVPNRISRCLEEGAEDFLLKPVRPSDVSRLCSRIR

SEQ ID NO: 16063 - protein, 136 aa, Oryza sativa
MARTKQTARKSTGGKAPRKQLATKAARKSAPTTGGVKKPHRYRPGTVALREIRKYQKSTELLIRKLPFQRLVREIAQDFKTDLRFQSHAVLALQEALEAYLVGLFEDTYLCAIHAKRVTIMPQDIQLARRIRGERA

SEQ ID NO: 16064 - protein, 260 aa, Triticum aestivum
AYLGDTIEQVCTKKQAGTGPEFPGVRRPPRPLEPRVAVGFALDIARAMECLHAHGIIHRDLKPENLLLTADQRTVKLVDLGLAREETLTEMMTAETGTYRWMAPELYSTVTLRHGEKKHYNHKVDVYSFAIVLWELLHNRLPFEGMSNLQAAYAAAFKNIRPSADNLPEELSEILTSCWKEDPSDRPNFTQIVQMLLHYLSTLSPPEHMAPARTFSSENAILPPESPGTSSLMASRGDITPKGNIEDKPRGFFFCFSQCY

SEQ ID NO: 16065 - protein, 557 aa, Methylobacterium extorquens
MPSDIEIARAATLKPIAQVAEKLGIPDEALHNYGKHIAKIDHDFIASLEGKPEGKLVLVTAISPTPAGEGKTTTTVGLGDALNRIGKRAVMCLREPSLGPCFGMKGGAAGGGKAQVVPMEQINLHFTGDFHAITSAHSLAAALIDNHIYWANELNIDVRRIHWRRVVDMNDRALRAINQSLGGVANGFPREDGFDITVASEVMAVFCLAKNLADLEERLGRIVIAETRDRKPVTLADVKATGAMTVLLKDALQPNLVQTLEGNPALIHGGPFANIAHGCNSVIATRTGLRLADYTVTEAGFGADLGAEKFIDIKCRQTGLKPSAVVIVATIRALKMHGGVNKKDLQAENLDALEKGFANLERHVNNVRSFGLPVVVGVNHFFQDTDAEHARLKELCRDRLQVEAITCKHWAEGGAGAEALAQAVVKLAEGEQKPLTFAYETETKITDKIKAIATKLYGAADIQIESKAATKLAGFEKDGYGGLPVCMAKTQYSFSTDPTLMGAPSGHLVSVRDVRLSAGAGFVVVICGEIMTMPGLPKVPAADTIRLDANGQIDGLF

SEQ ID NO: 16066 - protein, 238 aa, Staphylococcus epidermidis ATCC 12228
MTHVDIAATIAPEDKLSKTLLKDIKVNEESIDIIELRIDQWPSFNKALLNEVIKQLKIFHLKILVTYRTSVQGGKGAVNEQEYLNILGELIECPQFDMIDIEWSSAVKIEKYTHLVQRAQQKGLEVVLSHHNFQETPALDELKFIYFKMQKLNPEYLKLAVMPKCQEDVLHLLEAMSLTAKHTTCRIVGISMSSLGKVSRIAQGVFGGTLSYGCIEEPQAPGQIHVSKLKSMVSFYED

SEQ ID NO: 16067 - protein, 234 aa, Thermus thermophilus HB8
MRAENPVFFLDYDGTLAPIAQRPEEAFPHPEAPRVLRALMERHPVYVVTGRRVRDLEPLLPLPGLPVVGGHGLEEGVLFGEVRPLFPVDLGPLRARLPSCPGVRVEDKGFALALHYRGAEDEEKARACLEAWLKAVEGLLEALGLEALPGKKVLELKPKGVDKGQAVLRLLGRHPDHTPVYIGDDTTDEAAFLALRGRGLTFKVGEGPTAAQGRLKDVEEVLAYLQTYLRPTSL

SEQ ID NO: 16068 - protein, 465 aa, Salinibacter ruber DSM 13855
MRAGPPSFFVPTNQSFRRSMPTKTDVLEQIEAKGVDFLRLQFIDILGTVKNVSVPAHQAEKAFEEGIYFDGSSIEGFVRIQESDMRLDPDPDTFAVLPWRSQRGDDTVSARLICNIIDTSTGEPFVGDPRYVLQRAIDRAADMGFELNAGPEPEFFVFEKDENGRATTETHDAGGYFDLAPKDLAQEIRAEVIYTLEAMDFEVEASHHEVAQGQHEIDFKYDDALTTADNIATFRSVVRAIAELHDVHATFMPKPIAGINGSGMHTHLSLFEDGENVFHDGDDEFSLSDTAYDFLGGILEHAPALTAICNPTVNSYKRLVPGYEAPIYVAWSDVNRSALVRKPAARVPAASRIELRSPDPSSNPYLALATMLHAGLDGIEKGRSAPDPVRENIYEFTEADREARGIETLPSTLGQAVTALQKDDVVLDALGPHVSEKFTQAKTQEYTEFLASVSQWELDRYLETF

SEQ ID NO: 16069 - protein, 336 aa, Streptomyces avermitilis MA-4680
MTVVGPFGLSVRDQALEADVQAGLAAVEEGLLEATKSEVPFITEAAQHLVRAGGKRFRPLLVMLAARFGDPYAPGLVPSAVVVELTHLATLYHDDVMDEADVRRGVPSANARWGNSVAVLTGDFLFARASHILADLGPEAVRVQAEAFERLVTGQILETAGPMDGRDPVEHYLEVLSGKTGALVAVACRFGAMMSGADETVVDVLTQYGERLGVAFQLADDVLDIASDSHESGKTPGTDLREGIPTLPVLRLRERVARLGLAEDIALCELLDSDLTDDARHAEALTRLRAHPALEQARKDTVRYVEDARAALAPLAECNAKAALIELCDAVVHRAG

SEQ ID NO: 16070 - protein, 257 aa, Crocosphaera watsonii WH 8501
MEWLEISGSSVLVPRYPIAIIHFLGGAFVGTAPNFTYRWLLEELAKEGYAIIATPFVNTFDHLAIARNVLNRFEGILDRLQTNNSLGQGYLPIYGIGHSMGCKLHLLIGSLFSVERAGNVLISFNNYPVKKAIPFLEQLDIENYLNLEFTPSTDETKLIIEKDYLVRRNLLVKFTDDNIDETKILEPILDDKYPNLIALQTLSGNHLTPLSQDIKWEAGEIFTPLDAVGQWVKQAFSRDLYRLKNEILRWLNPGRIV

SEQ ID NO: 16071 - protein, 487 aa, Oryza sativa (japonica cultivar-group)
MGRRDEESIIFSSLENGVRKRESEYFSRRTGACDWAALRSSRPNHTESTKMIGPLDRCVIAISARTSQGLQAHNACLTKRVGPHMSVAVREHNPHPVLFAPFPPFVLRPPRSLPRVREPDGFSVWSGPPYPTGSAPPVRLPKTACSATYFSSDGSRLLATVASASATVYDCRTLSVVRSFELPGLLAAALSPAGTFLQTFQKSSSPQEKNVTVWHVDTATALYQHYQKNMSKATWPMVQFSADESVACRMMTNEIQFFDPKDFTKGFVYKLRMPGIAAMQLASAPGSHVAGFVPEAKAFWDYSEKKLVGKTKAECSVTSEWSPDGRHFMTATTAPRLQIDNGIKIFDHNGSLQFKKMFEKLYQADWKPEAPEKFSDIADLTISLGSIKIEETKKQGSLHFLIFHVISAQGSKSAQPSSKAPANIAAKPTAYRPPHSKNSADVQDKLFGGLASTGGEMSKNALRNKKRREKQKEKKAAEGSGASADDN

SEQ ID NO: 16072 - protein, 138 aa, Coprinopsis cinerea okayama7#130
MARTKQTARKSTGGKAPRKQLASKSAARKTATTAAGGVKKPHRFRPGTVALREIRRYQKSTELLIRKLPFQRLVREIAQDFKTDLRFQSSAVMALQEAAEAYLVSLFEDTNLAAIHAKRVTIQPKDLALARRLRGERS

SEQ ID NO: 16073 - protein, 462 aa, Chlamydophila abortus S26/3
MSTDFDCVVIGAGPGGYVAAITAAQQGLKTALIEEQQAGGTCLNRGCIPSKALLVGAGIVSQIKHANQFGIHIDGYSIDYPAMVQRKNTVINGIRQGLEGLIRSNKITVLHGRGSLISSTEVRVKGQDTSVTKSQYIIIATGSESRPFPGVPFSSRILCSTGILNLTELPKKLAIIGGGVIGCEFASLFHTLGVEITIIEVAEQILSVNNADISKTMLDKFSRQGIRIITKASIHALEDLGDRVRITVNEQTEEYDYVLVAIGRQFNTTDIGLDNAGVIRDNRGIIPVDETMRTNVANIFAIGDITGKWLLAHVASHQGIVAGKNAASHNEIMDYSAVPAVIFTLPEVAMVGLSLEAAQQQGIPVKLTKFPFKAIGKAVAMAEADGFAAIISHETTQQILGAYVVGPHAASLIAEMTLAVRNELTLPCIYETIHAHPTLAEVWAESALLATNHPLHLPPPKL

SEQ ID NO: 16074 - protein, 161 aa, Brassica napus
THASRARPGEGSIISVRTSSGEEFHGTKCIVTVGAWTSKLIKSVTGLELPVQPVHTLICYWKVRPGREQELTPEAGFPTFASYGDPYIYSTPSMEFPGLIKIAMHGGPPCDPDGRDWSTGAGDLVEPVARWIDAVMPGHVDTAGGPVVRQCCMYSVTPDDD

SEQ ID NO: 16075 - protein, 515 aa, Glycine max
MAKDREKKLYVAVLGNYAAELKLLLTTLLLLCAVATLLQFLPSRFTISASDLRVCISRVTQTTPTLSNSTNATSPPAPPLVASLSSPTTSPPPPPPPPPPPPSEQVLPDGTIKRVFNPYGSAAYNFITMGAYRGGLNTFAIIGIASKPLHVYAKPTYECAWFSLAGDNKKVSSTVGYKILPDWGYGHVYTVVIVNCTFPEPLNADNSGGKLVLFASTSGGGDASFNTTDRIEALTEQPRTLDTTLFSSKPKYDYLYCGSSLYGNLNPQRVREWIAYHVKFFGPKSHFVIHDAGGVHAQVLEVLKPWMDLGYVTLHDIRDQERFDGYYHNQFMVVNDCLHRYKFMAKWMFFFDVDEYIYVPPKSTIKSVLDSLSEYSQFTIEQMPMSSKLCLTADYGKTYRKWGFEKLVYKDSKKGIRRDRKYAVQPRSLYATGVHMSQNLAGKTTHKTEGKIMYYHYHGTIAEKRESCKMLINSTEITYDKTPYVLDTTMRDIAGVIKKFELKMIGDRVQQKTRQ

SEQ ID NO: 16076 - protein, 177 aa, Zea mays
RGPKGVTMTVLLAKAAAMALAQHPVVNSSCRDGKSFTYNSNINIAVAVAIDGGLITPVLQDADKLDIYLLSQNWKDLVKKARAKQLQPNDYNSGTFTLSNLGMFGVDRFDAILPPGQGAIMAVGASKPTVVADKDGFFSVKSKMLVNVTADHRIVYGADLAAFLQTFAKIIEDPENK

SEQ ID NO: 16077 - protein, 255 aa, Thermotoga maritima MSB8
MKEVFDLRGRVALVTGGSRGLGFGIAQGLAEAGCSVVVASRNLEEASEAAQKLTEKYGVETMAFRCDVSNYEEVKKLLEAVKEKFGKLDTVVNAAGINRRHPAEEFPLDEFRQVIEVNLFGTYYVCREAFSLLRESDNPSIINIGSLTVEEVTMPNISAYAASKGGVASLTKALAKEWGRYGIRVNVIAPGWYRTKMTEAVFSDPEKLDYMLKRIPLGRTGVPEDLKGVAVFLASEEAKYVTGQIIFVDGGWTAN

SEQ ID NO: 16078 - protein, 190 aa, Triticum aestivum
  misc_feature (162)..(162): Xaa can be any naturally occurring amino acid
KVAKQTFSGKGGVIFLFGKQAPRTLKPSPIFFGNPHLFYGFPKGAHLFHYLFLGQIGKSRGGLPEVPFRPQVPRRPASPAVSRSTPRARGAPVVPKYGKKRVYFDLEDFANTTGQWALYGRDGGSPYNGLQSKFFNPFAAPFTKRGLLLKVLLFGGGSLFAXVRAPASPDLLPIKKGPQLPPPPGPRGKI

SEQ ID NO: 16079 - protein, 391 aa, Rickettsia rickettsii
MTNNTKTITLNLGPQHPATHGVLRLILEMDGEVVNNADPHIGLLHRGTEKLIEHKTYLQAIPYFDRLDYVSPMCQEHAFALAVESLLECKVPRRAQFIRVLFSELTRILNHTLNIGSQALDIGATTPLLWLFEEREKIMEFYEHVSGSRMHSNYFRPGGVVADLPEGLLEDIDKFIEQFPPKLHDIESLLNENRLWKQRLVDIGVVSQKEAMDWGFSGPMLRGSGIAWDLRKSNPYDVYDEMDFKVPIGKNGDCYDRYFVRMLEMYESIKIIKQCIEKMPKGAIKTDDPKLTPPTRAKMKESMEAMIHHFKLYTEGYDVPAGETYKAVEAPKGEFGVYLYSRGGNRPYRCRIKAPGFAHLQGLDFMSQGHLMADVITIIATLDIVFGEIDR

SEQ ID NO: 16080 - protein, 211 aa, Pisum sativum
PDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLESRTQIFKIHTRTMNCERDIRFELLARLCPTP

SEQ ID NO: 16081 - protein, 466 aa, Coprinopsis cinerea okayama7#130
MPQRLVAHKFSSFVAFYSCSRQLGVRNFITLHSRRPYERHVPAIGRVKSLGSKRRFHASNPISAPKNPYEVLGVKKDATAADIKKAYFSLARKWHPDTNPDKDAREKFVEIQEAYDTLKDDKKRAAYDQYGSTSQQPGFDPDAFARAGFGGFGGGQFRGGFRAGGFQDFSDIFGAGMGRGGQGNIFEELFTQFGQGGRGPRASANVRGSDIETTIGIDFLDACKGTKKSVTVQPVVNCHTCSGSGLRKGAKRTTCGECGGSGQRTFVIDNGFHMATTCGACDGVGSTVGRGDQCSPCGGAGKVRVKKQVQVDIPAGVEDGMTIRVPNAGDAPITGSGPVGDLLVRIHVKPSSVFRRQGNNLYYKANIPFYSALLGGRVRVPTLNGDVDVRVPGGTQPDEEMVLKGRGVPSVYGSGSGDLFVRFSVSIPRKNVIIHIHLLQFLVFDLIFEFDLTIFILPKQIYFAKV

SEQ ID NO: 16082 - protein, 428 aa, Methanosarcina mazei
MTIVEDAKKGIITEEMKIVAKDEGLDPEFIRRGIAAGRIVIPTSPYRQVKLCGLGEGLRTKINASIGVSSDIVDDEMEVKKAIAAEKAGADTLMELGTGGDFLGIRKKVIDSISLSVGSVPLYQAFIEAARKYGSIVHMTEDELFKATEDQAKLGTNFMAIHTGVNNITLDRLKAHGRYGGLCSRGGAFMSAWMMHNEKENPLYSQFDYLVEILKEHEVVLSTGNGMRAGATHDATDRAQIQELIINTELGQRAHDAGLQVIIEGPGHIPLDQIETNVKIMKEMSGHKPFYMLGPLATDIAPGYDHIVTAIGASLSASYGCDFLCYVTPAEHLALPNIEDVITGVKTSKIAAHIGDMVKYPERARQWDLDMGRARRDLDWEKMYSLALDPEHARAVRNSRAPEDSDACTMCGNFCALKIVNQNYNLAK

SEQ ID NO: 16083 - protein, 428 aa, Methanosarcina mazei
MTLMEDAKKGVITPEIEAVAKAEGIDAEIVRSCVAKGLVAIPKNARRDTLPVGIGKYMSTKINANVGTSRDCIDIDAEIEKAKAAEAFGAHAVMDLSTGGDLDEIRTRILKAVNIPVGTVPIYQAAASRKIVVEMSSDDMFNAVRKHAEQGVDFVTVHAGVNLNSLERLRQSDRIMNVVSRGGSFTLAWMLHNGEDNPFYAEFDYLLEIAKEYDMTLSLGDGMRPGCIADASDRPKFMEFITLGELVKRSREANVQTFVEGPGHVPLNEIELSVRGMKELCDGAPLYLLGPLVTDIAPGFDHITGAIGGAVAGMHGTDFLCMVTPSEHLALPSIEDIKEGLLVTKLAAHTIDLIKEGPRERAWKQDTAMAYARRDLDWEKQFELAIDGDRARKIRDARKTESDACSMCGELCAVKIVKEAFGEKKEEE

SEQ ID NO: 16084 - protein, 136 aa, Mycobacterium avium subsp. paratuberculosis K-10
MTERTLVLIKPDGVQRQLVGEIIGRIERKGLTLVALELRHVSQDLAAQHYAEHEGKPFFASLLEFITSGPVVAAIVEGPRAIAAFRQLAGGTDPVEKAIPGTIRGDFGLETQFNLVHGSDSVESAKREIGLWFPDA

SEQ ID NO: 16085 - protein, 144 aa, Caulobacter crescentus CB15
MRRRMTTPDPDKPDAVMLFDGVCHLCDGVVRTVLRLDRHGAIRFAAIQSPAGRRLAIAHGLDPDAPESFLFLDHGQPLRKTQAVAALLRRLPAPWRQLAWIDRLPRGLTDRVYDWVAANRYRIFGKHDQCRIPTPAQRARFLID

SEQ ID NO: 16086 - protein, 259 aa, Triticum aestivum
MDITINSLTYKGSIPDAINQSRREKKLFVIYISGQDETSSSLEQSTLVDEHVAAVISRCCIFLQLKQGDVDALQFSAIYPQKSVPSISVVGLSGAMLWNHEGYISPEELKESIDKAWAALQLQETAATLLAASLASRMSEPANTASTTMPGEDGSSTSENHSNSSGQSSESSAVRGFANSTALVAQPPSSTSHAELLKTSKIPKSDSAPCNITAEEKLDSACQALLPRFSSKSNVDIPQVPNQTGSTPSPKRKNMVDGE

SEQ ID NO: 16087 - protein, 153 aa, Oryza sativa (indica cultivar-group)
MAAAAAVVNYPLVAALVAFALAQSSKFFTTWFKEKRWDARQLIASGGMPSSHSATVTALAVAIGIQEGYRSATFATSVIIACVVMHDAFGVRLHAGKQAEVLNQIVYELPEEHPLSETKPLREILGHTVPQVVAGCILGILIAVVMRLALWSS

SEQ ID NO: 16088 - protein, 325 aa, Oryza sativa (japonica cultivar-group)
MAMERLISSPLLPRRPPRAAFSRPPPSLAAAPPHHRAGGAASGYGSRPPLASLLLSRHHHHHQPPVLAANPAADVAAGEAVPPATATASRRFLQKVASAAAATLLATIALTLIQPAWAPPALASFHSAAKAGGGIFKSELLSSAWTGFLAGCLHTLSGPDHLAALAPLSIGRSRVESAAVGALWGCGHDAGQVIFGLLFLSLKDRLHIEVIRTWGTRVVGLTLLVIGALGIREATRGAHAPDALMMVLPALALPSRVAGAAFLGMFLVGTVVAMGSYTVLIGSCTEALKERVPRITEKLTWAASLVAISMGLGILISQSLGFSLY

SEQ ID NO: 16089 - protein, 212 aa, Triticum aestivum
MNPFAKKPTPREAIRNSKRELTNATRGIERDIGTLQQEEKRLVAEIKRTAKTGNEAATKILARQLIRLRQKISTLQGSRAQIRGIATHTQAMQANTSVSAGMQSASKAMGAMNKQMDPAKQMKVMQEFQKQSAQMDMTNEMMSDSIDNVLDDDQAEDETEELANQVLDEIGVDVASQLSPAPKGRIAGKKVQADESSELEELKQRLAALKNP

SEQ ID NO: 16090 - protein, 125 aa, Glycine max
ACSMISSPSVTTVNRACAGMFAPFTGLNSIAGFPIMNTNTDITSIASNGGRVQCMQVWPPVCKKKCETLSYLPDLDDAQSAYEVQHHLMNGWITCLECQLEHCFVYRVHYMSPVYYDGLYWTIWN

SEQ ID NO: 16091 - protein, 420 aa, Pyrococcus furiosus DSM 3638
MVEQDPYEIVIKQLERAAQYMEISEEALEFLKRPQRIVEVTIPVEMDDGSVKVFTGFRVQHNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYETISRRKTPAFGIITGKPLSIGGSLGRIEATARGASYTIREAAKVLGWDTLKGKTIAIQGYGNAGYYLAKIMSEDFGMKVVAVSDSKGGIYNPDGLNADEVLKWKNEHGSVKDFPGATNITNEELLELEVDVLAPAAIEEVITKKNADNIKAKIVAEVANGPVTPEADEILFEKGILQIPDFLCNAGGVTVSYFEWVQNITGYYWTIEEVRERLDKKMTKAFYDVYNIAKEKNIHMRDAAYVVAVQRVYQAMLDRGWVKH

SEQ ID NO: 16092 - protein, 429 aa, Shigella flexneri 2a str. 2457T
MTRRAIGVSERPPLLQTIPLSLQHLFAMFGATVLVPVLFHINPATVLLFNGIGTLLYLFICKGKIPAYLGSSFAFISPVLLLLPLGYEVALGGFIMCGVLFCLVSFIVKKAGTGWLDVLFPPAAMGAIVAVIGLELAGVAAGMAGLLPAEGQTPNSKTIIISITTLAVTVLGSVLFRGFLAIIPILIGVLVGYALSFAMGIVDTTPIINAHWFALPTLYTPRFEWFAILTILPAALVVIAEHVGHLVVTANIVKKDLLRDPGLHRSMFANGLSTVISGFFGSTPNTTYGENIGVMAITRVYSTWVIGGAAIFAILLSCVGKLAAAIQMIPLPVMGGVSLLLYGVIGASGIRVLIESKVDYNKAQNLILTSVILIIGVSGAKVNIGAAELKGMALATIVGIGLSLIFKLISVLRPEEVVLDAEDADITDK

SEQ ID NO: 16093 - protein, 216 aa, Streptomyces avermitilis MA-4680
MAPIPGSGLAKGLAVTLRTMTKKTVTAQYPDAQPELPPRSRGVIGLFEENCTVCMLCARECPDWCIYIDSHKETVPPAAPGGRERSRNVLDRFAIDFSLCMYCGICIEVCPFDALFWSPEFEYAETDIHELTHERDKLREWMWTVPAPPALDPAAEEPKEIAAARKTAEKLAAAQAAAAQTDAAQAEAAQAEAAAEAGSAAEGAPDAAPKPQEGEA

SEQ ID NO: 16094 - protein, 250 aa, Brassica napus
  misc_feature (149)..(150): Xaa can be any naturally occurring amino acid
  misc_feature (157)..(157): Xaa can be any naturally occurring amino acid
  misc_feature (159)..(159): Xaa can be any naturally occurring amino acid
  misc_feature (164)..(164): Xaa can be any naturally occurring amino acid
  misc_feature (176)..(176): Xaa can be any naturally occurring amino acid
  misc_feature (186)..(186): Xaa can be any naturally occurring amino acid
  misc_feature (189)..(189): Xaa can be any naturally occurring amino acid
  misc_feature (195)..(195): Xaa can be any naturally occurring amino acid
  misc_feature (208)..(208): Xaa can be any naturally occurring amino acid
  misc_feature (210)..(210): Xaa can be any naturally occurring amino acid
  misc_feature (222)..(222): Xaa can be any naturally occurring amino acid
MRTMVDLGKHHHHMQLITTPTTVDCARELRHRRTLRSLIECILPYCCTYQQPSPSCQNDTVSVSSSSSSSSSSDHSSSSSSSSSSSRSNSIISGTFFGHRRGRVSFCLQDTAVGSPPLLLLELAVPTAKLAKEMDQAGVLRIALECDRXXSSNSGPXSXFDVPXWSMYCNGRKMGXAVRRKVTENXAVXLRMMQXVSVGAGVVPVDKXEXTLYLRARFERVXGSSDSESFHMMNPGGSYGQELSIFLLRS

SEQ ID NO: 16095 - protein, 157 aa, Pyrococcus horikoshii
MSETERTLVIIKPDAVVRGLIGEIISRFEKKGLKIVGMKMIWIDRELAEKHYEEHREKPFFKALIDYITKTPVVVMVLEGRYAVEVVRKMAGATDPKDAAPGTIRGDFGLEVSDAICNVIHASDSKESAEREISLFFKPEELFEYPRAADWFYKKGI

SEQ ID NO: 16096 - protein, 317 aa, Oenococcus oeni PSU-1
MAYYEIARDIFAKESAELANVAKRLDDKFDKLVDLINDTNGRIVFIGIGKSQIIAEKISASLSSVSIHSFTVDAGTAYHGDLGRISDDDLLIFVSNSGETQEVVQTLFALQTIYPKGLKTVSLTGNLDSTLATNTGLAFDLGVSKEADTTGLAPTSSTTATLVFGDALLAAMEKSISFNRNQFALYHPGGTIGKLLLQRVKHVMHEKVPYVNEDTPINEVIYQISDYGIGMTLVKDKDSGKAIGIVTDGDIRKKFLSVQSVKKSVASDYMTKGFVSINQEKRNRTAWQLMANHGISNLVVIDNDEKVVGVVTIHDVL

SEQ ID NO: 16097 - protein, 205 aa, Rhodobacter sphaeroides
MDPCAWGSAARWAPARRPSTEKLCAALAHRCSMAVITNDIYTREDAEALMRAQVLPAERIRGVETGAAPYTAIREDASINLAAVADLRRTFPDLDLILIESGGDNLAATFSPELADLTIYVIDTAAGQDIPRKRGPGLARSDLLVVNKIDLAPHVGVDLARLEADTQAARGQRPYVMARMRAGVGVEAIVAFLEREGGLQLLPQD

SEQ ID NO: 16098 - protein, 554 aa, Salmonella enterica subsp. enterica serovar Typhi str. CT18
MCSIFGVFDIKTDAAELRKKALELSRLMRHRGPDWSGIYACDNAILAHERLSIVDVNAGAQPLYNAKKTHVLAVNGEIYNHQTLRAEYGDRYAFQTGSDCEVILALYQEKGPDFLDDLQGMFAFALYDSEKDAYLIGRDHIGIIPLYMGYDEFGNFYVASEMKALTPVCRTIKEFPAGSYLWSKDGEIRQYYQRDWFDYDAVKDNVTDKNALRQALEESVKSHLMSDVPYGVLLSGGLDSSVISAITKKFAARRVEDQERSEAWWPQLHSFAVGLEGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLQALHMYDCTRANKAMSAWGVEARVPFLDKKFLDVAMRINPQDKMCGNGKMEKHVLRECFESYLPASVAWRQKEQFSDGVGYSWIDTLKEVAAKQISDQQLETARFRFPYNTPSSKEAYLYREIFEELFPVPSAAECVPGGPSVACSSAKAIEWDEAFKTMDDPSGRAVGVHQSAYQ

SEQ ID NO: 16099 - protein, 156 aa, Oryza sativa
ATRALWPHAFAAEMSVSIGGGRLDMELEVSNTGDTAFSFTAALHTYLKVREVESLRIEGLRGLEYRDSADGNTLKKETGVGVMIDDEVDRIYHGAPPTILVREDHRALGIHNENFPDVVVWNPWEHKCAQLADMPADEIRRMLCVEAAAVKTTIEL

SEQ ID NO: 16100 - protein, 419 aa, Mycobacterium avium subsp. paratuberculosis K-10
MTATPREFDIVLYGATGFVGKLTAEYLAGAAPDKRVALAGRSTEKLRAVRDSLGDAAQSWPVLQADASSPATLNEMAARTQVVITTVGPYTRYGLPLVAACAAAGTDYADLTGEAMFVRDSIDSYHKQAADTGARIVHACGFDSVPSDLSVYALYRAARDDGAGELVDTDLVVRSFSGGVSGGTVASMLEVLDTASRDPEARRQLADPYTLSSDRGAEPDVGPQPDLPWRRGRQIAPELAGVWTAGFVMAPYNTRIVRRSNALLDWAYGRSLRYSESMSLGSSPLAPVASAVVGGTAAATFGLGSRYFRFLPRRLVERIVPKPGTGPSPAARERGYYRIETYTTTTSGARYVARMEQRGDPGYKATSVLLGESGLALAFDRDKLPQLYGVLTPAAAMGDALLDRFPGAGVFLQVDRLAG

SEQ ID NO: 16101 - protein, 445 aa, Cryptococcus neoformans var. neoformans JEC21
MSFQSVRASQIFDSRGNPTVEVVVETLQGRFVAGVPSGASTGSHEAVELRDKGDAYGGKGVSKAVKAVNEVLGPALIQSGIKASEQAKIDQLLIQLDGTDNKSKYGANAILGISMAAARAGAAEKGLELFEHLADLTFPQRDKAKPYVLPVPCTNQLNGGVHAGNQLAPQEFMVLPTGATSFEEAMRIVTECYHSLKSVITEKFGLAGTGIGDEGGFAPPVDSIDQALDLLVEASAKAGHSNNVHFAIDPASSEFFKDGVYDLDFKSTDQLETHRCLSPDQMASLYNDLISKYPLILLEDPFAEDDWDSWTKFMEKINGRIEVVGDDLLCTQVSRVKMAKKASACDGLLLKINQCGTISEAIEAAQTAYSYGWSVFVSHRSGETIDDFIGDIVVGLQTGHIKSGAPCRGERLAKYNRLLQIERLLKERGHPVRYAGVDFRRAATW

SEQ ID NO: 16102 - protein, 256 aa, Coprinopsis cinerea okayama7#130
MCQEVKPRNLWKLTHISYFLLKATSAAPFHEPTSPNPTATTYAATTEALHTYGSYLTQCLPKFIQQFSVLKDELTLYIAPSAVVPVLTFLRDHTQCQFKAVMDISGVDFPEREKRFEVVYHLLSIRHAGRIRVKTYAGEADPVPSAVEVFRGADWYEREAWDMYGIYFENHPDLRRILTDYGFEGHPLRKDFPLTGYTELRYDEEKKRVVYEPLQLTQAFRNFESLSPWEQIGDGTKGRRPEELKHVPPPPAEEKK

SEQ ID NO: 16103 - protein, 1094 aa, Francisella tularensis subsp. holarctica
MPKITDIKSILVLGAGPIVIGQACEFDYSGTQACKVLKEDGYTVFLVNSNPATIMTDPTTADKIFIEPITVESVGKIIARERPDAILPTVGGQTALNCALALDKAGILEKYNVEMLGAKADSIDKAENRERFNKAMAKIGLEVPRNVVVQSMEQAYKALEDIGLPAIIRPSFTLGGSGGGIAYTKEEFEKIVKNGLSLSPTNEVLIDESILGWKEYEMEVIRDKADNSIIVCSIENIDPMGIHTGDSITVAPALTLTDKEYQIMRDASIAVLREIGVETGGSNVQFAVNPKDGKLVVIEMNPRVSRSSALASKATGYPIAKVAARLAVGYTLDEIDNDITKVTPASFEPTIDYIVTKIPRFTFEKFPTTPSNLSSQMKSVGEAMAIGRSFIESLQKALVSLETGLTGLDQVEIPGVDESKSLKENKTAILKSLEELSPMRILRVAQALRYGISQQEIHDACKIDPWFIEQIAIIIDAEERLKKTGLPNSKEEFSVYKNLGFSDAKIAELVGRTERYIRNFRFGKEIYPTFKRVDTCAAEFESQSSYLYSTYEHYSYEEIVRDCESEISDKKKVIILGGGPNRIGQGIEFDYACVHAAKSLKEEGIETIMINCNPETVSTDYDTSDKLYFEPLMAENVLNIIKNEMRKGEVLGVIVQFGGQTPLKLVSALHENNIPILGTDPDKIDLAEDRERFKELLDKVGLKQPLNTIAYTINELKKKIVNVGYPVVVRPSNVLGGRAMEIIHSQEELDAYIKTNSKCILEGPILIDKFLEDATELDVDALADGGERVFVAGIMEHIEEAGIHSGDSACYIPTRSLSNEQIEEVKQATIKLARELNVIGLMNVQFAYQNGQLYVIEVNPRASRTVPFVAKATGNSIANIATKLMLGKKLSEFILNNPIPRHFSVKEAVFPFGRFADVDCYLGPEMKSTGEAMGIDRTFGVAFYKAQEMSFNKLPLKGNILISVSNADKPKIIEPVKELIELGFNIFATKGTERFLKENGIECKLFDKASDNIGNDQVHSTVKAIEAGEVDLLVNTSIRQELKISLALRRAAIMSRVSYVTTIGAFEAFVIAVRDMRKINNDFDVKTVKEWINS

SEQ ID NO: 16104 - protein, 978 aa, Coccidioides immitis RS
MDQGPVKRPPPSAIPRLSRLPLPTAAAPKLVRPSPSRERLQADQGLNVSRLRRPSEDVFKKPHLPPPSSRKVSDNFYAQRRSSQYGHSIRTAASAESLASKRNSELCLTEIGPSLEERTIETLSQIPSSPSPSRRQSGFFRPSSPMRSPSRPTSEISQHPVPQITSPTKQFRPRASLSTDPSRPKPRAASSAPSSRKASENSRKEDPPVPLPKQDVVSPRMPPNGEKRNAVLRSSKSRQSLAQTYSETNGSAPAKDTPKSKQPKPRKPPSTLSSNITSPTSSVSKTSQRTSVTSESNCSEPPRKVPEAKKASKSSSALRESIAKAKAARKAARQSNANDAFADPFNSISMKDPFNQLQNETSDKALLKSRTRAARKSGHLNIAALGLKEIPHEVMTMYDYDPESTDDWYEAVDLVKFIAADNEFESLSEDAFPDVDVTSLQMDEGCKGNQFGGLEALDLHGNLLASLPIGLRRLQRLRSLNLAKNRLNMDAIEVITQIGNLTELRLGNNDLDGMFTPQLGSLQKLEVLDLRGNALTGLPDNLSDLTGLRVLNVAENQLTSLPFSALSKLPLVEINAQKNRLQGCLVPASIRRIEGLQILNVSGNSLEGLSAGDVLELPSLQQLFADANRIKALPNVSSWTSLLSLIIEDNDLCEIPEGLSELTNLKHADFKGNSITTLNDRIGLMENLMTFHIGNNPLRERKFLSMDTENLKRELCTRCAPEVQEGEDGEESDHTEFTLAPERPETSHGWRVKSGGVLDRSSTDLSRLEVEDLEPLVSSSDIRCLYLKHNRFDRLPLSAISFLSHSLTDIDLSHNPMNGEDLFTSPIALPHLQNLTLAATGLTSFEPLQSFLSAPSLMFLDVSNNRLRGALPTLRSTYPKLITFLASENQINSLSFEAVEGLQALDVSNNNIDFLPPRLGLLGVEESGGLRRLDVSGNSFRVPKWQIVAKGTEAVLDWLKNRLTPEELREWQGDTDNM

SEQ ID NO: 16105 - protein, 286 aa, Synechococcus sp. CC9311
MAMTLRQLSTPYAHWEYVHPQSGDRLRVVPERGGIVTEWLCNGREILYFDQSRYADPTQSIRGGIPVLFPICGNLPGDRLPLKSGEATLKQHGFARGLPWQLELLDDQSGVRLCLTDTDETLAHYPFRFRLEMAVRPVSDALEITTTIANANEGGELMPFSFGLHPYFNVTDLSRTSIEGLAPQCLNHLVMAEAETRDQLSRLPEGVDFLTRPAGPVTLVDEAAGTRLQLQHQAPMDLTVVWTEPPRSMVCLEPWTGPRQSLITGDGKLELAPGDSLQLSCRYALS

SEQ ID NO: 16106 - protein, 960 aa, Pseudomonas putida GB-1
MINFFDPASDKNSDLGTPARDSDVQVSLSIDGRAISVPAGTSVMRAAAMLGTSIPKLCATDSLEAFGSCRMCMVEIEGMRGYPASCTTPVSEGMVVRTETPRLAGLRRNVMELYISDHPLDCLTCSANGNCELQTVAGQVGLREVRYGYDGANHLAEKKDVSNPYFDYEPSKCIVCSRCVRACEDIQGTFALTITGRGFESRVAAAGGDDFLTSECVSCGACVQACPTATLTEKSLVQLGQPERSVITTCAYCGVGCSFRAEMKGDQLVRMVPDKNGGANHGHACVKGRFAWGYATHPDRITKPMIRKRLEDPWQEVSWDEAVTYAASEFRRIQLKYGRDAIGGITSSRCTNEEAYLVQKLVRTAFGNNNVDTCARVCHSPTGYGLKQTLGESAGTQSFDSVMQADVVLVIGANPTDAHPVFGSQLKRRLRQGARLIVIDPRRIDLVDSPHARAELHLQLRPGTNVAMLNALAHVIVTEGLLAQRFIDARCETEDFARWRDFVSLADNAPEVLGPVCGVPAEQIRAAARLYATGGNAAIYYGLGVTEHSQGSTAVMGIANLAMATGNIGREGVGVNPLRGQNNVQGSCDMGSFPHELPGYRHISNEGVRAEFERAWGVTLQPDPGLRIPNMFEAALDGSFKALYCQGEDIAQSDPNTQHVTAALHAMECVVVQDIFLNETAKFAHVFLPGSSFLEKDGTFTNAERRISRVRKVMEPLAGKADWEATVALANALGYPMNYRHPSEIMDEIARLTPTFRRVSYAEIDRHGSLQWPCNDAAPDGTPTMHIDQFVRGKGRFMLTGYVPTDEKVNNRYPLLLTTGRILSQYNVGAQTRRTGNVAWHDADRLEIHPTDAESRGIQDGDWVGIGSRAGQTVLRAKVSARVAPGVVYTTFHFPESGANVITTDNSDWATNCPEYKVTAVEVVKVFQPSQWQKRYQDFSDEQRRLLIERRTAEKAEVRR

SEQ ID NO: 16107 - protein, 325 aa, Bacillus subtilis subsp. subtilis str. 168
MAQMTMIQAITDALRTELKNDENVLVFGEDVGVNGGVFRATEGLQKEFGEDRVFDTPLAESGIGGLALGLGLNGFRPVMEIQFFGFVYEVMDSVSGQMARMRYRSGGRWTSPVTIRSPFGGGVHTPELHADSLEGLVAQQPGIKVVIPSTPYDAKGLLISAIRDNDPVVFLEHMKLYRSFRQEVPEEEYTIELGKADVKREGTDLSIITYGAMVHESLKAADELEKDGISAEVVDLRTVSPLDIDTIIASVEKTGRAIVVQEAQKQAGIAANVVAEINDRAILSLEAPVLRVAAPDTVFPFSQAESVWLPNHKDVLETARKVLEF

SEQ ID NO: 16108 - protein, 422 aa, Streptomyces avermitilis MA-4680
MTQSGAGPSGGFGLRRTLGVGDAVVVGLGSMVGAGIFAALGPAARAAGSGLLLGLAVAAVVAYCNAMSSARLAALYPASGGTYVYGRERLGAFWGYLAGWAFIVGKTASCAAMALTVGAYVWPGQAHAVAVAAVVALTAVNYGGMQKSALLTRAIVAVVLAVLASVVVVCLGSGAADAGRLAVGLSGGAGGVLQAAGLLFFAFAGYARIATLGEEVRDPERTIPRAIPLALGIALVVYAAVAVGVLSVLGADALGHAPAPLADAVRAAGVPGLVPVVRVGAAVAALGSLLALILGVSRTTLAMARDRQLPGALAAVHPRFQVPHRAELAVGAVVAALAATVDVRGAIGFSSFGVLAYYAVANASAWTLSSAPASRAVPAVGLLGCVTLAFALPAVSVGVGAAVLGLGAAAYGMRRWGASRRP

SEQ ID NO: 16109 - protein, 470 aa, Bacillus subtilis subsp. subtilis str. 168
MVVGDFPIETDTLVIGAGPGGYVAAIRAAQLGQKVTVVEKATLGGVCLNVGCIPSKALINAGHRYENAKHSDDMGITAENVTVDFTKVQEWKASVVNKLTGGVAGLLKGNKVDVVKGEAYFVDSNSVRVMDENSAQTYTFKNAIIATGSRPIELPNFKYSERVLNSTGALALKEIPKKLVVIGGGYIGTELGTAYANFGTELVILEGGDEILPGFEKQMSSLVTRRLKKKGNVEIHTNAMAKGVEERPDGVTVTFEVKGEEKTVDADYVLITVGRRPNTDELGLEQVGIEMTDRGIVKTDKQCRTNVPNIYAIGDIIEGPPLAHKASYEGKIAAEAIAGEPAEIDYLGIPAVVFSEPELASVGYTEAQAKEEGLDIVAAKFPFAANGRALSLNETDGFMKLITRKEDGLVIGAQIAGASASDMISELSLAIEGGMTAEDIAMTIHAHPTLGEITMEAAEVAIGSPIHIVK

SEQ ID NO: 16110 - protein, 453 aa, Bacillus halodurans C-125
MPTNTMPTGPKGNPVLGNTIEFGKDPLQFITRCSQEYGEIVRLRFERERDTFLLNDPKHIQYVFMNKGGEFSKGYQQDPIMGLVFGNGLLTSEGSFWLRQRRLSQPAFHPKRIADYADTMVGYCERMLNTWMDNDTRDINDEMMQLTMAIATKTLFDLDLHKGDTQEASRSLDTVMTAFNEQMTNVFRHVLHLIGLGKLVPPVSRELREAVESLDKMIYSIIEERRKHPGDRGDLLSMLISTYDEDDGSYMTDRQLRDEIITLFLAGHETTANTLSWAFYLLSQHPHVEEKLYQEVSQVLGNRPATLEDMPKLSYAEHVIKETLRVQPTVWLISRRAEKDVTLGDYHISAGSEIMISQWGMHRNPRYFNDPLTFLPERWDNNDNKPSKYVYFPFGGGPRVCIGERFALMEATLIMATIVREFRMELVDELPIKMEPSITLRPKHGVTMKLRKR

SEQ ID NO: 16111 - protein, 213 aa, Triticum aestivum
  misc_feature (49)..(49): Xaa can be any naturally occurring amino acid
  misc_feature (70)..(70): Xaa can be any naturally occurring amino acid
  misc_feature (91)..(92): Xaa can be any naturally occurring amino acid
PKALFLGLEKKKHPGNLPGTKTFTQKNLAARLTLRVSTNIHPGKFQGWXNPPAAGRGGAQLKKVQGPISXKVQFQISGGQFLFDLIGPVRXXIFRKELPVVLKAFVHGDASLFTQHPELEEPTVWFYFHSNNPNFNRVECWAPLRDAAAPYDDENADAAVPPTATAADEKAMGSGQRPRRCPGQCDCCFPPECLIPWPHEIEMAADAGQAPPQ

SEQ ID NO: 16112 - protein, 340 aa, Lactococcus lactis subsp. lactis Il1403
MKRIAVLTSGGDAPGMNAAIRAVVRKAISEGIEVYGINHGYAGMVAGDIFPLTSASVGDKIGRGGTFLYSARYPEFAQVEGQLAGIEQLKKFGIEGVVVIGGDGSYHGAMRLTEHGFPAVGLPGTIDNDIVGTDFTIGFDTAVSTVVDALDKIRDTSSSHNRTFVVEVMGRNAGDIALNAGIAAGADDICIPEKEFKFENVVNNINKGYEKGKNHHIIVLAEGVMTGEEFATKLKEAGYKGDLRVSVLGHIQRGGSPTARDRVLASRMGARAVELLRDGIGGVAVGIRNEELVESPILGTAEEGALFSLTTEGGIKVNNPHKAGLELYRLNSALNNLNLN

SEQ ID NO: 16113 - protein, 126 aa, Sulfitobacter sp. EE-36
MAYSYDDQNIFAKILRGEIPNNTVYESDHALAFRDIEPQAPTHVLVIPKGPYISFDHFAAEASDAEIVGYVRAISEVCKAEGVTLDAGEGFRMIANAGAHGVQEVPHLHVHILGGRPMGRMVARPS

SEQ ID NO: 16114 - protein, 356 aa, Arabidopsis thaliana
  misc_feature (1)..(1): Xaa can be any naturally occurring amino acid
  misc_feature (80)..(80): Xaa can be any naturally occurring amino acid
  misc_feature (92)..(92): Xaa can be any naturally occurring amino acid
  misc_feature (212)..(212): Xaa can be any naturally occurring amino acid
  misc_feature (245)..(245): Xaa can be any naturally occurring amino acid
  misc_feature (269)..(269): Xaa can be any naturally occurring amino acid
  misc_feature (320)..(320): Xaa can be any naturally occurring amino acid
XVAVERVESLAKSGIISIPKEYIRPKEELESINDVFLEEKKEDGPQVPTIDLKNIESDDEKIRENCIEELKKASLDWGVXHLINHGIPADLXERVKKAGEEFFSLSVEEKEKYANDQATGKIQGYGSKLANNASGQLEWEDYFFHLAYPEEKRDLSIWPKTPSDYIEATSEYAKCLRLLATKVFKALSVGLGLEPDRLEKEVGGLEELLLQXKINYYPKCPQPELALGVEAHTDVSALTFILHNXVPGLQLFYEGKWVTAKCVPDSIVXHIGDTLEILSNGKYKSILHRGLVNKEKVRISWAVFCEPPKDKIVLKPLPEXVSVESPAKFPPRTFAQHIEHKLFGKEQEELVSEKND

SEQ ID NO: 16115 - protein, 424 aa, Chlamydophila abortus S26/3
MLEVVISDIQAREILDSRGYPTLYVKVITNTGTFGEACVPSGASTGIKEALELRDQDTSRYQGKGVLQALKNVKEVLLPVLQGVSIFDQILIDSIMVEADGTPNKEKLGANAILGVSLAAAKAAAATLGRSFYRYVGGCFAHILPCPMMNLINGGMHANNGLQFQEFMIRPIGAHSLQEAVRMGADVFHTLKNLLNDKHLATGVGDEGGFAPQLKSNSEALDLLVLAIEKAGFQPGEEISLALDCAASSFYDTKTETYAGKNSQEQVGILADLCDRYPIDSIEDGLAEEDFDGWELLTAELGENIQIVGDDLFVTNPELIAEGISKGLANAVLIKPNQIGTLTETSEAIQLAHSQGYTTILSHRSGETEDTTIADLAVAFNTGQIKTGSLSRSERIAKYNRLMAIEEELGSEGLFKDSNPFSGE

SEQ ID NO: 16116 - protein, 439 aa, Pyrococcus furiosus DSM 3638
MNISVSMNKFDSKIKFVQLVFVDINGMPKGMEIPASRLEEAVTDGISFDGSSVPGFQGIEDSDLVFKADPDTYVEVPWDNVARVYGFIYKDNKPYGADPRGILKRALEELEKEGYKAYIGPEPEFYLFKKNGTWELEIPDVGGYFDILTLDKARDIRREIAEYMPSFGLIPEVLHHEVGKAQHEIDFRYDEALKTADNIVSFGYITKAVAEMHGLYATFMPKPLFGFPGNGLHLHISLWKDGENVFMGEEGLSEIALHFIGGILKHAKALTAVTNPTVNSYKRLVPSYEAPVYISWGYRNRSALIRVPAFWGKGARIEYRCPDPSANPYFAFAAVLKAGLDGIKHKIDPFSYVEENVYEMSEEKRKELGLETLPGNLGEALGELEKDKVVKEALGDSYKNFINYKWKEWESYLEYLEEKHIPPDTEKVTEWELERYFFL

SEQ ID NO: 16117 - protein, 128 aa, Burkholderia xenovorans LB400
MNLIAKLEQEEIARALGEKTIPEFAPGDTVIVSVNVVEGTRKRVQAYEGVVIAKRNRGLNSSFIVRKISSGEGVERTFQTYSPLLASIVVKRRGDVRRAKLYYLRDRSGKSARIKEKLVSKGRAASQA

SEQ ID NO: 16118 - protein, 720 aa, Cryptococcus neoformans var. neoformans JEC21
MTATRNTNGHGELNREAHTTNKVVSEKEEQLVLNTIRCLAADLCQQYKGGHPGTVMGASAIGIALWRYEMRYNPLNPDWFNRDRFVLSAGHACLFQYIFLHLSGYEAWTLDQIKMYHSPATSGSMAAGHPEIEYPGIEVTTGPLGQGISNAVGMAIASKQLAATYNREGLDIVDNKIWCFTGDGCLQEGVGQEAISLAGHLGLDNLILVYDNNAVTVDGRIDNCFTENTSKKLQAQGWNVIDVYDGSNDLAAILEGFDKAKQFKGKPSLVNIRTVIGYSSRKANTGPAHGQALGDDEVAYVKTQLGFDPAQKFVIPDKAYEYFAECKIKGAKANEEWNEKFEAYSKAYPDLYKQLTDRMNGRFAPDGWETLLPAKKDLPQGDQPTRKSSGIAVQTLVPKNNTFIAGSADLLESTFVNFDGQVEFQNPSSGLGDYTGRQIRFGIREFAMVGLGNGMAAYHKGMFIPIMSTFFMFWIYAAPAARMAALQHLRFIGVATHDSIGIGEDGPTHQPIALAAFYRALPNINLIRPADAEECMGMWLLALSDQSANTPSIFALSRQPVPLLSGTDRTKVAQGAYIVYGDDRSPDMTIIATGAEVARAIESAKLLKSVKKVRVVSMPSQKHFDIQTAEYKELVLKSSTALVVAIEAWASYGWARYAHASLSMQTFGHSAPQQQLYEHFGFSPKAMAEKIDEWAARWQTKGGRPGLGDFEELLLRYTQH

SEQ ID NO: 16119 - protein, 141 aa, Brassica napus
GAGKAVAYGAKVKGAKVVIANRTYERALEVAEAIGGRAVSLADLENFHPEDGMVLANTTSVGMQPNVGETPISKHALKHYALVFDAVYTPRVTRLLREAEECGAVTVSGSEMFVRQAYEQFEIFTGLPAPKELYWKVMSKY

SEQ ID NO: 16120 - protein, 330 aa, Ostreococcus tauri
MEASDSEDDGVANAPTLHVASVIHHGCVNRVRAMPQTPTVAATWSDSGHVMVWDLKVQMLKVMSATNDTKGQLEAPARVTPSQVFTGHKDEGYALDWSPATEGRLASGDCAGAIHMWEPIAGKWDVGATPYTGHTSSVEDIQWSPTERDVFMSCSADQTVCVWDVRQRAKPAMRVKTHDSDVNVMSWNRLANCMVATGADDGSLRIWDLRNFSETNPQFIANFTFHRDAVTSVDWAPFDSAMLASSSADNTVCVWDLAVERDAEEEAAALAARDNALPPEDLPAQLMFVHQGLKDPKEIKWHKQIPGMCVTTAFDGFNIFKAYNVGPAVA

SEQ ID NO: 16121 - protein, 293 aa, Thermotoga maritima MSB8
MEIKKGTWIIKKGFAEMFKGGVIMDVTSAEQAKIAEEAGAVAVMALERVPADIRKEGGVARMASIAKIREIMEAVSIPVMAKVRIGHIAEAKILEELGVDFIDESEVLTPADDRFHINKHEFKVPFVCGARDLGEALRRIAEGAAMIRTKGEAGTGNVVEAVKHMRRVMEQIKQVTKMEDEELVAYGKEIGAPVELLREVKRLGRLPVVNFAAGGVATPADAALMMMLGADGVFVGSGIFKSKDPRKMAKAMVLAVTYWDNPRILLKISEDIGEPMRGLDVEELEVRMQERGW

SEQ ID NO: 16122 - protein, 328 aa, Glycine max
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLDEMEGPLEVGADGTLKFEEKDGIDYAAVTVQLPGGERVPFLFTVKQLVATGKPESFSGPFLVPSYRGSSFLDPKGRGGSTGYDNAVALPAGGRGDEEELAKENVKNASSSTGNITLSVTKSKPETGEVIGVFESVQPSDTDLGAKAPKDVKIQGVWYAQLESN

SEQ ID NO: 16123 - protein, 402 aa, Staphylococcus epidermidis ATCC 12228
MAQDRKKVLVLGAGYAGLQTVTKLQKELSADAAEITLINKNEYHYESTWLHEASAGTINYEDLLYPVEKTVNKNKVNFVVAEVTKIDRNAKRVETDKGVYDFDILVVALGFVSETFGIDGMKEHAFQIENVLTSRKLSRHIEDKFANYAASKEKDDKDLSILVGGAGFTGIEFLGELTDRIPELCSKYGVDQSKVKLTCVEAAPKMLPMFSDDLVSYAVKYLEDRGVEFKIATPIVACNEKGFVVEVNGEKQQLEAGTSVWTAGVRGSHLMEESFEGVKRGRIINKQDLTIEGHNDIFVIGDCSAFIPADEERPLPTTAQIAMQQGEHTASNIKRLLNGESTQDFQYVNRGTVCSLGANDGVGIVYGRDIAGKKAAFLKKVIDTRAIYKLGGIGLAFKKGKF

SEQ ID NO: 16124 - protein, 319 aa, Lactococcus lactis subsp. lactis Il1403
MDLKNNFWKDYPELEKELVQVQQLMKSHVTIKNSDVKSAIFDIFDAGGKMLRPAYLLLFSGFTDLSESERLALAASVEMMHTATLVHDDVIDHADTRRGVATLSAKYGPEIAVYAGDYLFIAVFRLMSEHSLELSNLTKNIGSIERLLGGELGQLNHHFNLQQTLDDYIENISGKTGELFALSASVAPLISKNNTLTKRAYKIGMNIGISFQIMDDYLDYASTAQTLGKPVLEDIKQGIYSAPVLFALQENNALVSELIKNEKFDEVYDFIKTSDALEKTKALAKSYTLSALNLIDKLPKGKNRELIAEITRKLLERTL

SEQ ID NO: 16125 - protein, 605 aa, Sulfitobacter sp. EE-36
MDMRNIAIIAHVDHGKTTLVDELLKQSGTYRENQATTERAMDSNDLERERGITIFAKPTSVVWNNTRINIVDTPGHADFGGEVERILSMVDGVVLLVDAAEGPMPQTKFVTSKALKLGLRPIVVLNKVDKADAEPDRALDECFDLFASLDATDEQLEFPHMYASGRSGWADAELDGPRKDLSALFELVLKHVPAPKQIENADKPFTMLATTLGGDPFLGRLLTGRVETGTLKAGQSIKAMSRDGKLIENFRCTKILAFRGLEQTAIDVAEAGDIVSIAGMSKATVADTLADTSVNEAIPAQPIDPPTITVTFGINDSPLAGRDGKKVQSRVIRERLMKEAESNVAIKISDTPGGDAFEVAGRGELQMGVLIENMRREGFELSISRPQVLFQEIDGVRHEPIEEATIDVDDEYSGAVIEKITGTRKGELVEMKPAGAGKTRIIAHVPSRGLIGYHGEFLTDTRGTGVINRVFHSWAPHKGTIPGRRAGVLISMENGTSVAFALWNLEERGKMMIGAQADVYTGMIIGEHSRENDLEVNPLKGKKLTNVRASGTDEAVRLTTPMTLSLEEAIAYIDDDELVEVTPNAIRLRKRYLDPHERKRMAKSA

SEQ ID NO: 16126 - protein, 378 aa, Glycine max
MGCNSSKAEPPPLENTMHHHHHADVAEFQKPKTLKEEVVLQIPGCKVHLMDQGEALELAQGHFTIMKIMEQNVALATIIKVGNSVQWPLTKDEPVVKVDALHYLFSLPVKDGGEPLSYGVTFPEQCYGNMEMLDSFLKDHSCFSGLERNKKSDLKWEEFAPRVEDYNHFLARAIAGGTGQIVKGIFLCSNAYTNQVQKGGETILNTAAEKNNGGMVTESMNHRSDATKNNATNDNLKRVRKLTNMTEKLTKSLLDGVGIMSGSVMTPVLKSQPGQAFLNMLPGEVLLASLDAVNRVFEAAEAAEKQTFSATSQAATRMVSNRFGEEAGEATEHVFATAGHAVNTAWNVSKIRKAINPASSANAAGALRNSAKNRNVIY

SEQ ID NO: 16127 - protein, 636 aa, Oryza sativa (indica cultivar-group)
MGRKIKVKKKKASSKVWQPGVDTLEEGEELQFDPQAYNYLRGFNIGWPCLSFDVVRDQLGLVRSEFPHTLYGVAGTQAERASWNYIGIFKICNINGKKREPIPASAIDGDSDMDSESSSDEEDEAANEDTMPILHLKKVAHAGCVNRIRSMNQEPHICATWGDTGHVQVLIFDSRGTESKLYQRLEWTCEVWDFSSFLNSLAESGAVAHNEDDRIHNHVPVKIFGGHKDEGYAIDWSPLVTGRLVSGDCNKCIHLWEPTSNSWNVDTNPFWSPTEADIFASCSADRTISIWDIRTGKKPCISVRAHNADVNVISWNRLASCMIASGCDDGSFSIRDLRLIKDDSLVAHFEYHKHPITSVEWSPHEPSTLAVSSADHQLTIWDLSLEKDAEEEAEFRARMREQADAPEDLPPQLLFVHQGQKDLKELHWHPQIPMDECNDTACLQVSVFDSLYPSFVVIHSENLLLVLLIIFEGRQLMDHLTKEQIAEFREAFNLFDKDGDGTITSKELGTVMGSLGQSPTEAELKKMVEEVDADGSGSIEFEEFLGLLARKLRDTGAEDDIRDAFRVFDKDQNGFITPDELRHVMANLGDPLSDDELADMLHEADSDGDGQINYNEFLKAKAEYDGGTWKWRSSVK

SEQ ID NO: 16128 - protein, 235 aa, Triticum aestivum
MTVTLKTPLEVHHIKLFLTRMPKEKTPYLCCLKKRKFIISTYSVQCSTCQKWRVVPSKLKYEQTRENIIQVPFSCKYVHGWKPQVTCHDPTDISEDNGMAWAIDIPCIPQTPLGWERNITLRNEQSTRFADVYYISPAGRKVRSMKDVERYLEDSPDYAARLQLSQFSFRVPKPPNCPRQSELIEPTEVPPPVHEDPVHNYMPVPHGEANHLTHIPVILALQVPVMLSKKRKLNQ

SEQ ID NO: 16129 - protein, 340 aa, Selaginella lepidophylla
MGSEAKIKIGINGFGRIGRLVARVVLERDDVELVAVNDPFISTEYMAYMFKYDSVHGKWKKADVEVKDHETLIFGGKPVGCFACKDPSEIPWGKFGAEFVVESTGVFTDRDKASAHLKAGAKKVVISAPSSNAPMFVMGVNENDYKPDIDIVSNASCTTNCLAPLSKVINDRFAIIEGLMTTVHSLTATQKTVDGPSSKDWRGGRGAGFNIIPSSTGAAKAVGKVLPALNGKLTGMAFRVPTADVSVVDLTVRLEKPASYEEIKKAVKEESEGKLKGIMGYTEDAVVSSDFIGDSRSSIFDAAAGIALNDSFVKLVSWYDNEWGYSNRVVDLIVHMAKTK

SEQ ID NO: 16130 - protein, 301 aa, Burkholderia xenovorans LB400
METSPGSIMQPVAGKRNAGEPLRSSVTAGDGVQLPLYRWPAAAPTRATVALIHGLAEHAGRYAALAGRLNAAGIELVAIDLRGHGHAPGKRAYVRRFDDYLLDAQALLDAAAQSCAPLFLMGHSMGGAVAALYAIERLEASGRRLNGLILSSPALAPGRDVPRWMLKLSQVISRLYPSFPAMKIDAALLSRLQPVVNANRADPLVHHGAIPARTGAELLLAMARIERGRAGLRVPLLVYHGTADKLTEPEGSRDFGQHAGSPDKTLTLHEGSYHETMNDMDRDRVIGALIEWIEKRLVVRT

SEQ ID NO: 16131 - protein, 423 aa, Mycobacterium avium subsp. paratuberculosis K-10
MTSRGDVAMSVAGDLTSRCSWAGAQAARLAAEARDVYQLGNLVLRGGPFALGCFAGWLFTEFPPHVLTGHALSRVSHPSIGRVGKTLATQRADHTLTAALQESLGPDFRDQVCHPTSVASVCARRGGLLGRPGPHRRYAAQTSDISYGPGGRDNLLDIWRRDDLAPGCRAPVLIQVPGGAWALNGRRPQAYTLMSRMVLLGWICVSIDYSKSPRSTFPAHLIDVKRAIAWVRENIADYGGDPDFIAITGGSAGGHLASLAALTPNDPAFQPGFENADTAVQAVAPYYGVYDFTDFENMHPLMVPFLEQFVLKARYADDPQRFAAASPISYVHADAPPFFVLHGQKDELVPSGQARAFCAALRAAGARTVGHAELSNAHHAFDITPTVRSRLAADAVADFLGVVYGRRVSSLVDSLPLSATSAS

SEQ ID NO: 16132 - protein, 398 aa, Ustilago maydis 521
MSTSANGRIATNPSTSVDWDKLGFKERDVNGLVRVTYQNGKWGALEISKDSHLNVHAAAPCLNYGQQAFEGIKAFRTASGSVRVFRPQENWARMNLSARMASMPELPEELFLEAIKVAVALNLEYVPPYKKNASGGALYIRPLLIATGPMLLLGSPDEFTFLVWVTPVGSLYGSGAEIPAVDGFVLDTFDRTAPMGTGHTKLGGNYAPVFGPTAAAKKQGYPITLHLDSATHTYVDEFSTSNALGVQKKGDQVTLVVPDSTSILRSVTKISVVEIAEKLCGWKVDLRQVAFEELKQNKFAEFMAAGTAAGITPVRSMSYNSHKPQLIHDKLSREGPKYTFPSDNKVIRIDFGDGKSAGECAQRLFDELTSYQCGDQPDKFGWLWPEQGIVAEDANLSA

SEQ ID NO: 16133 - protein, 678 aa, Caulobacter crescentus CB15
MGSPSFFSPYRHGFVRVATAVPKVKLADPAANAQNVVALAREAHAEGVAVVVFPELGLTGYTIDDLLQQEALLDAVEAAIATLTEASAGLAPMIVVGGPLRDAGRLYNTAIVIQGGKVLGVVPKSFLPNYREFYERRWFTPGAGLTGKTLTLAGQTVPFGTDILFRGEGVAPFTVGVEICEDVWTPTPPSTAQALAGAEILLNLSASNITIGKSETRRLLCASQSSRMIAAYVYSAAGAGESSTDLAWDGHVDIHEMGALLAETPRFSTGPAWTFADVDVQRLRQERMRVGSFGDAMALSPASTPFRIVPFAFDAPEGDLALARPIERFPFTPSDPARLRENCYEAYNIQVQGLARRLEASGLKKLVIGISGGLDSTQALLVAAKAMDQLGLPRSNILAYTLPGFATSDRTKSNAWALMKAMAVTAAELDIRPAATQMLKDLDHPFGRGEAVYDVTFENVQAGLRTDYLFRLANHNAALVVGTGDLSELALGWCTYGVGDHMSHYNPNCGAPKTLIQHLIRFVAHSGDVGAETTALLDDILATEISPELVPGEAVQATESFVGPYALQDFNLYYMTRYGMAPSKIAFLAWSAWHDADQGGWPVGLPDNARRAYDLPEIKRWLELFLKRFFANQFKRSAVPNGPKISSGGALSPRGDWRMPSDATADAWLAELRTNAPI

SEQ ID NO: 16134 - protein, 554 aa, Oryza sativa (japonica cultivar-group)
MQREKEAMGIGIGIGIGIGIGTGTGAALPFGEASPWSLLGGAVAALLLVWAAQMLEWAWLAPRRMERALRAQGLRGTQYRFLHGDLTEDLRLVTAARSKPVPMDRPHDFIPRVAPLLHRALEEHGRVSFTWFGPMPRVTITDPDLVREVLSNKFGHFEKTKLATRLSKLLVGGLVILHGEKWVKHRRIMNPAFHAEKLKRMLPAFSASCSELIGRWENAVAASVGKAELDIWPDFQNLSGDVISRAAFGVRHHEGRQIFLLQAEQAERLVQSFRSNYIPGLSLLPTENNRRMKAIDREIKSILRGIIEKRQKATKNGEASKDDLLGLLLQSNMDYYSDEDGKSSKGMTVEEIIDECKLFYFAGMETTAVLLTWTMVALSMHPEWQDRAREEILQVFGRNKPDINGVSRLKVVTMVLHEVLRLYPPVVMMNRRTYKEIELGGVRYPAGVMLSLPVLFIHRDAAAWGHDAGEFDPGRFAEGVARACKDPGAGAFFPFSWGPRICIGQNFALLEAKVALGMILQRFAFELSPAYAHAPYTVLTLHPQHGVPVRLRRL

SEQ ID NO: 16135 - protein, 452 aa, Pseudomonas putida GB-1
MSEQNSQTQAWQALSRDHHLAPFSDVKQLAEKGPRIITSAKGVYLWDSEGNKILDGMAGLWCVAVGYGRDELAEVASQQMKQLPYYNLFFQTAHPPALELAKAIADVAPQGMNHVFFTGSGSEGNDTVLRMVRHYWALKGKKNKNVIIGRINGYHGSTVAGAALGGMSGMHQQGGVIPDIVHIPQPYWFGEGGDMTEADFGVWAAEQLEKKILEVGVDNVAAFIAEPIQGAGGVIIPPQTYWPKVKEILARYDILFVADEVICGFGRTGEWFGTDYYDLKPDLMTIAKGLTSGYIPMGGVIVRDEVAKVISEGGDFNHGFTYSGHPVAAAVGLENLRILRDEQIIQQVHDKTAPYLQQRLRELADHPLVGEVRGLGMLGAIELVKDKATRARYEGKGVGMICRQHCFDNGLIMRAVGDTMIIAPPLVISVEEIDELVQKARKCLDLTYEAVR

SEQ ID NO: 16136 - protein, 309 aa, Bacillus subtilis subsp. subtilis str. 168; identical to SEQ ID NO: 1088

SEQ ID NO: 16137 - protein, 104 aa, Cyanidioschyzon merolae strain 10D
MKSLLTFILTTIFCIQQVWAADLAHGEQIFSANCAACHAGGNNVIMPEKTLKLDALEANQMNSVEAISTQVRNGKNAMPSFSRLTDSDIEDVANYVLAQAKKGW

SEQ ID NO: 16138 - protein, 117 aa, Brassica napus
MSYNNNGNVVPAADPLPGKKTKLQSSRSWVSIVATGESETLDVDKYAIMHRVQIHARDLRILDPNLSYPSTILGRERAVVLNLEHIKAIITADEVLLRDPSDENVIPVLKELERRLP

SEQ ID NO: 16139 - protein, 284 aa, Ralstonia metallidurans CH34
MCLILVAWQSHPDYPLVVAANRDEFYARPAAPADWWRDAPGVLGGRDLAEVIGDAGTWMGIAGAQHGLDSPVGARFAALTNYRAPSEKRTDARSRGELVAHFLRGDQTPADYLHDLAGDHGAYNGFNLLTSDLHDLWWYSNRSKSRVPQRLTPGLYGLSNALLDTPWPKVRSRVGAMCEVLAADRGQIGSNVESYLQLLADDRQAPDWELPSTGVAPEWEKLLSSAFIRSPNYGTRASTVLRVMHDGRFDFVERSFDADGQTGEVSYRGRLNLARDTGTVPAPR

SEQ ID NO: 16140 - protein, 653 aa, Caulobacter crescentus CB15
MPVSPIKMADAIRVLSMDAVHKAKSGHQGMPMGMADVATVLWGKFLKFDASKPDWADRDRFVLSAGHGSMLLYSLLHLTGFKAMTMKEIENFRQWGALTPGHPEVHHTPGVETTTGPLGQGLATAVGMAMAEAHLAARYGSDLVDHRTWVIAGDGCLMEGVSHEAISIAGRLKLSKLTVLFDDNNTTIDGVATIAETGDQVARFKAAGWAVKVVDGHDHGKIAAALRWATKQDRPTMIACKTLISKGAGPKEGDPHSHGYTLFDNEIAASRVAMGWDAAPFTVPDDIAKAWKSVGRRGAKVRKAWEAKLAASPKGADFTRAMKGELPANAFEALDAHIAKALETKPVNATRVHSGSALEHLIPAIPEMIGGSADLTGSNNTLVKGMGAFDAPGYEGRYVHYGVREFGMAAAMNGMALHGGIIPYSGTFLAFADYSRAAIRLGALMEARVVHVMTHDSIGLGEDGPTHQPVEHVASLRAIPNLLVFRPADAVEAAECWKAALQHQRTPSVMTLSRQKTPHVRTQGGDLSAKGAYELLAAEGGEAQVTIFASGTEVGVAVAARDILQAKGKPTRVVSTPCWELFDQQPAAYQAAVIGKAPVRVAVEAGVKMGWERFIGENGKFIGMKGFGASAPFERLYKEFGITAEAVAEAALA

SEQ ID NO: 16141 - protein, 246 aa, Thermotoga maritima MSB8
MKMKEFLDLLNESRLTVTLTGAGISTPSGIPDFRGPNGIYKKYSQNVFDIDFFYSHPEEFYRFAKEGIFPMLQAKPNLAHVLLAKLEEKGLIEAVITQNIDRLHQRAGSKKVIELHGNVEEYYCVRCEKKYTVEDVIKKLESSDVPLCDDCNSLIRPNIVFFGENLPQDALREAIGLSSRASLMIVLGSSLVVYPAAELPLITVRSGGKLVIVNLGETPFDDIATLKYNMDVVEFARRVMEEGGIS

SEQ ID NO: 16142 - protein, 461 aa, Triticum aestivum
MATTASPSTTTTPRSFLSSPSSSLRASKSNHLRTTRRLPVNVRCASSSPAADTSYTTKVSRNANIAKLQAGYLFPEIARRRAAHLLKHPDAKIISLGIGDTTEPIPEVITNAMAERAHALSTVDGYSGYGAEQGEKKLRAAIAATYYADLGIDETDIFVSDGAKCDISRLQVLFGSKVKIAVQDPSYPAYVDSSVIMGQTDLYQQDVQKYGNIEYMRCSPENGFFPDLSKVPRTDIIFFCSPNNPTGAAASRDQLTRLVKFAKDNGSIIVYDSAYAMYISDDSPKSIFEIPGAKEVALETASFSKYAGFTGVRLGWTVVPKELLFSDGHPVAKDFNRIVCTSFNGASTISQAGGLGCLSPEGLKAMQDVVGFYKENTKIIVDTFESLGFNVYGAKNAPYVWVHFSGRNSWDVFAEILEKANVVTTPGSGFGPGGEGFVRVSAFGHRENIIEAARRLKQLYK

SEQ ID NO: 16143 - protein, 956 aa, Kineococcus radiotolerans SRS30216
MPGLGASFGRGGATGDLQDLSNADVIVIQGSNMAECHPVGFQWVMEAKARGAKVFHVDPRFTRTSALADTHVPIRTGTDIVLLGAIINRVLTQERDFREYVVAYTNASHLISEDFQDTDDLDGLFSGFDHETNSYDTKSWQYAGTEQHGDEEEETAESSDSESGHSLGAGGAAVEHRSIQRDETLQDPRCVYQVLKRHFARYTPEMVADVCGIPTDLFEELAEAWISNSGREKTGALVYSVGWTQRGTGVQYIRAGAILQLLLGNMGRPGGGVMALRGHASIQGSTDIPTLYNLLPGYLQMPHVERHPDLAGYIDSIKGPAQKGFWANADAYTVSLLKAYFGDEATAENDYLFDELPKISGDHGTYSQVMDMIEGGKIFGYFLLGQNPAVGSANGRAQRLGMANLDWMVVRDLVMIESATFWKDAPEVETGEIVPEQCRTEVFFLPAASHVEKEGTFTQTQRLLQWREKAVNPPGDATSELWFFYHLGRRMREKLAGSTDPRDQLLLKLAWDYPLHGEEREPSSEDVLKEINGYGPEGLLPGYTALKADGSTSSGCWIYSGVYADDVNQAARRKPGREQSLHAPEWGWAWPMNRRMLYNRASADPEGRPWSERKALVWWDEEAQRWVGDDIADFEATKPPSYRPPEGATGVAAIAGDDPFIMQSDGKGWLYAPKGVVDGPLPAHYEPAESPFRNAVYTQQANPAREVYTNHLNEVHPSPPELGSQVFPYVWITSRLTEHHTAGGMSRYLPYLAELQPALFMEVSPELARMRGLEHLGWAHVVTARAIVEARVLVTDRLAPLKVQNQLVHQIWLPYHWGQGGLTTGDVVNDLMHLTLDPNVHIQEFKAGTCDVLPGRRPRGAAMLALIDEYRVRGGVTMASGAVAVTADLIARDGQERTDLAQGGDDHVGDGHDDDEIDRVLSVRHDVRSSPEHPQQDVEPAVLDAHPARGLDRRAD

SEQ ID NO: 16144 - protein, 513 aa, Bacillus halodurans C-125
MEQLSEEMIVVLDFGGQYNQLITRRIRDLGVYSELHPNTITAEQLKEMKPKGIIFSGGPNSAYAEGAPKCDPAIFDLGVPILGICYGMQLMTQHFGGKVDAAEHREYGKATITVENQSKLFQGLPVEQTVWMSHGDLIVAPPEGFVVDAQNPSCPVAAMSDEARNYYGVQFQPEVRHSQFGDDMLKNFAFAVCGCEGNWSMENFIELEMEKIREQVGDKQVLCALSGGVDSSVVAVLIHKAIGDQLTCMFIDHGLLRKGEADSVMKTFSEGFNMNVIKIDAKDRFLSKLEGVSDPEQKRKIIGNEFIYVFEEEASKLKDMDFLAQGTLYTDIIESGTATAQTIKSHHNVGGLPEDMRFELIEPLNTLFKDEVRKLGTELGIPDEVVWRQPFPGPGLGIRVLGEITEEKLEIVRESDAILREEIKKAGLDREIWQYFTALPNMRSVGVMGDARTYDYTVGIRAVTSIDGMTSDWARIPWDVLEIISTRIVNEVKHVNRVVYDITSKPPATIEWE

SEQ ID NO: 16145 - protein, 414 aa, Staphylococcus epidermidis ATCC 12228
MTENNNLVTSTQGIIKEALHKLGFDDGMYDLIKEPIRFLQVRIPVRMDDGTVKTFTGYRAQHNDAVGPTKGGVRFHPEVDEEEVKALSMWMTLKCGIVNLPYGGGKGGIVCDPRQMSIHEVERLSRGYVRAISQFVGPNKDIPAPDVFTNSQIMAWMMDEYSALDKFNSPGFITGKPIVLGGSQGRDRSTALGVVIAIEQAAKRRGMDIKDAKIVIQGFGNAGSFLAKFLYDLGAKVVGISDAYGALHDPNGLDIDYLLDRRDSFGTVTNLFEDTISNKELFELDCDILVPAAISNQITEDNAHDIKASIVVEAANGPTTPEATRILTERDILLVPDVLASAGGVTVSYFEWVQNNQGYYWTEEEVNDKLREKLVTAFDTIYELSQNRKIDMRLAAYIVGIKRTAEAARYRGWA

SEQ ID NO: 16146 - protein, 572 aa, Bacillus halodurans C-125
MGNERLKAPEGPPSDVERIKEESNYLRGTLKESMLEPISAGISDDDNRLMKHHGSYLQDDRDLRNERQKQKLEPAYQFMLRVRMPGGVATPEQWLVMDELAQKYGNGTMKLTTRETFQLHGILKWNMKKTIQAIHSALLDTIAACGDVNRNVMCTSNPYQSEIHQEVYEWSKKLSDDLLPRTRAYHEIWLDEEKVAGTPEAEEVEPMYGPLYLPRKFKIGIAVPPSNDIDVFSQDLGFIAIVEDDKLVGFNVAIGGGMGMTHGDKATYPQLAKVIGFCKPEQIYDVAEKIITIQRDYGNRSVRKNARFKYTVDRLGLETVKNELENRLGWSLDEAKPYHFDHNGDRYGWVKGVKGRWHFTLFVEGGRVTDYADYKLMTGLREIAKIHTGDIRLTSNQNLIIANVTSQKKKKINELIEQYGLTDGKHYTALRRSSIACVALPTCGLAMAEAERYLPKLIDKIDEIIEENGLKNEEITIRMTGCPNGCARHALGEIGFIGKAPGKYNMYLGAAFDGSRLSKMYRENIGEEEILKELREILPRYAKERKEGEHFGDFVIRAGIIKETTDGTNFHD

SEQ ID NO: 16147 - protein, 1064 aa, Lactococcus lactis subsp. lactis Il1403
MPKRNDIKKIMIIGSGPIIIGQAAEFDYAGTQACLALKEEGYEVVLVNSNPATIMTDREIADTVYIEPITLEFVSKILRKERPDALLPTLGGQTGLNMAMELSKIGILEELNVELLGTKLSAIDQAEDRELFKELCERIGEPLCASDIATTVDEAVEIADKIGYPIIVRPAFTMGGTGGGICDTEEELREIVANGLKLSPVTQCLIEESIAGYKEIEYEVMRDSADNAIVVCNMENFDPVGVHTGDSIVFAPSQTLSDNEYQMLRDASLNIIRALKIEGGCNVQLALDPHSYEYRVIEVNPRVSRSSALASKATGYPIAKMSAKIAIGMTLDEIINPVTNKTYAMFEPALDYVVAKIARFPFDKFENGDRHLGTQMKATGEVMAIGRNIEESLLKAVRSLEIGVFHNDLQEAQDADDEILYEKMVKTQDDRLFYVSEAIRRGIPIEEIADLTKIDIFFLDKLLHIVEIEDQLKVNIFEPELLKTAKKNGFSDRQIAKLWNVSPEEVRRRRQENRTIPVYKMVDTCAAEFESSTPYFYSTYEWENESKRSSKEKIIVLGSGPIRIGQGVEFDYATVHCVKALQALGKEAIVINSNPETVSTDFSISDKLYFEPLTFEDVMNIIDLEQPEGVIVQFGGQTAINLAEPLSKAGVKILGTQVEDLDRAEDRDLFEKALQDLEIPQPPGATATNEEEAVANANKIGYPVLIRPSFVLGGRAMEIINNEKDLRDYMNRAVKASPEHPVLVDSYLQGRECEVDAICDGTEVLLPGIMEHIERAGVHSGDSMAVYPPQTFSQEIIDTIVDYTKRLAIGLNCIGMMNIQFVIFEEQVYVIEVNPRASRTVPFLSKVTNIPMAQLATQMILGKNLKDLGYTEGLAETPDMVHVKAPVFSFTKLAKVDSLLGPEMKSTGEAMGSDVTLEKALYKSFEAAKLHMADYGSVLFTVADEDKEETLALAKDFAEIGYSLVATQGTAAFFKENGLYVREVEKLAGGEDEEGTLVEDIRHGRVQAVVNTMGNTRASLTTATDGFRIRQEAISRGIPLFTSLDTVAAILKVMQSRSFTTKNI

SEQ ID NO: 16148 - protein, 531 aa, Oryza sativa (japonica cultivar-group)
MGMVVFAAGDERPLMLVWAAVAGAVLAWCAVRAMEWAWWRPRRLERALRAQGLRGTPYRSPAGDAPLNVQLSAEARARTMPLGCHDVVPRAMPLFHQAMKEHGKVSITWFGPVPRVTITKPELVREVLSNKFGHFEKLKFGRFQRLLHNGLGSHEGEKWAKHRRIINPAFHLEKLKRMLPAFAACCTELVDKWEGLAKGGDEPYEVDVWPEMQSLTGDVISRAAFGSSYLEGKRIFQLQGEQIELIVATMNKIHIPGYIHLPTKSNRRMKQIAAEIEGMLKRIIAKRESALKAGEASSDDDLLGLLLESNLDHSKGNGGAASSGISIDDVIGECKLFYFAGMETTSVLLTWTMVVLSMHPEWQDRAREEVLHVFGSRAPDYDGLSRLRIVTMVLYEVLRLYTPLTALQRKTYKPMELGGVRYPAGVVLTLPLLCVHHDKDVWGADADEFRPERFAEGISKASREAPAFFPFGWGPRICIGQNFALLEAKMGLSMILQRFSFDLSPSYTHAPFPVGLLQPEHGAQVRLTRLN

SEQ ID NO: 16149 - protein, 579 aa, Zea mays
  misc_feature (35)..(35): Xaa can be any naturally occurring amino acid
  misc_feature (161)..(161): Xaa can be any naturally occurring amino acid
  misc_feature (176)..(176): Xaa can be any naturally occurring amino acid
MASHIILPPDDADENHNHQTAAAAAAEEEEEGPHXSPPPPDDDEHGVPPALPPKAALPFSATCVRISRDSYPNLRALRNASSVSLADAAYVKISEADFGYVLDDVPHFTDYLPDIPTYPNPLQDHPAYSTVKQYFVNEDDTVPQKVVVQKNSRRGVHFRRXAGPRQRVYFGTDEVXKACIVTCGGLCPGLNTVIRELVCGLSHMYNVSSIFGIQNGYKGFYSSNYLPLTPKSVNDIHKRGGTVLGTSRGGHDTKKIVDNIQDRGINQVYIIGGDGTQKGAYEIFKEIRKRGLKVSVAGVPKTIDNDIAIIDKSFGFDTAVEEAQRAIDSAHVEACSAENGIGLVKLMGRYSGFIAMYATLASRDVDCCLIPESPFYLDGEGGLLQYVEKRLKENKHMVIVVAEGAGQDLIAKSLATSDQQDASGNKLLLDIGLWLTHKIKDYFKSKKMEMTIKYIDPTYMVRAIPSNASDNVYCTLLAHSAIHGAMAGYSFTVGMVNGRHTYIPFYRVTSTRNKVKVTDRMWARLLSSTNQPSFLSQKDIDEASEADRLANRPPLPTGASSRVARSFDQSSSCSSNGEI

SEQ ID NO: 16150 - protein, 807 aa, Bacillus halodurans C-125
MKEKLVVVGNGMAGIRTVEELFERGGHERYEVTVVGEEPHVNYNRILLSSVLASEANMEDIELNSLDWYRENDVTLYRSEKVTKLDRKKKVVLTDKGQKIAYDKVILATGSHPFMLPLPGSDLEGVIAFRNIEDCETMIETAKNYKKAVVIGGGLLGIEAARGLLNLGMEVEVVHIFDYLMERQLDRTAANILRTELENQGMKFLLEKHTEAIIGKGRVERVKFKDGTETRADLVVMAVGIRPNHEVASASGIEVNRGIVVDDYMQTSDPDVYAVGECAEHRGMVYGLVAPLWEQGKILANALMDNKDEKYEGSVLYSKLKVSGVQVFSVGEFQEQDDAKSVSMLDEFAGIYKKIVTRGDKIVGSILVGDTSESTILLNQIIKGVPFEGSPMQLLRSHVGSADDGVSAVSMLSNEDQVCGCNGVSKGAIIDAIKTQGCASVADVGACTTAGRSCGTCKPMIADLLAEELGETANEKETMCGCTDLSHEEVVAAIREKGLTHTREVMNVLGWKEEHGCSKCRPAINYYLAMVHPLEHEDERESRFVNERLHANIQKDGTYSVVPRMYGGVTNPDELRRIADVAEKFNVPLLKITGGQRIDLLGVKKEDVPSVWKELDMPSGYAYGKALRTVKTCVGEDFCRFGTQDSIGLGIAIEKKFERLNTPHKVKMAVSACPRNCAESGIKDVGIVGVEGAWEIYVGGNGGASLRLGDLMCRVKTSEEVLEIIGAFLQLYREEARYLERTSHWVERVGLDYIKETLLEHPENRKVLNERMDEALSVLTDPWEEINNDPSLKETLFEEKVAVVTSE

SEQ ID NO: 16151 - protein, 123 aa, Aeropyrum pernix K1
METAPKPVGPYSQAVESGCFMFVSGQIPINPETGALEEGGFKESAKRALDNLKAIVEGAGYSMDDIVKVTVYITDISRFSEFNEVYREYFNRPYPARAVVGVAALPLGAPLEVEAVLYTCRRK

SEQ ID NO: 16152 - protein, 743 aa, Bacillus halodurans C-125
MEEMIQFFREKQKQQGKEARYDTRCPFCSVQCSMTLTEEKLVATSRFKAIPNKQDPTSEGRLCIKGVHAHQHTVHRERIRQPLVKTGGAFVETSWEVALGLIAERFKRLQKSYGQDAVGVFGGGSLTNEEAYLLGKFARLALGTRYIDYNGRYCMSSAAAAANLTFGVDRGLTNELREVEDAECIVLAGTNLAECQPTLMPYLRRAKKNGAFIIVLDPRETGTTKIANLHLKPKPGTDGAIAAGMLKVLIEEELIDRTFIEARTNGFEQVESELQEIALAELALAAGVPEEQIREAAIRFGEAQTGMIFTARGVEQQATGTADVRQFLHILLATGKIGRYACGYGAVTGQGNGQGGREHGQKADQLPGYRSIESPEDRAYIASVWNVEEKDIPRKGVSAFELFQKIDQQDVRGMFIMGSNPVLSSPHENLVKRALSRLDVLVVVDMFISETAEYADIILPTTSYLEDEGTMTNFEGRVVHRPGSKPPFGKAKHDWQILCELAEALDRSHGFQFSSPEEIFNELCLASKGGKADYSGLSYEKIKGEGVLWPCPTKEHEGTGRLFEDRFYTEDGRAQFGSVHCPVDSENDEYPILLTTGRVLTQYLSGTQTRRSDALLFKEPEPFVLLHPETASSYQIQDEDWVMVRSPYGEAKLKARQSEGIREDTVFVPFHWAGSVSINHVVAPELDPTSRMPAFKRTKVKLKKIIEEKGESWYSGQKNDRQESENTDDILDPVHSGGVAKNR

SEQ ID NO: 16153 - protein, 444 aa, Arabidopsis thaliana
MVRRQEEEKKAEKGMRLGKYELGRTLGEGNFGKVKFAKDTVSGHSFAVKIIDKSRIADLNFSLQIKREIRTLKMLKHPHIVRLHEVLASKTKINMVMELVTGGELFDRIVSNGKLTETDGRKMFQQLIDGISYCHSKGVFHRDLKLENVLLDAKGHIKITDFGLSALPQHFRDDGLLHTTCGSPNYVAPEVLANRGYDGAASDIWSCGVILYVILTGCLPFDDRNLAVLYQKICKGNPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVKQEERNQKGQVGLSVTAEVFEIKPSLNVVELRKSYGDSCLYRQLYERLLKDVGTSSPEQEIVT

SEQ ID NO: 16154 - protein, 577 aa, Polytomella sp. Pringsheim 198.80
MSSSALRLLCGRTSFFNLCQKYPPSFLSQLSTLNFSTHSPFDSTYDVVVVGAGISGLSTAQALSIQHKIDNVLVTEADHRVGGKITTKRNKDFLWEEGPNSCLMNDALYRAARDAGVESKILSADPKLPRWILWGRRLRVAPIGSYALKSDLLSTQGLLRAIRGVTGFGVSPAPPKGQEESVEGFVRRTLGDEIFERLVEPFCSGVYAGDPSKLSMRAAFGKLVEFEETGDGSLLRGVFRYVMNKRRERRTGGAKDGDTVPLNETAKAPKSSSGPTVSSFEGGIEILPKAIAQKLGDRVRLGLRLVRIDPTQLADGTTAYRLSYRRMSHQGDDDSSRTAGAVPRTAEGDVAAGDEDAVVEVVAKKVVLTTPAFDAADILSRSGLVAAANPLKEVDYPPVALVVLSYDVDSISAIHRVSHVAHGLSGFGQLHPRPEGLRTLGTIYGSTLFPNRSPVARTTLLNFVGGSTDRAVGSADPMALAMEVDLDLKKSGLIREGAAKPEVLGVKVYPKAIPQFDIGHLDRVEKAKMMLKNERGGADWSGVKLAGNYVCGVAVGRCIEFGFEIAENLAQELARKK

SEQ ID NO: 16155 - protein, 427 aa, Salmonella enterica subsp. enterica serovar Typhi str. CT18
MADTKAKITLTGDTAIELDVLKGTLGQDVIDIRSLGSKGVFTFDPGFTSTASCESKITFIDGDEGILLHRGFPIDQLATDSNYLEVCYILLYGEKPTQEEYDEFRTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCETYEVNPVLERAMDRILILHADHEQNASTSTVRTAGSSGANPFACIAAGIASLWGPAHGGANEAALKMLEEISSVKHIPEFVRRAKDKNDSFRLMGFGHRVYKNYDPRATVMRETCHEVLKELGTKDDLLEVAMGLEHIALNDPYFIEKKLYPNVDFYSGIILKAMGIPSSMFTVIFAMARTVGWIAHWNEMHTDGMKIARPRQLYTGYDKRDFKSALKR

SEQ ID NO: 16156 - protein, 344 aa, Ralstonia metallidurans CH34
MLLYGITGMIWKSNDRSEIEHQYMPAQPLDSQVAQLLDLIARAKRPAIHTMDPVDAKIAYEKSAPILDLSPAPVHGVEDFQVTARDGHAIPVRLYSPREASWADPLPLLVYFHGGGFTVGSVNSHDSLCRMFCNGAECLVLSVDYRLGPEWKFPVAANDAFDVLHWVFEEAARIGADATRIALGGDSAGGTLAAACAVEARDHGLAPVLQMLIYPGTCARQDTPSHRALAEGYLLTAEMIQWFFSQYLDVDASRDDWRFAPLDGGGEGADVRGCCPAWIAVAGYDPLHDEGVAYAAKLEAAGVVASLTDYPSMIHDFFKLGRFIGAVAGAHADATAALRRAFGI

SEQ ID NO: 16157 - protein, 481 aa, Zea mays
MPEPGGRCLGDLGGQRQVLKGWPDLWLVGDKPGLRALSTAAMAAAPQPPPLEADQTLALPDVLLLRVLACLPEPQLTGAASLVCRRWTRLAGRLRRRLAVRDWAFVAHRLPYRFPDLADLDLFPASIAAPTTAVPHGAAASPLLTCGVVSLTLDTSADPPLGACRFIDDDALDRGLAAVAASFPNLSRLSATAASESGGLMAIAVGCPTLQELELHRCTDLALRPVSAFAHLQILRIVAASPALYGTAEGGGVTDIGLTILAHGCKRLVKLELQGCEGSYDGIAAVGRCCAMLEELTIADHRMDGGWLAALAFCGNLKTLRLQSCSRIDDDPGPAEHLGACLTLESLQLHRCQLRDRSALHALFLVCEGAREIQFQNCWGLEDDMFALAGLCRRVKILLLEGCSLLTTRGLESVITSWGDLQSLEVVTCNKIKDEEITPTLAELFSNLKELKWRPDNKSLLAASLVGTGMGKKGRVFFKRV

SEQ ID NO: 16158 - protein, 337 aa, Ralstonia metallidurans CH34
MSKQTYKRIVLASRPEAAVTPDNFRIEELPVPELADGQVLVRNHFLSLDPYMRGRMSDSKSYADPQPLNEVMIGGTVGEVIASKNPKWNVGDKVIGMFGWQELGVSDGGMMQKVDTTHIPLSAYLGSVGMPGVTAWYGLNKIIAPKAGETVVVSAASGAVGSVVGQLAKLAGCYVVGVAGGKEKCDYVVNELGFDACVDYKAAKDAKELYAMVKAVTPNGIDGYFENVGGDILDVVLSRLNPFARIAVCGLIAGYDGQDMPIRNPRAILVARAKIEGFIVSEHMELWPQALRELGTYVAQGKIKFRESIAEGLASAPEAFIGLLKGKNFGKQLVKLA

SEQ ID NO: 16159 - protein, 149 aa, Oryza sativa (japonica cultivar-group)
MMAGLQRSATTFRRSGSSGLVWDERFLTEDAEAAKAGDGDGGGGTEEPQPELRHSKSVGSIGMMRRVAADDGDDSEKTTKQQRKKKKKKKKDGQKEDDNRSQQVFRTKDIAPDVDPPSPRVSGCILCSIFSGSGSSSSATSRRAKPRKK

SEQ ID NO: 16160 - protein, 525 aa, Oryza sativa (japonica cultivar-group)
MDLAAWFGPVNSGLVLLILTMLLRNLQNFQLMQTFVARQLNRRARRLAALIDPYLSITIHEYDAGRMTRSDVFAETKAYLDGAVGTRDDVRHLNAEDARGGGGGGGAGEGGGGGAGSSSSKGLVLSMADGEEVEDHFRGATLWWSAHCEQDDDKGRRGGGGRASQRRSYRLVFHECHRDLVRSAYLPHVRDQGRAFMAMSRQRKLYTNIPSSRWGDDGHAKTEVTCVRSHFRSYMCSLWTEVVFKHPKTFETLAMDPEKKREIIDDLDMFKNGKEQHRRVGKAWKRGYLLHGPPGTGKSTMVAAMANYLGYDVYDMELTSVHTNTDLRKLLIQTTSKSIIVIEDVDCSSNLTGRRKATGDGEDDDDDAKTTTKKVIDRGGGGGGVGGDSKVTLSGLLNFIDGLWSAFGEERLIVLTTNHVEDLDPALIRTGRMDKKIEMSYCDFETFKSMAKIHLDVDDHEMFAAVERLLPEVDLVPADVGEHLTAKNPRDDAGACLARLVNALQEAKAKKDAAERQDEDNGVVV

SEQ ID NO: 16161 - protein, 495 aa, Zea mays
MAGRRLVTLTLLAAAFLAAAPGGAGSKPSAKFELIHRGQAPWDEVARMDQERTAFISSHARRRATEAGPVQAQAPCSAGRRSPSPCRSRGAGTDLPAPFPPSPRPRGPPRPAHQTLNPSDLPLAPPPTMFFLKDPPPTMSPPQPPHPVPRETVASAVASLTTWMKKRAAEARPNLLADERDDIVVLQLSLRRIPASRSTKPRLLPMPHPVVGHDGASVCVISDDRTKSRSPSASDLHASMSLHRFPVSEVIPLSTLRTDYRPYESRRRLAASHDLFVADRAILPLLPRVLGKAFYSTKKAPIGVDFTRIGWPEQVRRVLGSAFLYLRSGTCSGIKVGRLDMEEEDIVDNVMAAVEEAVEKVPKKWGNVRALHLKAVDSVALPIYQVVPELGMKIEVPEPDIVGSGEVIEKKANAGADGREVFANVSSKRKRNKKEQIEEGVVMQEEVQVDTEKKKKTKSIMVDDGHEVGKKGRVKGKRATEEGKKRKKSIKGDRL

SEQ ID NO: 16162 - protein, 428 aa, Methanosarcina barkeri str. Fusaro
MTLMEDAKKGIVTPSIETVAKTEGIDPETVCSCVAKGLIAIPVNNRRETLPIGIGKYMSTKINANVGTSRDYVDIDAEIKKAKAAEAFGAHAVMDLSTGGNLDEIRTRILKSVNIPVGTVPIYQAAASRKVVVEMTSDDMFNAVRKHAEQGVDFVTVHAGVNLNSLERLRQSDRIMNVVSRGGSFTLAWMLHNGEDNPFYAEFDYLLEIAKEYDMTLSLGDGMRPGCIADASDRPKFMEFITLGELVKRARAANVQTFVEGPGHVPLNEIELSVRGMKELCNGAPLYLLGPLVTDIAPGFDHITGAIGGAVAGMHGTDFLCMVTPSEHLALPTLEDIKEGLLVTKVAAHTIDLIKEGPRERAWEKDLAMAYARRDLDWEKQFELAIDGNRARKIRDARKTESDTCSMCGELCALKIVKEAFEKKNSEE

SEQ ID NO: 16163 - protein, 465 aa, Chlamydomonas reinhardtii
MGSCLAKPAESAEQKKASSVPSPPPAPAPQPVQQAAAPAPKDSGDVKPGQQATPVPPPSPPPQPKPAPPAQPAPAPAAKVVEAIPAVADEKSPQGKQPRRSQEHDNGVKAEEIELVKQKSTEPQPSASATAAVATPKAIEPAMEPKVAAPSAPAAAPAPAQAPAAAPTPARPGSKLRTDVKLRDLYKLGKTLGTGGFSVVKLATDRGTGVEYACKIMALPPVGQEVGENENTREDIFKEIDLLCGMNHENVIFLKEYFEEGNKVYLITELLTGGELLEAVLKRGSYTEAEARLCFVQVLRGIEYLHSKNVVHRDLKLENLLLAKQDDISLVKIADFGLAKHAVNGMQTICGTPQYVAPEVIVGAKGHVYGPGVDMWSAGVVLYILLGGYPPFWSDSEPQLFDMIRKGKYSFGDPVWNKVSEGAKDLIRKLLVVDPTKRLSATEALQHQFILEGNFNPPSTPKGPR

SEQ ID NO: 16164 - protein, 228 aa, Zea mays
MAIARTGVYVDDYLECIMGQTKEQIKYILGVSSHGYDRSNMDDDESERMKKDIEASQDNALNLCTEKVLLARQAYDLIESHIKRLDEDLGQFAEDLKHEGKIPPDEPTVLPPVPVVSRDEKRRFGFSTPQASKKFREREWDRERGMDFDLMPPPGSSKKAGTSMDVDQTIDPNEPTYCICHQISYGDMIACDNENCGGGEWFHYTCVGLTPETRFKGKWFCPTCRNLQ

SEQ ID NO: 16165 - protein, 294 aa, Rickettsia rickettsii
MHNIFKGLITALITPFKDNKLDLYALERIVKHQIKHEVDAILIAGSTGESSSLSFEEYKLLLQTSVEIVNKCIPIISGCSSNNTTYARALAAESTKIGVDGFMASPPSYVKPTQHGIYKHFEALHEACNLPIMLYSAPTRSGVDFSDETILRLSKLPRILALKDCGVDLERPLRIRATVKKDFNILTGNDEVVLAFNAQGGVGWTSVASNIVPNICKELLEKWNKNDTKGALEIHQKLLPLYTALFVESNPIPIKYAAHYLGLCENEIRPPLTEASDSAKKQIENIITSLSIKI

SEQ ID NO: 16166 - protein, 101 aa, Arabidopsis thaliana
  misc_feature (14)..(15): Xaa can be any naturally occurring amino acid
  misc_feature (30)..(31): Xaa can be any naturally occurring amino acid
  misc_feature (42)..(42): Xaa can be any naturally occurring amino acid
  misc_feature (54)..(55): Xaa can be any naturally occurring amino acid
  misc_feature (84)..(84): Xaa can be any naturally occurring amino acid
RNNNNVFSMLSSAXXVTFFFQASMVTPFTXXNSSSSFPFTLXTNKDITSISFYXXRFNYINLFPPIVKNKFLTLSYLPDLNDFXLANEFYYLFLNKWIPFF

SEQ ID NO: 16167 - protein, 380 aa, Sulfitobacter sp. EE-36
MRISTRSQVDPFIVMDVMQAAAAAEAEGRHIIHMEVGQPGTGAPKGASTALTAAMEQGALGYTVALGLSALRQRIARMYGEWYNVDLDPNRVVITSGSSGGFILTFTSLFDTGDRVGIGAPGYPSYRQILKALDLAPVDLPTSLDNRLQPVPADFAGMDLQGLLVASPGNPTGTMLDHAAMSALIDATKAQGASFISDEIYHGIEYEKKAVTALEITDDVYVINSFSKYFSMTGWRVGWMVVPEDHVRVVERIAQNMFICAPHASQVAALAAMDCIDELEANMDVYRANRAMMITGLREAGFTRFAPPDGAFYVYADVSELTDDSRALARDILDKAGVAVTPGLDFDPVRGHHWLRFSYARSTQDIVEGLGRLKTYMAAR

SEQ ID NO: 16168 - protein, 402 aa, Salmonella enterica subsp. enterica serovar Typhi str. CT18
MSSVDILVPDLPESVADATVATWHKKPGDAVVRDEVLVEIETDKVVLEVPASADGILDAVLEEEGTTVTSRQILGRLREGNSAGKETSAKSEEKASTPAQRQQASLEEQNNDALSPAIRRLLAEHNLEASAIKGTGVGGRLTREDVEKHLAKGESKAPAVEPAAQPALGARGEKRVPMTRLRKRVAERLLEAKNSTAMLTTFNEVNMKPIMDLRKQYGEVFEKRHGIRLGFMSFYVKAVVEALKRYPEVNASIDGDDVVYHNYFDVSMAVSTPRGLVTPVLRDVDTLGMADIEKKIKELAVKGRDGKLTVEDLTGGNFTITNGGVFGSLMSTPIINPPQSAILGMHAIKDRPMAVDGKVEILPMMYLALSYDHRLIDGRESVGFLVTIKELLEDPTRLLLDV

SEQ ID NO: 16169 - protein, 307 aa, Oryza sativa (japonica cultivar-group)
MQWDAHSLSTAMLPSPYLFFLDKWTYSCIILHYLSNDVVMLSLFVFMHINRLEITPDKRFLAAAGNPHIRLFDINSNSNHPVISYDSHTSNVMAVGFHCDGNWMYSGSEDGTVRIWDLRTATCQREYESRAAVNTVVLHPNQKELISGDQNGNIRVWDLAANSCSCELVPEVDTAVRSLTVMWDGSMVVAANNRGTCYVWRLLKGTQTITCFEPLHKLQAHDGYILKCLLSPEFCDPNRYLATASSDHTVKIWNVDGFKLEKTLVASSDTTARLWTMSTGEAIRVYTSHHKPVVCCALHDGAESAPS

SEQ ID NO: 16170 - protein, 97 aa, Glycine max
DDPLFKLVSKLYEVVPPMRIELGKVKNPWPNVDAHSGVVLNHFGLTEAKYFTVLFGVARSIGVGPQLILDRILGLPLERPKSVTMAWLEEYCKNAAK

SEQ ID NO: 16171 - protein, 388 aa, Arabidopsis thaliana
MLSSIKPSSSSFSTAISGSVRRSIPTKLKFSPLLIIKNCHNQSFNANVVSHQKPLHISSASNFKREVKVEAYEADRSRPLDINIELPDEQSAQKLKIGIYFATWWALNVVFNIYNKKVLNAFPYPWLTSTLSLACGSLMMLVSWATRIADAPKTDLEFWKTLFPVAVAHTIGHVAATVSMSKVAVSFTHIIKSGEPAFSVLVSRFFMGETFPLPVYLSLLPIIGGCALAAITELNFNITGFMGAMISNLAFVFRNIFSKKGMKGKSVSGMNYYACLSMMSLVILTPFSIAVEVPQMWAAGWQNAVSQVGPNFVWWVVAQSVFYHLYNQVSYMSLDQISPLTFSIGNTMKRISVIVASIIIFHTPIQPVNALGAAIAIFGTFLYSQAKQ

SEQ ID NO: 16172 - protein, 483 aa, Caulobacter crescentus CB15
MDDALAHLPRAFAGKTVLVLGDVMLDRFIYGAVDRISPEAPVPVIAVEKETAMLGGAGNVARNVAALGAKAVLIGLVGRDDAGAALRGMIDAEAGLEAELVVDPARRTTEKVRYISGSHQMLRVDREDRSPGDGAALLAAFETRLASADVVVLSDYAKGVLTPAVVRGAIDAAKAAGKPVIVDPKSRDFARYDGATLIKPNRKEAAEATGIVETSDAASEDAGAAILAMAPGLQAALITRGGAGMTLAVRNQPPIHLPATAIEVFDVSGAGDTVAATLALAVAAGASLAQAAQLANLAGGLVVAKLGTDVVTAAELTACASSAQGEPGEIKIADREQAQRIVEGWRARGLKVGFTNGCFDLLHPGHVSLLSQAKAACDRLIVGLNTDASVSKLKGPTRPVQKEQGRATVLASLSSVDLVVLFDEDTPLELIKAFRPDVLVKGADYTVETVVGSDVVLGYGGKVVLAELKQGQSTTNLIARMNS

SEQ ID NO: 16173 - protein, 1072 aa, Photobacterium sp. SKA34
MPKRTDIKSVLILGAGPIVIGQACEFDYSGAQACKALREEGYRVILVNSNPATIMTDPDMADATYIEPIHWEVVRNIIAKERPDAVLPTMGGQTALNCALDLEKYGVLEEFNVEMIGATADAIDKAENRSRFDKAMKAIGLECPRADTATTMEEAYKVLEMVGFPCIIRPSFTMGGTGGGIAYNKEEFEEICSRGIDLSPTNELLIDESLIGWKEYEMEVVRDKNDNCTIVCAIENFDPMGIHTGDSITVAPAQTLTDKEYQLMRNASLAVLREIGVETGGSNVQFGINPKDGRMVIIEMNPRVSRSSALASKATGFPIAKIAAKLAIGFTLDELMNDITGGATPASFEPTIDYVVTKIPRFNFEKFAGANDRLTTQMKSVGEVMAIGRNQQESLHKALRGLEVGANGFDEMVDLDDPNAMSKIRHELKEAGAERIWYIGDAFRAGMSVDGIFNLTNIDRWFLVQIEDIIKLEEQVKAGGFAGLNADVLRKLKRKGFADARLAKLLGVSEGEIRKLRDQFDIHPVYKRVDTCAAEFSSDTAYMYSSYDEECEANPTDKDKIMVLGGGPNRIGQGIEFDYCCVHASLALREDGYETIMVNCNPETVSTDYDTSDRLYFEPVTLEDVLAIARVEKPKGVIVQYGGQTPLKLARALEAAGVPIIGTSPDAIDRAEDRERFQQAVDRLGLLQPENATVSTMEQAIEKSRDIGFPLVVRPSYVLGGRAMEIVYDEQDLRRYFNEAVSVSNESPVLLDRFLDDAVEVDVDAICDGEQVVIGGIMEHIEQAGVHSGDSACSLPAYTLSQEIQDVMREQVKNLAFELGVRGLMNTQFAVKDGEVYLIEVNPRAARTVPFVSKATGAPLAKIAARVMAGQSLESQGFTKEIIPPYYSVKEVVLPFNKFPGVDPLLGPEMRSTGEVMGIGNTFAEAFAKAELGCSKEYPEGGRALLSVREEDKQRVVDLASKLTKLGYQLDATHGTAVILGEAGINPRLVNKVHEGRPHILDRIKNNEYTYIVNTAAGRQAIEDSKVLRRGALAEKVNYTTTLNAAFATCMAHTADDRNTVTSIQELHARIK

SEQ ID NO: 16174 - protein, 499 aa, Arabidopsis thaliana
MATRLLRTNFIRRSYRLPAFSPVGPPTVTASTAVVPEILSFGQQAPEPPLHHPKPTEQSHDGLDLSDQARLFSSIPTSDLLRSTAVLHAAAIGPMVDLGTWVMSSKLMDASVTRGMVLGLVKSTFYDHFCAGEDADAAAERVRSVYEATGLKGMLVYGVEHADDAVSCDDNMQQFIRTIEAAKSLPTSHFSSVVVKITAICPISLLKRVSDLLRWEYKSPNFKLSWKLKSFPVFSESSPLYHTNSEPEPLTAEEERELEAAHGRIQEICRKCQESNVPLLIDAEDTILQPAIDYMAYSSAIMFNADKDRPIVYNTIQAYLRDAGERLHLAVQNAEKENVPMGFKLVRGAYMSSERSLADSLGCKSPVHDTIQDTHSCYNDCMTFLMEKASNGSGFGVVLATHNADSGRLASRKASDLGIDKQNGKIEFAQLYGMSDALSFGLKRAGFNVSKYMPFGPVATAIPYLLRRAYENRGMMATGAHDRQLMRMELKRRLIAGIA

SEQ ID NO: 16175 - protein, 493 aa, Ralstonia metallidurans CH34
MSHPHPHQHPVVEHDDLHRKLKARHLTMIALGGAIGTGLFVASGASIAQSGPGGALLAYCLIGLMVYCLMTSLGELAVHMPVAGSFVTYSALYVDEGFGFALGWNYWFSLAVTIAVELTAAQLVMQYWFPEVPGIYWSAGFLALMFALNAFSVKGFGEAEYWFAMIKVVTVVVFLCVGVLMILGILKGGPQSGWHNFTTGEAPFVGGLPGLFAVAMIAGFSFQGTETVGVAAGEAADPGRTIPRAIRQTFWRILLFYVVAILIIGVLIPYTDPNLLRNDVTDVGVSPFALVFQHAGLAFAAALMNAVVLTALLSAGTSSMYVSTRILYGLAVSQRAPRALAKLTPNGVPFNALLVTTGIGALCFFSSLFGDKAVYLWLLNTSAMTGFFAWLGIAVSHYRFRKGLLYQGYKVSDLAYRSPLYPFGPIFAGVLCLVIVGGQNYQAFTDIPGRWQEIVSTYIGVPVFLALWLGYRIVRGTRMIDYEDMPFELVKKD

SEQ ID NO: 16176 - protein, 484 aa, Oryza sativa (japonica cultivar-group)
LAGRDLMACAQTGSGKTAAFCLPVVSGLVAAGGSGIGHRERSSFNRAAAKPRALVLAPTRELAAQINEEAKKFSFQTGLRVVVAYGGTPMYNQLRDLERGADILVATPGRLVDMVERSKVSLEAIKYLVMDEADRMLDMGFEPQIRKIVERMNMPRKSVRQTMLFSATFPPEIQRLASDFLSNYIFITVGRVGSSTDLIMQKVELLSDGEKRGYLLDLLQRQSVGVANSKLQQPLTLVFVETKREADSLRYWLYSKGFPATAIHGDRTQQERESALRSFKTGLTPIMVATDVASRGLDVPNVAHVINYDLPKSIEDYVHRIGRTGRAGKAGSATAFFTESDHSLAKGLLELMTEAKQDVPDWLVQYAERPYYGGSSYGGRNRRSGGGGNRFAGRDFRQGSGGGYSGGGGGGGYSGGGGGGGYSGGGGGYSGGGRGGGYSRGGRGGYSGGGGGGGGDPYRASAPPPRYYPSYPMGTADINASGWD

SEQ ID NO: 16177 - protein, 175 aa, Solanum tuberosum
MASKMCEPLVIGRVIGEVVDNFCPSVKMSVVYNNNKHVYNGHEFFPSSVTSKPRVEVHGGDLRTFFTLVMIDPDVPGPSDPYLREHLHWIVTDIPGTTDCSFGREVVGYEMPRPNIGIHRFVFLLFKQKKRQTISSAPVSRDQFSSRKFSEENELGSPVAAVFFNCQRETAARRR

SEQ ID NO: 16178 - protein, 896 aa, Arabidopsis thaliana
MSITIPYDGSISREPSPSPPPPKANTKNLPTKILSNFLIGLIMIPVAITAFIFILTSLGFTFFFAFYWFLQRNYRHRLRRHRRHEYSDGLSPRCVKRLPQFKYCEPSSEYGGDDCVVCIDGFRQGQWCRKLPRCGHVFHRKCVDLWLIKVSTCPISILVFINSHICLLELELELLLMELRKDKLLMFYSEGKESKEAKWAVNDPMSKSYKLSLPSALRPDNLLPGNRLRYTDASKSKSSKVSWYKTILDPGSEIVLKWNWVFIVSCMVALFIDPLYFFVPAIGGDKNYPCARTDTSLSILVTFFRTIADLFYLLHIFIKFRTGFIAPNSSTRVFGRGELVMDPKAIAWRYIKSDFIIDLIATLPLPQIVIWFVISTTKSYRFDHNNNAIALIVLLQYIPRFYLIIPLSSQIVKATGVVTKTAWAGAAYNLLLYMLASHVLGAAWYILSVDRYTSCWKSRCNGEAGQVNCQLYYLDCDSMYDNNQMTWANVTKVFKLCDARNGEFKYGIFGNAITKNVVSSQFFERYFYCLWWGLQQLSSYGQNLSTTMFMGETTFAVLIAIFGLVLFAHLIGNMQTYLQSLTVRLEEWRLKKRDTEEWMRHRQLPEELRNRVRRYEQYKWLATRGVDEEVLLQSLPTDLRRDIQRHLCLDLVRRVPFFSQMDDQLLDAICERLVSSLCTEGTYLVREGDLISEMLFIIRGRLESSTTNGGRTGFFNSIILRPGDFCGEELLSWALLPKSTLNLPSSTRTVRALVEVEAFALRAEDLKFVANQFRRLHSKKLQHTFRFYSHHWRTWAACFIQAAWRRYKRRVMENNLTAIESMENEEGEVGEELVVVEEEECVEESPRTKMNLGVMVLASRFAANTRRGVAAQRVKDVELPRFKKPEEPDFSAEHDD

SEQ ID NO: 16179 - protein, 200 aa, Triticum aestivum
  misc_feature (100)..(100): Xaa can be any naturally occurring amino acid
  misc_feature (168)..(168): Xaa can be any naturally occurring amino acid
  misc_feature (187)..(187): Xaa can be any naturally occurring amino acid
HYRTSLYKKAGWYRSGIPGISSTHASEEIDKEIEDKKTELEPKVVETIEASPPEIKGLIKDKKTSKIRKNSVAVTKFLDDLAKIDFPGAKLVSDAVAKSXTTPLSPAIVFILDKVAPFVPAPKEEPKVEPEVAAAAPAEETTTREVAVEEEKKEEAEPSAAPAEAAAXGKAAPPAEVVEEKKEGKPXEAAAPAAEDPKKK

SEQ ID NO: 16180 - protein, 337 aa, Zea mays
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFLGDSRSSIFDAKAGIALNDHFVKLVSWYDNEWGYSNRVVDLIRHMFKSQ

SEQ ID NO: 16181 - protein, 535 aa, Oryza sativa (japonica cultivar-group)
MVVLAVDEGYGHGGAVPDWIGYEVDGRRCGRAVKMLLAVEGGGFFSSSASGYSHGLALLLLGRKDEEKPVKVSPWNQYRLVDREAEQVYHLASRKDQAPGKCAPFICFGRAAAGLEGASPPKLSSGNTSGSSSEESSASANEGTNGSLTGNEKKGCLKSNSRRDSLEHCIVVSEGEEPRESLEEVQTLKSGMERRKVQWTDTCGKELFEIREFEARYTVTLSDLLVIISTVMKVCQTMIRKMRVSGNGKIPVDSRQGVMVDLMPFAELFAGDMGQSDGAECLNVLRPCRVPESLTSHNPNKLAIIHNPKLCSSAEALAALHHLCLETRFSLGSWAPPHTLIHTGAAQEAMSLAPSIPSIKVKVGGVAAVAVSPPRHRACRSSFAVIRSSKAEGAPRRPAAPPLSPPPKTPTLSTPPTLSQPPTPVKPAAPSSSPPPSQDPEPKQAAAPVAVAAPAAAGAVTLEYQRKVAKDLQDYFKQKKLDEADQGPFFGFLGKNEISNGRDANRVRNRLGFCSTSEDPSLQFWDCGFGLIADV

SEQ ID NO: 16182 - protein, 186 aa, Brucella melitensis 16M
MKGLKMESGFKVTLKDAIRTIPDYPKPGVQFRDVTTLMGNAQAFRRAVDELVYPYAGNRIDKVAGIEARGFILGGAIAHQLSAGFVPIRKKGKLPRDTVRIAYSLEYGVDEMEMHRDAIEKGERVVLVDDLIATGGTAEAAAKLLLQMGAEIVAACFIIDLPDLGGRKKLEALGLPVRTLVAFEGD

SEQ ID NO: 16183 - protein, 236 aa, Zea mays
ARGTAGAYSLVRVFDELTERRLIEKSLSRKVVHVLSGVLFMSSWPLFSNSTEARYFAAVVPFLNSMRLLIYGLRLYTDEALVKSVTREGKPEELLRGPLYYVLVLLFSVLVFWRESPIGIVSLSMMSGGDGFADIVGRRYGSAKLPFNRKKSWAGSISMFISGFLLSAMMMLYFSSLGYIDVIWEEALGKLALVALAATVVECVPVTEVVDDNISVPLATMLVAFLLFSSNRTIVN

SEQ ID NO: 16184 - protein, 306 aa, Vibrio angustum S14
MSKLVVLGSVNADHVLQVPSFPRPGETLHGRNYQVIPGGKGANQAVAAARLNADIGFIACVGDDAFGMLMHDNFVKDGIDVSGVKTEVGTPTGIAMIQVSDCGENSICLSAEANNKLTEQAIESDLDTIRQAEYLLMQLETPMCGIEKAAKVAKSANTTVILNPAPARELSDELLACVDVITPNETEAEVLTGVTVTDNQSAQQAADILHGKGIKTVMITLGAKGVWLSQNGSGDIISGFRVEATDTTAAGDTFNGALVTGLLEDLALESAIKFAHAAAAISVTRFGAQTSIPTREEVDLFLAQHA

SEQ ID NO: 16185 - protein, 575 aa, Arabidopsis thaliana
MRAKNTITWNSLLIGISKDPSRMMEAHQLFDEIPEPDTFSYNIMLSCYVRNVNFEKAQSFFDRMPFKDAASWNTMITGYARRGEMEKARELFYSMMEKNEVSWNAMISGYIECGDLEKASHFFKVAPVRGVVAWTAMITGYMKAKKVELAEAMFKDMTVNKNLVTWNAMISGYVENSRPEDGLKLFRAMLEEGIRPNSSGLSSALLGCSELSALQLGRQIHQIVSKSTLCNDVTALTSLISMYCKCGELGDAWKLFEVMKKKDVVAWNAMISGYAQHGNADKALCLFREMIDNKIRPDWITFVAVLLACNHAGLVNIGMAYFESMVRDYKVEPQPDHYTCMVDLLGRAGKLEEALKLIRSMPFRPHAAVFGTLLGACRVHKNVELAEFAAEKLLQLNSQNAAGYVQLANIYASKNRWEDVARVRKRMKESNVVKVERVKVPGYSWIEIRNKVHHFRSSDRIHPELDSIHKKLKELEKKMKLAGYKPELEFALHNVEEEQKEKLLLWHSEKLAVAFGCIKLPEGSPIQVFKNLRICGDCHKAIKFISEIEKREIIVRDTTRFHHFKDGSCSCGDYW

SEQ ID NO: 16186 - protein, 383 aa, Zea mays
EFSGLRSSASLPMRRNATSDDFMSAVSFRTHAVGTSGGPRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVCDVPLVSVDFRCSDVSSTIDASLTMVMGDDMVKVISWYDNEWGYSQRVVDLADICANQWK

SEQ ID NO: 16187 - protein, 521 aa, Debaryomyces hansenii CBS767
MFKNSIAKQARSNVAYAKSFIRMSSNLPLQVSIKLPNGTTYEQPTGMFINNEYVYPKQKKTFDVISPSTEEHITDVYEALEEDIDTAVEAASAAFKSSWSTGDPSVRANALLKLADLVDANADTLAHIEALDNGKSLMCSRGDVALTAMYFRSCAGWADKILGTVPETGSTHFNYTRREPIGVCGQIIPWNFPLLMLAWKVGPATATGNTIVLKTAESTPLSGLFLTGLIKEAGFPPGVVNILTGFGKNAGNAIASHPKIKKVAFTGSTATGRHIMKSAAESNLKKVTLELGGKSPNIVFNDADVQKSAQSLITGIFYNTGEVCCAGSRIYVQEEIYDNVLEELKNASSKIKIGNPFEEDTFMGAQASSQQLDKILKYIETGKNEGAKLISGGERVQGKGYFIKPTIFGDVTEDMQIVKEEIFGPVVTITKFKTIDEVVDLANDSEYGLAAGIHTENINTAIGVANRLQAGTVWVNTYNDFHPMVPFGGYGQSGFGREMGAEALDNYTQVKAVRIGLTEKH

SEQ ID NO: 16188 - protein, 219 aa, Triticum aestivum
MDSEHWISRLAAAKRFYAAQLGHADRAGMDELDMDGDENAGRPDFACPYCYEDHDVASLVAHLEEDHPFEPHAAPCPVCSEKVSKDMLNHITMQHGYLFKNRRRLRRFAVPGSQSLSLLSRDLREAHLQVLLGGGGHRSSNNNATNISADPLLSSFGLSFPTLDAEETSKLSTPAQSDVPVLKEAAARPWRSSIDSSLTREEREQASQRESGMLARPML

SEQ ID NO: 16189 - protein, 324 aa, Zea mays
MTIALETLQLQQIQQTLAEIKERTPDVNISRFVASVLGDWMETEYATSERKRGDAGHGRGAGPSDARPCAPTLEMDWAACVLPLHGEDAHFGHAEAGVVGVADGVGGYRDNGVDAGAFARALMANALASAERVAKASRRLRRLCPEKVLERAHKKAAADETPGASTAVILALHGTALTWAYIGDSAFAVLRGGKIICRSVQQQRRFNYPYQLSSEGSGGGLDDAKVGSMPAARDGDVVVVGTDGLFDNVHDWQLERAVRMGTNLGFSPKNMADIIAGIAYGISKDKWACTPFGMGYMKVHGLARRGGKKDDITVIVAHIVSKGS

SEQ ID NO: 16190 - protein, 87 aa, Arabidopsis thaliana
ANEDGYHQDAFLAASMLSSAAEVTSPGGATMIAQFTGLTQCPGFPVTRKTTTDLTFIPSNGGRVRCMKVWPPIAKKKLETLYYRRDL

SEQ ID NO: 16191 - protein, 250 aa, Salmonella enterica subsp. enterica serovar Typhi str. CT18
MAVTKLVLVRHGESQWNKENRFTGWYDVDLSEKGVSEAKAAGKLLKEEGFSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNDTILPRMKSGERVIIAAHGNSLRALVKYLDNMSEDEILELNIPTGVPLVYEFDENFKPIKHYYLGNADEIAAKAAAVANQGKAK

SEQ ID NO: 16192 - protein, 497 aa, Arabidopsis thaliana
MEISVSSVTFSLAVVVVSWWVWRTLKWVWFTPKMLERSLRRQGLSGTSYTPLIGDFKKMISMFIEATSKPIKPTDDITPRVMPHPLQMLKTHGRTNLTWFGPIPTITIMDPEQIKEVFNKVYDFQKAHTFPLSKILGTGLVSYDGDKWAQHRRIINPAFHLEKIKNMVHVFHESCSELVGEWDKLVSDKGSSCEVDVWPGLTSMTADVISRTAFGSSYREGHRIFELQAELAHYLPTKGNRRMKTAAREIQDILRGIINKRERARESGEAPSEDLLGILLESNLGQTEGNGMSTEDMMEECKLFYLAGQETTSVLLVWTMVLLSQHQDWQARAREEVKQVFGDKQPDTEGLNQLKVMTMILYEVLRLYPPVVQLTRAIHKEMKLGDLTLPGGVQISLPVLLVHRDTELWGNDAGEFKPERFKDGLSKATKNQVSFFPFGWGPRICIGQNFALLEAKMALALILQRFSFELSPSYVHSPYRVFTIHPQCGAHLILHKL

SEQ ID NO: 16193 - protein, 727 aa, Pseudomonas syringae pv. tomato str. DC3000
MNTKSTPAADESSASHDSSASTPTRIREGLPFPLGASWDGLGVNFALFSANATKVELCLFDSTGEVELERIELPEYTDEIYHGYLPDAHPGLIYGYRVYGPYDPKNGHRFNHNKLLIDPYAKQLVGELKWSEALFGYTIGHADGDLSFDERDSAPFVPKSKVIDEAYTWGRDQRVGTPWDKTIFYETHVRGITMRHPEVAEELRGTFAGLGSAPVVDHIRKLGVTSVELLPIHAFVNDQHLLQKGMTNYWGYNSIAFFAPDPRYLASGKIAEFKEMVAHLHHAGLEVILDVVYNHTAEGNELGPTLSMRGIDNASYYRLMPDDKRYYINDSGTGNTLDLSHPCVLQMVTDSLRYWASEMHVDGFRFDLATILGRYHDGFDERHSFLVACRQDPVLRQVKLVAEPWDCGPGGYQVGGFPPGWMEWNDKFRDTVRAFWKGDEGQLADFAARMTASGNMFNQRGRRPQASVNFITAHDGFTLHDLVSYNDKHNEANDENNQDGSNNNVSWNHGVEGPTEDPEINTLRLRQMRNFFATLLLAQGTPMIVAGDEFARTQHGNNNAYCQDSEIGWINWDLDEDGEALLKFVTRVIKLRQSYPILRRSRFLVGDYNEEIGVKDVTWLAPSGEEMSVEQWHDANGRCLGMLMDGRAQETGIRRPGADATLLLVVNSHHDGVNFTLPQVPEGTHYECLIDTNQDDARSKEQFAFGSHYTVTPRSLLLFEVKREDQQ

SEQ ID NO: 16194 - protein, 327 aa, Burkholderia vietnamiensis G4
MNSSIQVAPGVTAAGGLSAADGQIPGVSPLLGSGARVKRLTALAVMLVPLAGFALAVRQLVLGEFAATDLVLFAVFYFLHMGGITMGFHRYLAHKTFRTSKWFEGLLLICGSMAAQGPIMFWVTTHRRHHLYSDQQGDPHSPNLAGKGLFAKLRGLWYAHMPWMLAPDVSGWTFFAPDVLRDRRLFFYHRTYAWWIVLGLVLPAAIGGAVAGSWLGAWNGLLFGGLARIFVANQAAWCVGSVCHMFGGRPFKTGDNSANNWTVAVFTFGEGLQNNHHAFPASYRHSVKWYEPDLSAWVLWTLGKLGIVRDLRQPTPAAIRKLAKQPY

SEQ ID NO: 16195 - protein, 319 aa, Burkholderia vietnamiensis G4
MAEADLSSSRTPAAARAADADTDSRARRLAYLTVGVPALGFVLAIAYTWTYGVRATDFILLAVMYFSTAIGVETGMHRYFSHRAFKGRPIVTVMLGVFGSMAAQGPILFWAATHRMHHAFTDQDGDPHSPLPRANRHGRPSRLAGLWHGHVGWLFSVRRENWSAYAADLLRDRLIVNLNLRYGWWVLLGLALPALAGALLAPAGQALTGAVGGFLWGGLARIFLLDQSTWAVNSLCHTIGTRPHATRDHSRNLGLLAIVSVGGAWHNNHHAQPAFANNDHAFWQLDPSAWVIRLLDALGLVTEVRYAPKRRATVPSISP

SEQ ID NO: 16196 - protein, 364 aa, Debaryomyces hansenii CBS767
MNIFRRKDTSTSSLSNSTSEAASVSSKSSTASTTTSKKGSKLIKCHTPFDKPVNPVKPPVFDLSEEEQKKYDEVLKHFQEHVKKDLPVNDQAGAAKHAVLDEEIAWLTKECFLRYLRASKWRLETAIKRIEETLIWRRTFGVVEIPQHTDPKIIITPELVEEENVTGKNLIVGYDNDNRPCLYLRNGYQNTSPSIKQVQHLVFMLERVIQFMPPGQDTLALLIDFKAAPAHMNLSSKFPSLSISKQVLNILQGHYPERLGKGLFTNIPWIGYTFFKVVGPFIDPYTRLKTIYDQPFENFVPKEQLDKEFNGNLDFEYIHDVYWKEMNVMAERKRENYVKNFHRLGAKVGLSEYDLRLIHNDDSQ

SEQ ID NO: 16197 - protein, 182 aa, Fusobacterium nucleatum subsp. nucleatum ATCC 25586
MKTYVFLADGFEILETFAPVDVLKRCGAEVVTVSTEKDLFVASSQKNIVKADAMLSDIDYKTADLIIIPGGYPGYVNLRENKEVVDIVKYFLDNDKYVASICGGPTIFSYNNLANGTKLTGHSSTKEELSKNHIYVDVPTHIDRKIITGVGAGQAINFAFKIAEQFFDKEKIEEVKKGMEII

SEQ ID NO: 16198 - protein, 104 aa, Methanosarcina barkeri str. Fusaro
MPDADLSILNRVYEIILDRKQNYDERSYVCKLLNHRKGMNKILEKVGEESIETILAVRNENHEEIVSESSDLIFHLLVMLAANNVTLDEIAAELSARHESMKRD

SEQ ID NO: 16199 - protein, 116 aa, Brassica oleracea var. alboglabra
IPAGEVIACHTVEDWNNKLKAAKESNKLIVIDFTAVWCPPCRFIAPIFVELAKKHLDVVFFKVDVDELATVAQEFDVQAMPTFVYMKGEEKLDKVVGAAKEEIEAKLLKHSQVAAA

SEQ ID NO: 16200 - protein, 359 aa, Methanosarcina mazei Go1
MDLHSSFKDFWTECSRVSAILWCKSDKKYRQRLRSVLSIADNSLLSPRLMSITETELKKMENLPGESQGGESQGIQKAAPFSYDPAQGVLKIQDKRLEILPLFMAVRDLYSSLPFFDELKSCTEMLEKDPRNATALFQKSLLLYKAGRFENSLKFIEQVLEIVPDDFRVWYNKGVILSDMVLLKEALDAYDRAIELEPSFEIVWDNKGVVLAGLGRLEEALETYEKVLLRDPKYAEAWAGKGSVLSALDRKEEALEAYSSALKIRPDYPEALKAAGNLLFKLGRYEKALSTYDMALQASPEDPQLWAGRGLVLSELNKQEEALQNCNRALELKPGFNPALEIKVEILSRISRQKAEKSR

SEQ ID NO: 16201 - protein, 493 aa, Methanosarcina mazei Go1
MCGIAGMFGTPDSNTKVKKMLAILGHRGPDACGIHTEGKLSIGNTLLKITGDMPQPLTGTGSLVLNGEIYNFRELAAEIGLKTDSDTELLFTLIERKVRKGIKPTNAVFSVLSKVNGDYALAYACGTELVLARDPSGVKPLYYFYEKSMVKPGLAFASEKKALAFTGREVKPFPQGGIMGFSTENGKIAEKFTEKSLKITQPEKRISAEKEAIIYLKAALEKAVELRLTPVSGIAFSGGIDSTFLAALAKRIDPYVSLYAVGLPDSHDIAQAEYAAEAIGMKRNLKTHFLSPEEIEAAVPEVIYATESTDPMKVAIGLPLHIVAKTAREEGKRVLLTGQGADELFGGYSRHEGFFEQGADVLDREIYSDLENISAINLERDDMVAMANSVELRVPFLDKEVIKTGLAISPELKVRKKEGVYIRKYILRKAAEGLLPPKILWKEKKAVQYGTGVQKTLDRLARDSGFSKKQGGHIEKYLSQIASEKGFDFINEM

SEQ ID NO: 16202 - protein, 361 aa, Debaryomyces hansenii CBS767
MFSGFGSAMFGASQFAPMNSNFEDYFRSYPVAMMPDHIRKDDANYGGKIFLPSSALNKLTMLHIRYPMLFELSNEASGVTTHSGVLEFVAEEGRAYLPQWMMSTLQLSPGLLLKISNCDLPLGNFVKIEPQSVDFLDISDPKAVLENVLRNFSTLTVNDIIEINYNDSIFGIKVLEAKPESSSRGICVVETDLETDFAPPVGYVEPEYKPQAKKPTTNAIDPSSVNRSAGAGTMAKSLNYANLVAESSNPATKAFQGSGQSLSGKPTTEREQVKENHTIDDLDPDAEPVPLDLPSNQLFFGFPVVLPTPEESEEENANQASQDAFSGSGQSLRQSKKRKDKTSNHPSLKNHSRSPDYIEID

SEQ ID NO: 16203 - protein, 188 aa, Oryza sativa (japonica cultivar-group)
MAIAGDDSNHGVDDARIARIAAAITVFPGFPKPGISFQDVTGIFHKPEVFRDAIGLFVERYKGKGVTLVAGIEARGFFFAPTIALEVGAKFVPLRKPRKLPGEVISEEYSLEYGTDKIEMQIGAVEPNDRAIIVDDLIATGGTLCAAVKLLERAGAEVVECACVVELQELKGREKLGKIPVFVLVETN

SEQ ID NO: 16204 - protein, 505 aa, Triticum aestivum
  misc_feature (229)..(229): Xaa can be any naturally occurring amino acid
  misc_feature (431)..(431): Xaa can be any naturally occurring amino acid
  misc_feature (470)..(470): Xaa can be any naturally occurring amino acid
MIKQILGRLPKKTGKAGDGRDAATANGNEPSNSYSVARSVEPGGNKRAGNGEHLPPAGSASTPAMNGAVVYHSNEPLPAFKDVPVSEKQNLFVRKATLCCAVYDFADPTKNLKEKEMKRQTLMELVDYVTSANGKFSEIIMLEISKMVAINLFRSSNPTPRENKAIEGVDMEEEEPLMDPAWSHLQIVYEVFLRFVASQETDAKLAKRYIDHSFILKLLDLFDSEDPRXERDYLKTILHRIYGKFMVHRPFIRKAINNIFYRFIFETEKHNGIAELLEILGSIINGFALPLKEEHKLFLLRALIPLHKPKCVAMYHQQLSYCITQFVEKDCKLADTVIRGLLKYWPITNSSKEVMFLGELEEVLEATQLAEFQRCMVPLFRQIASSMNSSHFQVAERALFLWNNDHIENLIKQNYKVILPIIFPALERNAXGHWNQAVRSLTLNVRKIFTDHDSAFFGECMQKFDDDEAXKQEESSSKREVLWKRLEEMGGESSPSGIPNGKSSQ

SEQ ID NO: 16205 - protein, 243 aa, Brassica napus
  misc_feature (124)..(124): Xaa can be any naturally occurring amino acid
  misc_feature (143)..(143): Xaa can be any naturally occurring amino acid
MGSLPPPHLDFSSANHGNEHHHHQEISKDNLLALFKSQQDLLNYFFKHLDLSQTLDFSRILLSTSGTVFFTGVGKSAFVANKISQTLISLSFRSSFLSPLDALHGDIGALSSRDVLVLFSKSGXTEELLRLVPCAKARGAFLXSLTSVPGDPLAGVCDMNVHLPLQRELCPFNLAPVTSTAIQMVFGDTIAVALMAARNLTKGEYGANHPAGRIGKSLIFKVKDVMKKKEELPVCKEGDLIMD

SEQ ID NO: 16206 - protein, 315 aa, Silicibacter sp. TM1040
MSETVNVMDYEKLIDEETWNFIRETGRHYPDDTVDLTIDDQRAVYNKMAAAFRKPRAEVVDVTERSVGRVLVRIYEAGDPTRTVMYCHGGGFVVGDLNSHDDVCSEICEQTGYRVVSVDYRLAPEHKHPAQFEDAWTVLDWICETYPGGVVLAGDSAGAMLSACVAHHARGRHEGVLGQVLIYPGLGGDHALPSYREHAQAPMLTLEDVKYYADVRADGTPVENDPTYAPLQDDDFAGLPPTVMFSADCDPLRDDCLVYRDAIHAAGGLAEWINEAGLVHGYLRARHSVGRARDGFERIVLAIEGLGQEIWPYDD

SEQ ID NO: 16207 - protein, 369 aa, Malus sylvestris
MEDGAGRGLECQKTMDGKGSNGNGSEKAIPSCCLKAMASTPEAEAKCHSTVVSGWFSESQSRSEKDCKKVYFNNPMWPGEAHSLKVENILYRGKSEYQEILVFESSIYGKVLVLDGIIQLSEKDECAYQEMIAHLPLCSISSPKTVLVVGGGDGGVLREVSRHPSIEHIDICEIDKMVIDVSKKFFPQLAVGFQDPRVHLHVGDATEFLRLAPEGKYDAVIVDSSDPVGPAQELVEKPFFETIARALRPGGVLCNMTESMWLHTHLIQDMISVCRQIFKGSVNYAWASVPTYPSGVIGFLLCSTAGPPVDFKNPVNSIEKLERALKHKRELKFYNSEMHSAAFALPPFLRREVSALRESSTPARQIGEK

SEQ ID NO: 16208 - protein, 447 aa, Cryptococcus neoformans var. neoformans JEC21
MTLLTGSRITQSFLLTVKTRKPQCLCLLQSEQGKRMSTNHAAVHKGKPPPSRSAPAIIDMQSTTEEPPLGESELFLRTRDEALNTPGMKFADGHGLKGPTGKGRQTRKMNLYQAIRDALGTALAKNPKSFVFGEDVETGVFRCTTGLVDEFGKRRVFNTPLTEQGIAGFGIGLASVGGCAIAEIQFGDYIFPAFDQLVNEAAKQRYASGGSYPPVGGSLTIRAPIGSVGHGGLYHSQSPEGFFLGAAGLKIVIPRSPIQAKGLLLAAIRDPSPTLFFEPKILYRAAVEEVPIDDYTIPLGQAEVIRKGADLTVVSYGTPLHICLRAINMLQQPPSSILGSLPPGLRPPQPAPSIELIDLRTINPLPLEDLVSAVRKTGRLVIVHEAGRSGSVGNNIAGEVGRRAFEYLEAPVGVVSGWDTPVPLSFERFYQPDVIRVFDKLVETLSY

SEQ ID NO: 16209 - protein, 258 aa, Oryza sativa (japonica cultivar-group)
MDLHGIRGKVALNPVLKLPQGELVVFTDQFEPGIGRRTSAGLQHLLQELLRLKMQGITKALRFHGKQLKLTVLQHMNKGIFSWATLISRIQTESPTVIIPHIGLENIRVREILNAKGEAKAGAVYWCCTSHFVHEAIKHMTAHNVGALVVLKSGDEKQLAGIVTERDFARKILLPGRPSEETRVGDIMTEEDKLITVSSNTNILQAMELMTERHIRHVPVFDEKVVGMITIGDVVKTIVDQQHQEVKQLKKYIRGDYY

SEQ ID NO: 16210 - protein, 186 aa, Xanthomonas oryzae pv. oryzae KACC10331
MTDCSRCAGTNASGPNHWSERIRDIVDFPKPGIVFKDITPLLSDGPDFASALDEMAQPWRTTPLDAVLGIEALGFILGAALARELRTGFVPVRKPGKLPGRTLIREYALEYGTDRIEMHEGALPRGARVLIVDDVLATGGTLRAALGLAAQLELEIVGAAVLVELLALQGRQKWADDVPLLATLSF

SEQ ID NO: 16211 - protein, 324 aa, Xanthomonas oryzae pv. oryzae KACC10331
MLPGRCHLGLCLPDPLRTRLVPITLPAILPILPMPSRASRWFRPALLLLGSLPLTACSSVFFGGINAASSRAGIVEHHDQVFDPAHGLALDVYQPRGAVDAPVVVFFYGGTWKRGSRANYRWVGRALARRGVVAMVADYRKYPQVGLHGFMSDAAGATAWSYRHAHEYGGDPKRMAVMGHSAGAHMAALLGTDARWLQAQGLKPYQLCGVVGLAGPYDFMPMTDPELVEIFGDAPAAQRQSQPVRYVGGDEPPMLLLHGDADRVVELQNSISLQQALKRRGDSAELKVYPGIGHLGILLALRQPPERSQVLSDTLQFVRQCRAH

SEQ ID NO: 16212 - protein, 308 aa, Sulfitobacter sp. EE-36
MILCCGEALIDMVAAPSLDGPDGFVPHSGGAVFNTAIALGRLGARAGMLTGMSRDMFGDQLADALKASAVDTTHIIRSDRPSTLAFVKLEDGQASYSFFDENSAGRMIRPEDMPALPSDITALFFGGISLASDPSASAYAALLERQGGPRAVMIDPNIRPLFITDAEGYRRRMAAMIRQADIVKVSDEDLNWLNPAPLTQAEKISAMLDTGPSVVIVTQGAAGAIATLADGTSITVPSVKTNVVDTIGAGDTFNAGFLAKLSELDLLTPEALGTLDPDVLRDAMTYGARVAAITVSRAGANPPWANEL

SEQ ID NO: 16213 - protein, 334 aa, Nostoc punctiforme PCC 73102
MERSRQSFTRFSQQQLYFYLVSCAILNNRRGDSEVVMSQIKRVAIVGGNHGNELTGVYLVKKFQQYPNLINRTSFETLPLLGNLKAIEEGKRYIDRDLNRCFTNQGLQNPQLSSYEDTRAKAIQQVLQPQNQPFVDVIVDLHSTTANMGLSLIFCDLNPFLLRLAAYLSSINPMVKVFVNQQSKEGGFLRSLCELGFVIEVGAVAQNILNAELFQQTEQLIYAILDYFEGCNQGNIPHTSSQLTFYQYIETIDYPRSDAYGGLQSGEIQAMIHPQLQFKDYEPLNPGDPMFLTFAGKDIFYEGESTVYPIFINEAAYYEKGIAMYLSQKLQEIV

SEQ ID NO: 16214 - protein, 141 aa, Triticum aestivum
  misc_feature (54)..(54): Xaa can be any naturally occurring amino acid
  misc_feature (70)..(70): Xaa can be any naturally occurring amino acid
  misc_feature (86)..(86): Xaa can be any naturally occurring amino acid
  misc_feature (103)..(103): Xaa can be any naturally occurring amino acid
  misc_feature (121)..(121): Xaa can be any naturally occurring amino acid
  misc_feature (137)..(137): Xaa can be any naturally occurring amino acid
  misc_feature (140)..(140): Xaa can be any naturally occurring amino acid
MAPTVMASSATSVAPFQGLKSTAGLPVSRRSNGASLGSVSNGGRIRCMQVWPIXEGIKNSETLSYLPPLXSTEASSKQVDYLIRSXKWVLASESSKVGFIFPXETTIPGYYDGRYWDMWNXMFGCTDPHRCQRVEEXKKXT

SEQ ID NO: 16215 - protein, 1072 aa, Vibrio angustum S14
MPKRTDIKSVLILGAGPIVIGQACEFDYSGAQACKALREEGYRVILVNSNPATIMTDPDMADATYIEPIHWEVVRNIIAKERPDAVLPTMGGQTALNCALDLERHGVLEEFGVEMIGATADAIDKAEDRSRFDKAMKSIGLECPRADTAKTMEEAYKVLDMVGFPCIIRPSFTMGGTGGGIAYNKEEFEEICSRGLDLSPTNELLIDESLIGWKEYEMEVVRDKNDNCIIVCAIENFDPMGIHTGDSITVAPAQTLTDKEYQLMRNASLAVLREIGVETGGSNVQFGINPKDGRMVIIEMNPRVSRSSALASKATGFPIAKIAAKLAIGFTLDELMNDITGGATPASFEPTIDYVVTKIPRFNFEKFAGANDRLTTQMKSVGEVMAIGRNQQESLHKALRGLEVGANGFDEMVDLDDPNAMSKIRHELKEAGAERIWYIGDAFRAGMSVDGIFNLTNIDRWFLVQIEEIIKLEEQVKAAGFAGLNADVLRKLKRKGFADARLAKLLGVSESEIRKLRDQFDIHPVYKRVDTCAAEFSSDTAYMYSSYDEECEANPTDKDKIMVLGGGPNRIGQGIEFDYCCVHASLALREDGYETIMVNCNPETVSTDYDTSDRLYFEPVTLEDVLAIARVEKPKGVIVQYGGQTPLKLARALEAAGVPIIGTSPDAIDRAEDRERFQQAVDRLGLLQPENATVTTMEQAIEKSRDIGYPLVVRPSYVLGGRAMEIVYDEQDLRRYFNEAVSVSNESPVLLDRFLDDAVEVDIDAICDGEQVVIGGIMEHIEQAGVHSGDSACSLPAYTLSQEIQDVMREQVKNLAFELGVRGLMNTQFAVKDNEVYLIEVNPRAARTVPFVSKATGAPLAKIAARVMAGQSLESQGFTKEIIPPYYSVKEVVLPFNKFPGVDPLLGPEMRSTGEVMGIGNTFAEAFAKAELGCGKEYPEGGRALLSVREGDKQRVVDLASKLIKLGYQLDATHGTAVILGEAGINPRLVNKVHEGRPHILDRIKNNEYTYIVNTASGRQAIEDSKVLRRGALAEKVNYTTTLNAGFATCMGHTADDRNTVSSIQELHARIK

SEQ ID NO: 16216 - protein, 545 aa, Methanosarcina mazei Go1
MPVITLHYEDLEKLTGTDKETIIKRVPMIGADIERVEDEYVDIEFFPDRPDLYSVEGAARAMRGFLDLETGLPEYEIKPYKVSISVSEDILKIRPFLGCAVVRGVKFTSSSIKSLMDLQEDLHWGLGRNRKKVSIGVHDLKNVKPPFRYMAVDPGFEFVPLDYTEKMSMTEILEKHPKGTRFAHLVSGFEKYPIILDADDNVLSFPPIINGTLTSVTEETTDLFIDVTGLGEAVYTALNIVVTALAERGGEIEFVRVIRPGGEELVLPDLEPEERLLTTGEVKSLIGMELPVEEIVKQLERMRFGACALDKETVEVRVPAYRADILHNYDLVEDIAKGYGYENIKVKIPETYTAGMSHPISLMRAPVNEIMVGLGYYEVMPFTLTSEKVNFENMCREKTDDVTYVLHPISEDQTMLRTTVLPNLLEILALNQHRELPQKIFEFGEVVSNETTGQHVAAVSIHPQANFTEVYEVVDAFMREMMLSYEVKESKDPAFLEGRRADVYVNGKKLGVFGELQPEVISKFSLGYAVVGFELDLNDLIGKNI

SEQ ID NO: 16217 - protein, 390 aa, Methanosarcina barkeri str. Fusaro
MRKEHYVFPLEDFVSRDDFNRIKKFSRGKETPFLTVDLQKIEQSYDELVEHMPFAKIHYAVKANPMDEVVLALKSKGSNFDVATVYELDQLLRLGVEPERISYGNTIKKEKDIEYAYEKGVRLYVTDSDSDLKKLARKAPGSRVFFRILTESDGADWPLSKKFGSHPDLIYKLILKAEKLGLEPYGLSFHVGSQQRDIGQWDNAISKCKYLFEAAAEKGIHLKMINLGGGFPAKYQAQAHDLETYAGEIRRFLHEDFGEELPEIIIEPGRSLVANAGIIVSEVVMISKKARFNQYKWVYLDIGKFGGLIETLDECIKYPIFCDKKGCAEEVILAGPTCDSMDILYEHHKYTFPHTMREGNRVYIFTAGAYTQSYSSVCFNGFPPLKAYLI

SEQ ID NO: 16218 - protein, 392 aa, Bradyrhizobium japonicum USDA 110
MSINIDSGQDSDQEHDDVMYPQVLPFVLIHAGCLAAIWSGVSWQAVAICVALYWLRMFGITAGYHRYFSHRAYATSRAFQFILAFLAQSSAQKSVLWWAAKHRHHHLHSDTAQDVHSPRHKGFVYSHLGWIFYRQHDATDLVKVSDLASYPELMWLHRLELLPAVVLAGLCFLIAGWSGLVVGFMWSTVVLYHATFCINSLAHVHGRRRYVTGDDSRNNWLLALLTMGEGWHNNHHAYQASARQGFYWYEVDLTYYALVALSWLGIVWDLKLPPRQVLRNEHRLGSRVVKQAAEQLAARFDPEHIALAIRTSIHETELSVRDALSLLQHRADLRLSSMPTREQLLAEAQRMFAKTISLDDIVDRAYELLHDSVGFLLATPALSANTNAKSGI

SEQ ID NO: 16219 - protein, 422 aa, Methanosarcina barkeri str. Fusaro
MKRESELKKELNLLEVTLVGIGDILGAGIYVLMGKAAGLAGNMVWFSFLFAGATATLSAFSYMELASMFPKAGAEYGFVRRAFGERIGLFIGLLVIYFVAITSSAVALGFGRYFSNLFGNGYLTGTLGLFILLSLIMVYGIKESARLAIFISFIEVSGLLIVIYTGLPYLGTVNYFETPDLAGIFKASTLIFFAFLGFEDIVRLSQETKEAEKTTPKALLIAIFFTVFLYMCVAITAVSMLDFRVLGLSGAPLADVVAISLGNKAFVLMSWIALFSTMNTVLVVMLGGSRIVYGMADSGALPRFLSRVHPGYRTPWVAILGVSFLSALFVLFRDVAIVANISNFMIFIIFFMVNLSLIKLRYTDPGRNRPFKVPLNIGRFPLLPFLGALSTVFLFFQLSLEVITYGLVFIGIGILIVLFRTR

SEQ ID NO: 16220 - protein, 199 aa, Epichloe festucae
MAQPGVQSLKCVVTGDGAVGKTCLLISYTTNAFPGEYIPTVFDNYSASVMVDGKPISLGLWDTAGQEDYDRLRPLSYPQTDVFLICFSIVSPPSFDNVKAKWYPEIDHHAPNIPIILVGTKLDLREDAATLDSLRQKRMEPVSYEQALACAREIKAYKYLECSALTQRNLKSVFDEAIRAVLNPRPQPSKHKKSKCSIL

SEQ ID NO: 16221 - protein, 421 aa, Brucella melitensis 16M
MRKTGPRPVTVNRACHLWRSIMAFLADALSRVKPSATIAVSQKARELKAKGKDVIVLGAGEPDFDTPENIKQAAIAAINRGETKYTPVSGIPQLRQAIVSKFKRENGLDYKPEQTIVGTGGKQILFNAFMATLNPGDEVIIAAPYWVSYPEMVAINGGTPVFVDTKIEDNFKLTAADLEKAITPKTKWLIFNSPSNPTGAAYTQAELKSLTDVLVRHPHVWILTDDMYEHLVYGDFVFTTPAQVEPSLYDRTLTMNGVSKAYAMTGWRIGYAAGPIELIKAMDMIQGQQTSGACSIAQWAAVEALNGTQDFIPANKKIFQARRDLVVSMLNQATGLQCPTPEGAFYVYPSCAGLIGKKTEAGKVIETDKDFVTELLETEGVAVVHGSAFGLGPNFRISYATSDELLEKACIRIQRFCASLR

SEQ ID NO: 16222 - protein, 189 aa, Arabidopsis thaliana
MGCCCCLPSIPESSRTIDEHLPLSRATPSSLSNAYSSPLSPPIPLAITNINLQTSPPKLPRTQGNSSEASPGLTQVVPEKKTWHVDDLTDFELKKQYREAIDECPICLEEYEIDNPKLLTKCGHDFHLACILAWMERSEACPVCDKVCVRLKSAIFTIHFELLESLESVLTIESTFWVFFSQELVLTES

SEQ ID NO: 16223 - protein, 421 aa, Ehrlichia ruminantium str. Gardel
MANVKINNISARQILDSRGYPTIEVQITLSNNVFAKASIPSGASVGKFEAVELRDHDTNYYHGYGVTKAVNLINSEIGQKIIKLETLDQEKIDNALIEIDGTNNKSRVGANSILAISLAVAKAAASTLNIPLYQYLGGITAKILPTPLINIINGGMHADNNLDFHEFMIIPHGANSFEDAIRMSSEVFHTLKKILKQKQYNTNVGDEGGFAPNIKDNTEVFDIIIDAIEKSGYKVYKDFSLGLDVAASTFYKNEKYKFSDYQFSTHELVEYYKNIVTQYPIISLEDPIAEEDTLGWKMITKELGDKIQIVGDDLFVTNCKLIKNGIDNNMANAVLIKPNQIGTLTETLNAIRLAQKNNYKVILSHRSGETNDTTISHIAVAVNCGQIKTGSLSRSERLAKYNELLYIEKLLNTSAIYQGML

SEQ ID NO: 16224 - protein, 430 aa, Oceanobacter sp. RED65
MNYSRSESLFNDAQTHIPGGVNSPVRAFKGVGGTPVFFKKGQGAYMYDEDGNRYIDYVNSWGPLILGHNAPEVMEAVKAQLENGLGFGAPTEIEIEMANKVCEIYPSMNMVRMVSSGTEATMSAIRLARGFTGRDKLVKFEGCYHGHADSLLVKAGSGALTLGVPSSPGVPSVLADLTVTLTHNDLDGVRECFSRIGNEIACVIVEPVAGNMNCIPPEPGFLEGLRELCDVHGIVLIFDEVMCGFRVAKGGAQEKYGVKPDLTTLGKVIGGGMPVGAFGGKKEIMEYLAPLGPVYQAGTLSGNPVAMSAGLAMLNAIEKPGFYDMLSEKAKKLCQGLEALAEKHGIALTTNQVGSMFGFFFSEEKSISRFDQVSRCNMDQFKAFFHGMLDEGVYLAPSAFETGFMCSAVSDEDIEFTLAAADKVMANLAK

SEQ ID NO: 16225 - protein, 388 aa, Coccidioides immitis RS
MASSASFPPPPVSSIDWNNIGFKVWEVNGHVESRFSHSSSPQWSPPQFVASPYLPIHGMAPGLNYGQQAYEGMKAFRHAPTESHPNGRITIFRPHRNAERMQHSARFISIPPVPESHFLECVKLAVSANAGFVPPHSTGAAMYIRPLIFGSSAQLGLSPPDEYTFVVFVMPTGVYHGVHAVNALILEDFDRSAPDGTGSAKVGGNYAPVLRHSEKARADGYGITLHLDSKTRSEIDEFSTSAFIGVLKDASGHVTLVIPDSKNAIDSVTASSIMAIGSNMFGYKVEKRRVPYDELKEFSEVMAAGTAAALVPIKSITMKSRNDVFNYEAGEGDSGGEVYKKLIHALKGIQRGEIHDKMGWLVDIEPVPAGWVEASRGKEADVSIANLP

SEQ ID NO: 16226 - protein, 91 aa, Triticum aestivum
MAGSRRALRFVLLLPAILGALLPPAAAAGPPKVSLALYYESLCPYCSRFIVTRLAGIFDSGLIHAVDLLLVPYGNAHVRGANNTISCQHGR

SEQ ID NO: 16227 - protein, 401 aa, Nocardioides sp. JS614
MNIVVIGAGLAGANAVEELRTQGYTGDITLIGAEPHPPYERPPLSKGLLLGTADPDSVFVHDTHWYADQQVDLLTGTTVTGIGLDTGHVALGDRQLSYDRLLLATGAQPRRLPLADSSGADVVYLRTLDDSRALNARLTERLLIIGAGWIGLEVAAAAREAGGTVTVVEPAALPLAHVLGDELGLLFADLHREHGVDLRLKTSVAAINHNRGQTTVGLSDGDELSPDLILVGIGAEPSDHLAAAAGLATDHGVLVDARLRASDPHVYAAGDLANHDHPLLGRIRVEHWDTAIHQGRHAARSMLGDDEPYTRQPYFFTDQYDLGMEYVGHVGPSGYDELVIRGDFASRVTTAFWIKDEHVVAGMHTNDWDAIGPIRSWIGREADDDLRNPASPLPTSRPLPA

SEQ ID NO: 16228 - protein, 419 aa, Oryza sativa (japonica cultivar-group)
MENMRSENFNQGVSMEGVKHAPEMANTNRRALRDIKNIIGAPHQHMAVSKRGLLDKPAAKNQAGHRPMTRKFAATLANQPSSAPLAPIGSERQKRTADSAFHGPADMECTKITSDDLPLPMMSEMDEVMGSELKEIEMEDIEEAAPDIDSCDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKLELMSFFIIELSLVEYEMLKFQPSMLAAAAIYTAQCTINGFKSWNKCCELHTKYSEEQLMECSKMMVELHQKAGHGKLTGVHRKYSTFRYGCAAKSEPAVFLLKSVAL

SEQ ID NO: 16229 - protein, 199 aa, Ashbya gossypii ATCC 10895
MTNPISQPTSAPSVPTIIIVAGTAGTGKSTIGAALAELMGTPFIEGDGLHPPTNIQKMANGIPLDDEDRWGWLRELAEHARRITLERQGPVVVTCSALKKKYRDFLREVCGEVRLDFLVLHASQEEVLERVARRKNHYMGPEMVASQFRDLELPSAEEPDCALIRSTEGSPGDTLNTALRKLQDLANPSTPAGSAYDQQ

SEQ ID NO: 16230 - protein, 1165 aa, Streptococcus pyogenes MGAS315
MKKKVNQGSKRYQYLLKKWGIGFVIAATGTVMLGCTPSILTHQVAAKTIVGLARDEAQQGDGNAKSGDGFQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPRMNEVWIDENYHAHAYRPLKKGYLRINYHNQSGHYDNLAVWTFKDVKTPTTDWPNGLDLSHKGPYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDKDKSVMALKGDFKTQGAVYTVTFGEVSQVARQSWQLKDKLYAYDGELGATLAKDGSVDLALWSPSADTVKVVVYDKQDQTKVLGQADLTKSDKGVWRAHLTSDSIKGISDYTGYYYLYEITRGQEKVMVLDPYTKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPSNFEADAPGDVVQYIAAHDNLTLHDVIAKSINKDPKVAEEEIHKRIRLGNTMILTAQGTAFIHSGQEYGRTKQLLNPDYKTKVSDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLADAEQAGVTAIAKPKGVQFTKEGLTIDGLTALVLKVSSKTADPSQQKSQTDNHQTKTPDGSKDLDKSLMTRPKRAKTNQKLPKTGEASSKGLLAAGVALLLLAISLLMKRQKD

SEQ ID NO: 16231 - protein, 867 aa, Arabidopsis thaliana
MAAMKLLLSQARRQGLIKPFSSPFQQIPRLFSSSSSSSSSSSSSSDSNPSPDSNESRKKAVTIEPVSYAAKPKDQKSEPKNVESTENLQSPESANWTREEIRYVKDSPSINPVSYAQRVAPLPEDRVAGENEGDRTPEEMERERKRIELENRARRRFLRANAVEEDTSSLPLPTLLKPELKHGKKPIFDLMEAIREIKGNAKAKFDETLEAHVRLGIEKGRSELIVRGTLALPHSVKKDVKVAFFAEGADAEDAKAAGADVVGGLELIEEILKSGKIDFDRCLATPKMMPRVYKISRILNNHGLMPNPKQGSVTKDVTKAVKDAKAGHTKFRMDKTSILHVPLGKMSFSEEALRENVGAFMNALLLAKPAGLKKTSKYAGYVNAFHLCSTMGKGYPVSIQSLSRAADLHTKLQLSLCLRVFRVIMDRISSLPDEILEHILSFLSTKEAALTSSLSTRWKNVFVFVPSLHLDYARQHENPREFIDFVDFVNTLFNRKGNSPIKKLALKIHLKDNQSLQNQTHVQSWIHRVLSRGGVTDLDLFITFKGKFQLVPLLIFKSNTLVKLRLGRGFTIKLCHENVYLPMLKTLCLDTVDFDGDHNVFETLLPRCPLLEELVLEDQRWKQWCGSVSSPSLKRLRIRFFHIPIISLDVPGLVYLELSCIFGSKYANVNLDSLVEARLNHWVEEQELRKLRDGSSHLVPADMMDLITGIRKVKVLHLTSDALELFYFSGQELPMFDNLVYLSIASDKKQGWQILPLLIKNSPNLETLVFKGLEHYTTKQCGDACVCSGILGKSSSCLSSSRVKVLEIWSYQGTSKELKQMGHFLMKLQFLELVKIRAVSNLQVPIDIQYLLKLPRASSNCKIQAIF

SEQ ID NO: 16232 - protein, 585 aa, Triticum aestivum
MTTYRVCCFLRRFRPASNEPSEAIGDVFEAYAGADGSGSALGEEALRRFLREVQGEAGDDDVEAAAREVLAFAAEHRLLKKGGGLTVEGFHRWLCSDANAALHPRRGVHHDMGLPLSHYFIYTGHNSYLTGNQLSSGCSEAPIAKALRDGVRVIELDLWPNAAKDDVEVLHGRTWTSPVDLMKCLETVKEHAFVSSPYPVILTLEDHLTPHLQAKVAKMIKETFGDLLHLSESEAMPVFPSPEDLRGKIIISTKPPKEYLETKSSKEEAQNGSAEESVWGDEIPDNKAQVATARQVSEKDTERYVEEDEEMEKKVQQGVNGEYKSLISISLTRRKHDMDQDLKVDPEKVSRMSLGEAAYEKATITHGSEIIKFTQRNLLRIFPKTTRITSSNYNPLMGWRYGAQMVAANMQGHGRKLWLTQGMFRANGGCGYVKKPDFLMNTDKMFDPRSKLPVKTRLKVTVYMGDGWRFDFRKTHFDKCSPPDFYARVGIAGVVADTMMKETKVIMDNWIPTWDHEFEFPLSVPELALLRVEVHESDNHQKDDFAGQTCLPVWELRSGIRSVRLYARDGEVLRSVKLLMRFEFS

SEQ ID NO: 16233 - protein, 735 aa, Arabidopsis thaliana
MQISLQIHLSSFTFLLLIFLLPVLSESQVASSESQTLLEIQKQLQYPQVLQSWTDTTNFCHIRPSPSLRIICLHGHVTELTVTGNRTSKLSGSFHKLFTLLTQLSSLKTLSLTSLGISGSLSPKIITKLSPSLESLNLSSNFISGKIPEEIVSLKNLKSLVLRDNMFWGFVSDDLRGLSNLQELDLGGNKLGPEVPSLPSKLTTVSLKNNSFRSKIPEQIKKLNNLQSLDLSSNEFTGSIPEFLFSIPSLQILSLDQNLLSGSLPNSSCTSSKIITLDVSHNLLTGKLPSCYSSKSFSNQTVLFSFNCLSLIGTPNAKYQRPLSFCQNQASKAIAVEPIPKAKDKDSARIKLGLVILIIIGVIILAAILVLLVLIALKRRRSRSEDDPFEVNNSNNERHASDKVSVCSTTTASSKSLPDSTKTINRIFLSVGRVPQTMRSAVIGLPPYRVFSLEELEEATNDFDAASLFCEQLYRGCLREGIPVTVRVIKLKQKSLPQSLAQQMEVLSKLRHMHLVSVLGHSIASNQDHNQHAGHTIFIVQEYISSGSLRDFLTNCRKKEVLKWPQRMAIAIGVARGIQFLHMGVAPGIFGNNLKIENIMLDETLTVKISGYTIPLPSKKEDVYQFGVILLQIITGKVVAAGSSEMGSLKLQLENGLRDEPSVLSSLADPSVKGSYAYESLRTTVEFAINCLCEDQSKRPSIEDVVWNLQYTIQVQQGWRPSSGNHESSMKAIYE

SEQ ID NO: 16234 - protein, 428 aa, Methanosarcina mazei Go1
MSYIGLQQDSGEYKIQKIHAREILDSRGNPTVEVDVFTPKGFGRASVPSGASTGTNEALELRDADPNRYGGKGVLTAVKNVNTIIQKELLGLDVRNQREIDELMIELDETENKSNLGANAILGVSMAVAKAAADSLNIPLYRYFGGSNAFTLPVPTMNVLNGGKHAGNELAIQEFMIQPKGAETFYEALQIGAEIYQTLGKFLENKYGRSSTNVGYEGGYAPKMGESTEALDALVHAIEEAGYTESEVTIGLDAAATEFYEEEFYNIDGKKLAAPELLDYYVELVNSYPILSIEDPFYEEAFEDFEALTNELWDTIIVGDDLFVTNIERLSKGVDMGAANALLLKVNQIGSISEAFDAASMASRNGYTVIVSHRSAETEDTTISDLAVAIGAEMIKTGAPARGERTAKYNQLLRIEEDLGEVAHYVQL

SEQ ID NO: 16235 - protein, 132 aa, Zea mays
ATVYKDQGITVIAGVEARGFIFGPPIALAIGAKFVPLRKPKKLPGEVISEEYSLEYGTDKIEMHVGAVQANDRALVVDDLIATGGTLCAAVKLIERVGAKVVECACVIELAELKGRDKLGDRPVFVLVEADA

SEQ ID NO: 16236 - protein, 873 aa, Ashbya gossypii ATCC 10895
MRTPRLPMKGNIAEVVLYRCSKTIKVNNYSNPRPVALDGRMMETTNTQKPLQWQTTPGEGSLEVHSPEQDRQRSISLSKFIPRSLKRNNSMNGSVESHVDAGDAEVDQEGQRASNGRQLGPGGEKRPEAGQLRGTGALPVILKENNKFASRLRSMFKASRELSQQEPNDVQQVSPEGKAEGTARHTPDGGMRVRSPSTPTFTVSRDPQPPTGQAAGTHEAIDIAPGRLQSPLMPSSHSAGGGITSKARGNRSNTVRGLNPYFAYQGLPPHAEPAHDGSQRSYDNSTFLTTPNTAQTSQTTLSYTNCSSNASAASLNDIEENEEVCSFQHTKKSPDILLQAIGCPVTPLTASESREETPLKSPVLRRVASQPTSLNKQEGQTRNNQQATDAGASLMAHQTLPVPVSCRSSSSSNMCAEASATARLEGGSPEHLELPPKRSQRLRAKSFGNKFREAVVGPQSFEKIRLLGQGDVGKVYLVREKKSDRLYALKIFGKAEMIKRKKIKRILAEQEILATSNHPFIVTLYHSFQTEDYLYLCMEYCMGGEFFRALQTRKTKCISEDDARFYASEVTAALEYLHLMGFIYRDLKPENILLHQSGHVMLSDFDLSVQAKGTRNPQVKGNAQSSLVDTKVCSDGFRTNSFVGTEEYIAPEVIRGNGHTASVDWWTLGILTYEMLFGFTPFKGDNTNQTFSNILKNDVYFPNNNDISRTCKDLIKKLLVKKESKRLGSKFGASEIKKHPFFKTVQWALLRNQEPPLIPVLTEDGYDFAKLSHKKDVKKAEKFGPSGDSTHKFKVAASIDSVEEQERIMFEEKVEHDDAVSDDDPFHDFNSMSLMKQDNNSLIYGDNNSYGKITYAPNQNRSRSNSHRSFFKR

SEQ ID NO: 16237 - protein, 906 aa, Nocardioides sp. JS614
MTADLQGWRHVSDRLVQPRDIDPDETQEWVESLDAVVDHAGQARARELLLRLQRRAQRRGVLMPGWGPSDYINTIPTAAEPAYPGDEDLERRIRAAVRWNAAVMVHRAQRPGLGLGGHLSTYASTATLFEVGFNHFFRGPDADGDGDQVYFQGHASPGVYARAFLENRLDEGQLDGFRQELSHGGLGAGLPSYPHPRLMPTFWEFSTVSMGLSPINAIYQARFNRYLRDRGIKDTSRQHVWAFLGDGEMDEPEALGALGVAAREELDNLTFVVNCNLQRLDGPVRGNGKIIQELESYFRGAGWNVIKVIWGREWDRLLDTDIQGALVDLMNVTPDGDFQTFKAESGHFVREHFFGRDPRALRLVETLTDEEIWDLKRGGHDTHKVFAAYDAALRHVGQPTVILAQTIKGYGLGSHFESRNSTHQMKKLTVEDLIELRDRLRLPIPDHQLDHDLPPYFKPAEGSPELEYLEECRLRLGGHLPSRRVRSRPLVLPGDTAYAVATLGSHQPVATTMAFVRLLRSLMNDPAIGHRFVPIIPDEARTFGLDALFPTKKIYSPQGQHYLSVDRGQLLSYQEDTAGVVLHEGLTEAGCTASWTAAGTSHATHDEPMIPIYVFYSMFGFQRTGDLLWAAADQLTRGFLLGATAGRTTLNGEGLQHQDGHSQLLAATNPACVSYDPAYAYEIGHIVRDGLRRMYGEPALGEDPDVFYYLTLYNEPIVQPAEPDDVDIEGILAGMHRISPAPASERPGAQILASGIAVPWALEAQAMLHDDWDVHADVWSVTSWNELRRRALTIDDWNHVHPDGPRRVPYVTRRLLGQRGPVVAVSDWMRAVPDQIAPFVDADWSSLGTDGFGLSDTRAALRRHFRVDPPWIVARVLAHLARQEQVDQTAPARAIKRYQATSLHAG

SEQ ID NO: 16238 - protein, 425 aa, Magnetospirillum magnetotacticum MS-1
MTAIIDIHGREILDSRGNPTVEVDVVLETGVIGRAAVPSGASTGVHEACELRDGDKKRYLGKGVQKACDSVNGEIYDALSGMDVEDQILIDKTMIDLDGTPNKSRLGANAILGVSLAAAKAAAEESGLPLYRYVGGAFASILPVPMMNIINGGAHADNPIDIQEFMIMPVGASSCSEAIRMGAEVFHALKKTLKDAGHNTNVGDEGGFAPNLKSAEMALDFIMKSIETAGYKPGDDIMLALDCASSEFFKEGKYVMAGAKKTYDQKGLVKFYAKLVGSYPIISIEDGCAEDDLVGWELLTDALGAKVQLVGDDLFVTNPERLSMGIDKGLANSILVKVNQIGTLSETLEAVDMAHKAGYTAVMSHRSGETEDSTIADLAVATNCGQIKTGSLSRSDRIAKYNQLIRIEELLGSAARYAGQTIMKR

SEQ ID NO: 16239 - protein, 281 aa, Oryza sativa (japonica cultivar-group)
GARRAPPLTMSTAAAAAAAQSWCFATVTPRSRATVVASLASPSPSSSSSSSNSSNLPAPFRPRLIRNTPVFAAPVAPAAMDAAVDRLKDGFAKFKTEFYDKKPELFEPLKAGQAPKYMVFSCADSRVCPSVTMGLEPGEAFTVRNIANMVPAYCKIKHAGVGSAIEYAVCALKVELIVVIGHSRCGGIKALLSLKDGAPDSFHFVEDWVRTGFPAKKKVQTEHASLPFDDQCAILEKEAVNQSLENLKTYPFVKEGIANGTLKLVGGHYDFVSGNLDLWEP

SEQ ID NO: 16240 - protein, 507 aa, Arabidopsis thaliana
MFRLLRSICKTCPTEESLRLFTGYLQFLTEIPKTWVLKYIEKMDHVSSLPEGVLCNIFSFLTTKEAALTSILCKRWRNLLAFVPNLVIDDSVFLHPEEGKEERYEIQQSFMEFVDRVLALQGNSPIKKFSLKFRTDFASHRVNAWISNVLARGVSELDVLVILYGAEFLPLSPKCFKSRNLVTLKINSLGIDWLAGDIFLPMLKTLVLHSVKLCVDKFFFRALPALEELVLFAVSWRDRDVTVSNASIKTLTIKFNYYLGTLSLDTPSLVSFCFSDHVAKDYPLAKMEKLSEARISLLVTEYQIERARAPNIYWVEDDVVLRLVNVGKLMKGIRNVQYLNLSPNTLEVLSKCCESMPLFNNLKSLTIESNERRGWQAMPVLLRNCPHLETLVLEGLLHHVTEKCRNACDCVSQEEKGRSLTSCQVKVLEIKGFQGTTKEMHTIKHFLEHFPCLREIKIHMEENGPTQLRVPEVSQYIAEMMEHYEKSSSCNVQLLVGGYLCKKWTTQ

SEQ ID NO: 16241 - protein, 83 aa, Glycine max
GFPQPPRCPPPPQPTPFGPPYTTPTLEEERERREFVVHVPLPDEKEIERRVLEKKKKDLLSRYASEGLVEEQTEAKDMLNIQR

SEQ ID NO: 16242 - protein, 343 aa, Triticum aestivum
MAEVSNKRVILKRYVTGFPAEDDMELVPATARLAVPPGSNAVVVKNLYLSCDPYLRSRMSGNDEPSHVPDFVQGEVLTTLGVSKVVESGHQDYKPGDLVWGMTGCEEYTLITDLQSHFKINHPELPLSYYTGVLGMPGLTAYVGFFDVAKPKKGEYVFVSAASGAVGQLVGQLAKISGCYVVGSAGSDEKVNLLKTKFGFDDAFNYKKEQDLDATLKRCFPEGIDIYFENVGGAMLDAVLLNMRLHGRVSVCGLISQYNLEQSEGVRNLFCIITKRIRMEGFIVTDHYGSYRKFEEEMAGYLKEGKITYVEDVAEGIESFPTALIGLFYGRNIGKQLVVVARE

SEQ ID NO: 16243 - protein, 175 aa, Glycine max
  misc_feature (164)..(164): Xaa can be any naturally occurring amino acid
LMTRLYFRNGGKRIWFSSFLQTSGCPIILLPLLFSFLTRHRQQQEQEEPKTTLFLIKPSLFLASVVVGLLIGFDNYLYAYGLAYLPVSTSSLIISSQLAFTAFFAFFMVKQRFTPFTINAVVLLTLGAGSLALHADGDKLPKETRKEYIVGFVMTVAAAVLYAXVLPLVELAYKK

SEQ ID NO: 16244 - protein, 167 aa, Klebsiella oxytoca
KHFSTTAPEKNLPVLLALIGIWYNNFFGAETEAILPYDQYMHRFAAYFQQGNMESNGKYVDRNGNAVDYQTGPIIWGEPGTNGQHAFYQLIHQGTKMVPCDFIAPAITQNPLSDHHPKLLSNFFAQTEALAFGKSREVVEQEYRDQGKDPAALEHVVPFKVFEGNRP

SEQ ID NO: 16245 - protein, 238 aa, Oryza sativa (japonica cultivar-group)
MFIRMRAASTTSSSEPCRRLSPPSSKRPAGRTKFHETRHPVFRGVRRRGRAGRWVCEVRVPGRRGCRLWLGTFDAADAAARAHDAAMLALRGRAAACLNFADSAWLLAVPPPATLRCAADVQRAVARALEDFEQRESSSSVFPLAIDVVAEDAMSATSEPSAASDDDAVTSSSSTTDADEEASPFELDVVSDMGWSLYYASLAEGLLMEPPASGASSDDDDDAIVDSSDIADVSLWSY

SEQ ID NO: 16246 - protein, 445 aa, Oryza sativa
  misc_feature (179)..(179): Xaa can be any naturally occurring amino acid
  misc_feature (379)..(379): Xaa can be any naturally occurring amino acid
MAATIQSVKARQIFDSRGNPTVEVDICCSDGTFARAAVPSGASTGVYEALELRDGGSDYLGKGVLKAVDNVNSIIGPALIGKDPTEQTVIDNFMVQQLDGTKNEWGWCKQKLGANAILAVSLALCKAGAIIKKIPLYQHIANLAGNKQLVLPVPAFNVINGGSHAGNKLAMQEFMILPXGASSFKEAMKMGVEVYHNLKSVIKKKYGQDATNVGDEGGFAPNIQENKEGLELLKTAIEKAGYTGKVVIGMDVAASEFYTEDQTYDLNFKEENNDGSQKISGDSLKNVYKSFVSEYPIVSIEDPFDQDDWVHYAKMTEEIGDQVQIVGDDLLVTNPTRVAKAIKDKACNALLLKVNQIGSVTESIEAVKMSKRAGWGVMXSHRSGETEDTFIADLAVGLSTGQIKTGAPCRSERLAKYNQLLRIEEELGAAAVYAGAKFRAPVEPY

SEQ ID NO: 16247 - protein, 466 aa, Aspergillus oryzae
MSSKSRWADEDPEAEAINAQRKREKEEKRRAKAEKQRQLEQQAEEAARQREAANNDTEAPPKKRRRLSNDPDTTADVQVGSAKPQENTSNILQFPTQEWGPSRHVDNFERLNHIEEGSYGWVSRAKDITTGEIVALKKLKMDNSPDGFPVTGLREIQTLLEARHPNIVLLREIVIGNKMDDVFLVMDFLEHDLKTLLDDMREPFLPSEIKTLLSQVLSGLDFLHSQWIMHRDLKTSNLLMNNRGEIKIADFGMARYYGDPPPKLTQLVVTLWYRSPELLLGAEKYGTEIDMWSIGCIFGELLTKEPLLQGKNEVDQVSKIFALTGPPTPQTWPGFRSLPNAKSLRLPQTSAPSGNPPLLPRSKFPFLTNAGLQLLSSLLALNPSSRPTTQECLSHPYFREDPRPKPKEMFPTFPSKAGMEKRRRRQTPEAPKRGQEAPRLDFASVFGGQSSGDGGETGAGFTLRLG

SEQ ID NO: 16248 - protein, 396 aa, Oryza sativa
IAGDDGKRLLAFGKFAGRAGLIDFLHGLGQRYLSLGYSTPFLSLGQSHMYPSLAAAKAAVIAIGEEIATFGLPSGICPIVFVFTGTGNVSQGAQEIFKLLPHSFVDAGKLPELSAARSLSQHPQSSKRVFQLYGCVVSSRDMVTPKDPTRCFNKADYYAHPEHYKPVFHERIAPYASAIVNCMYWERRFPRLLSIDQLQQLMKNGCPLVGISDITCDIGGSIEFVNKSTSIERPFFRYDPCTNSCHDDMEGNGVICLAVDILPTEFSKEASQHFGDILSKFVARLASAKELLELPSHLRKACIAHAGRLTSLYEYIPRMRKTIIELPPAPTNLLPDKKYNSLVSLSGHLFDKFLINEALDIIETAGGSFHLIRCDVGQSIDDMSYSELEVRTHVSF

SEQ ID NO: 16249 - protein, 85 aa, Brassica napus
  misc_feature (66)..(66): Xaa can be any naturally occurring amino acid
  misc_feature (68)..(69): Xaa can be any naturally occurring amino acid
LLYVEGCSLLTTSGLESVILQWHELEHLKVVSCKNVKDSEISPLMSALFSDLVELQWRPDTRSHLXSXXAGAGIGGKGAKFFKKT

SEQ ID NO: 16250 - protein, 103 aa, Debaryomyces hansenii CBS767
MVAAITSKQEFTDALSHDGLVVVDFFATWCGPCKMIAPLLDKFSAEYNQAKFIKVDVDEFGEIAQEYEVSSMPTVIFFKGGEVVNKVIGANPGALKQVISANA

SEQ ID NO: 16251 - protein, 1320 aa, Salmonella typhimurium
MGTTTMGVKLDDATRERIKMAASRIDRTPHWLIKQAIFSYLDKLENSDTLPELPALFVGAANESEEPVAPQDEPHQPFLEFAEQILPQSVSRAAITAAWRRPETDAVSMLMEQARLSPPVAEQAHKLAYQLAEKLRNQKSASGRAGMVQGLLQEFSLSSQEGVALMCLAEALLRIPDKATRDALIRDKISNGNWQSHIGRSPSLFVNAATWGLLFTGRLVSTHNEANLSRSLNRIIGKSGEPLIRKGVDMAMRLMGEQFVTGETIAQALANARKLEEKGFRYSYDMLGEAALTAADAQAYMVSYQQAIHAIGKASNGRGIYEGPGISIKLSALHPRYSRAQYDRVMEELYPRLKSLTLLARQYDIGLNIDAEEADRLEISLDLLEKLCFEPELAGWNGIGFVIQAYQKRCPLVIDYLVDLASRSRRRLMIRLVKGAYWDSEIKRAQMEGLEGYPVYTRKVYTDVSYLACAKKLLAVPNLIYPQFATHNAHTLAAIYHLAGQNYYPGQYEFQCLHGMGEPLYEQVTGKVADGKLNRPCRIYAPVGTHETLLAYLVRRLLENGANTSFVNRIADATLPLDELVADPVEAVEKLAQQEGQAGIPHPKIPLPRDLYGEGRINSAGLDLANEHRLASLSSALLSNAMQKWQAKPVLEQPVADGEMTPVINPAEPKDIVGWGREATESEVEQALQNAVNQAPVWFATPPQERAAILQRAAVLMEDQMQQLIGLLVREAGKTFSNAIAEVREAVDFLHYYAGQVRDDFDNETHRPLGPVVCISPWNFPLAIFTGQIAAALAAGNSVLAKPAEQTSLIAAQGIAILLEAGVPPGVVQLLPGRGETVGAQLTADARVRRVMFTGSTEVATLLQRNIATRLDAQGRPIPLIAETGGMNAMIVDSSALTEQVVVDVLASAFDSAGQRCSALRVLCLQDDIAEHTLKMLRGAMAECRMGNPGRLTTDIGPVIDSEAKANIERHIQTMRAKGRPVFQAARENSDDAQEWQTGTFVMPTLIELENFAELEKEVFGPVLHVVRYNRNQLAELIEQINASGYGLTLGVHTRIDETIAQVTGSAHVGNLYVNRNMVGAVVGVQPFGGEGLSGTGPKAGGPLYLYRLLAHRPPNALNTTLTRQDARYPVDAQLKTTLLAPLTALTQWAADRPALQTLCRQFADLAQAGTQRLLPGPTGERNTWTLLPRERVLCLADDEQDALTQLAAVLAVGSQALWSDDAFHRDLAKRLPAAVAARVQFAKAETLMAQPFDAVIFHGDSDKLRTVCEAVAAREGAIVSVQGFARGESNILLERLYIERSLSVNTAAAGGNASLMTIG

SEQ ID NO: 16252 - protein, 243 aa, Arabidopsis thaliana
MQTIIISPLVSHRLCLARAVPCNRLLNNHHRAPPSIRLSNHRSTTSLRLFSSAAASRDSEMATEDVQDPRIAKIASSIRVIPDFPKPGIMFQDITTLLLDTEAFKDTIALFVDRYKDKGISVVAGVEARGFIFGPPIALAIGAKFVPMRKPKKLPGKVISEEYSLEYGTDTIEMHVGAVEPGERAIIIDDLIATGGTLAAAIRLLERVGVKIVECACVIELPELKGKEKLGETSLFVLVKSAA

SEQ ID NO: 16253 - protein, 313 aa, Nicotiana tabacum
MATSHFILKLFLVISFCNVCFASRKLTALVQEPENQLLQYHKGALLFGKISVNLIWYGKFKPSQRAIVSDFITSLSSSTPSKTDPSVAKWWKTTEKYYHLANSKKSLSLYLGKQVLVENYSLGKSLTQKQIVQLASKGEQKDAINIVLTASDVAVDGFCVNRCGTHGSSKGAIIRGKTYKFAYIWVGNSETQCAGYCAWPFHQPIYGPQSPPLVAPNNDVGVDGMVINLASLLAGTATNPFGNGYYQGEADAPLEAASACPGVYAKGAYPGYAGDLLVDKTTGASYNAHGTNGRKYLLPALYDPSTSTCSTLV

SEQ ID NO: 16254 - protein, 499 aa, Lotus japonicus
MDIISFLYYSLFYVALFAIIKLFLGSRKFKNLPPGPTSLPIIGNLHHLKRPLHRTFRALSEKYGDVFSLWFGNRLVVVVSSFADVQECFTKNDVVLANRPRFLSGKYIFYNYTTLGSTSYGEHWRNLRRITSLDVLSNHRINSFSPIRRDETTRLIRKLAEDSAKNFSEVELTSRFFDMTFNNIMRMISGKRYYGEDCDMTELQEASEFRDMVTELLQLSGANNKADFMPILRLVDFEGLEKRVKGISSKTDRFLRGLLQEHRDKKQRTANTMIDHLLTLQESQPEYYTDQIIKGLALAMLLAGTDSSAVTLEWSMCNVLNYPEVLEKIKAELDTHVGQDRLVDESDIPKLTYLKNVINETLRLYTPAPLLLPHSASDDCTIGGYKVPRDTIVLINAWALHRDPQLWTEATTFKPERFDKKGELEKLIPFGLGRRACPGELLAIRAISMTLALLIQCFDWKRVSDEEIDMGERDGFVLMKSIPVKAMCKSRPVINNVFK

SEQ ID NO: 16255 - protein, 132 aa, Brassica napus
MFRRKTTSQAEQENNEAALREAKIKEVKTLIGELSGRSSLYCSDPCLKRYLEARNWNVGKAKKMLEETLKWRSTFKPEEIRWNEVSGEGETGKVYKAGFHDRSGRTVLILRPGLQNTKSLENQMKHLVYLIE

SEQ ID NO: 16256 - protein, 248 aa, Zea mays
MSATPSGDVPDELRVRSTWLQRAWTLAGTAAILMSFFTTARLVAASSTVVTDSLAVALAVWAAYSVADLTTGVYHWFIDNYGDAGTPVFGAQIVAFHDHHVHPTAITRLEPCNSLHVIAGTVAVALPAVDAALLYFAGGSSPAAAHAFACTFAVCVMLSVQFHAWAHERPSRLPPGVEALQAAGVLVSRSQHAGHHRPPYNSNYCTVSGMWNWALDGYKVFLAVEKVIYLATGAPPRSWRMKMTEHGV

SEQ ID NO: 16257 - protein, 374 aa, Candidatus Pelagibacter ubique HTCC1002
MSDDIKKGLLGIVVDETEISKVMPEINSLTYRGYAAQDLCARCDFEEVAYLILNKELPNKKQLKEFKKVLSKEITLSKNLLSILKKIPKKSHPMDVARTAVSVMGLEDKETKDSSPKANLRKAIRILAKTPTALAAFYRLRKGKKIIAPKKNLTFSENFFHMCFGKVPEKEIVKAFDVSLILYAEHSFNVSTFTARTITSSLSDIHGAITGAIASLKGPLHGGANEEVMHMMKKIKKPENALKWITKALKNKDVVMGFGHRVYKSGDSRVPTMREYFKRVAIIKKDKTFEKIYDIVEKVMIKEKNIYPNVDYPTGPTYHLMGFDTDFFTPIFVISRITGWSAHIMEQHAANKLIRPLASYKGSKHRKVIQLNQR

SEQ ID NO: 16258 - protein, 806 aa, Mycoplasma genitalium G37
MLISKKTLGVLIPDIFSFSNDQIAQKLEQMGIEVESIKQFNSPDYLQLAKVVSIQPHPHDNKLFICELQIDKNKFINVVSNANNINNPDNINKFVIVAKKGTELLNGLIVKTQNIKGIISEGILCSYIDINPFSRQIIEKTEVADAIIIDHVSNDHDWNQYLSFLSLDDVIFDVKTPTNRADLHSLIFLAKELGVLLKTKTFLKQKSSVVNHDFFKFPLNLKNKLKANYFGGLFLRQINQHSSPWTVKGLLINQMIKPVNYYVDKANLVTVFTAQPIHCHDADRIVGNIELKQATHNETFVGLDDKQYEIEPGDIVVCDEKGIIALVGIIGSKRTMVQPTTTNIFFEVVNCNSETIKQTAKRFLINNFASKFMVKPISLLATDNCLNYLQNSLLTTDNIGKISHFSSSLKVEPFSKKLTVNFHKIRQLIGIEKKELTDQTIKKSLSQLGFKVDNQLLKIPSYRQDINTWQDISEEIVKLIDINKLKPIGITSSFNFEKSSYFNTFNALTKLRKKLQTLGFHNVITYQLTDQKSAKTFNLFNLENFITIKNPVSQNHSVMRVSLIDSLLKVLKTNNNYKNELVNIFEFSFIKTQNNSELHLAVLWVEKLFTSSFNPMQGISNDVFTMKGLAKLIVANLGFSCDFEPLDDSDYFVNNQSLKIVVFNEQIGFIGLIKESLLNNYDLNNKPIYCLEINLDRMLSSLNRIEKNYLGYSKLQPVCKDLTFSFTNPASHFDQFANMIKRITGIESWKLISVFETMQNNQLITKYTVRYFLKNDANKPLTNQTIELITNNLKLQCEKLKIKLDI

SEQ ID NO: 16259 - protein, 288 aa, Candidatus Pelagibacter ubique HTCC1002
MSFEKKIVSGPIIFTPDLIKNLRSFSCSILEFICFIWKYFYIKCIDSLIHNLFLKNTLLMTQKYSILFDLDGTLVDTAPDLMNAHNHVMRKYGYPTKSTADIRNLVGQGAGAMIGRSIWGQAKKEFGKIDDQKIKAEMVKDFVNFYGKNIIKESTLINGVKEFLKWCKEKEISMAVCTNKQEHLAIDLLKKIGIYDYFEYVAGSDTFDYCKPDPRHITSIIEIIGGDVKKSLMFGDSETDANAAKAASVPVILLENGYTEKNSNEIYHNHLIKDFIGVEKIVSTYLKD

SEQ ID NO: 16260 - protein, 282 aa, Zea mays
MAQTLSAASELATLKRPFGNDGFGDGSNNGSATGEKPKARRREADPAAAMAAARHEFGEHGGVNMSIEASATFTVMEPDTMRRLFAGELGPDRGDMYIYSRHFNPTVLALGRQMAALEGTEAGYCTASGMSAISSVLMQLVGAGGHVVASRCLYGGTHALLARFLPRASGVRATFVDADDEAAVRAAVVPGETRVVYVETMSNPTLAVADIPMLARVAHEAGAKLVVDNTFTPVVVSPARLGADVVVHSVSKFISGGADIIAGKKREGRKAQRQLQWPRVDS

SEQ ID NO: 16261 - protein, 908 aa, Pseudomonas aeruginosa UCBPP-PA14
MSTDSPLRTTASTCCYCGVGCGVLIEHDGERILGVQGDPRHPANFGRLCSKGASLHLTGDLQARALYPQLRLGKQLARARSDWESALEHAAGRFAETIREHGPDSVAFYISGQLLTEDYYAFNKLARALVGTNNIDSNSRLCMSSAVVGYKRSLGADAPPCSYEDLDCADCVLIAGSNMAFAHPVLFRRLEAAKAARPEMRIVVIDPRRTDTCELADLHLALLPGTDVALFHGILHILLWEDWIDRSFIAEHTEGFADLKELVRDYTPAAVADICGIDRADLQRCAEWIGRSPRFLSLWCMGLNQSSAGSAKNSALINLHLATGKIGRAGCGPFSLTGQPNAMGGRETGSLATLLPGHREAADPGHRAEVAHYWGVEQLPTSPGLSAIELFDAVHDGRIKALWIACTNPAQSLPDQRKIHEALARCPFVVVQEAFAGTETCQYADLLLPAASWGEKEGSVTNSERRVSHVRRAVPPPGEARQDWNIVCDFARRLEGHLRPAKPGLFAFADSRSLFDEYKLLTAGRDLDLSGLSYALLDRLGPQQWPFPSGAEHGTARLYADGRFPTASGRAQLVAEPYRAAQEKRDARYPLTLNTGRLRDQWHGMSRTGTCARLFGHEEEALVHLHPEELRRRQLRDGQLVRLKSRRGALILPVSADDSVRPGQAFLPMHWGDRFLKGLGCNVLTLPAFDPLSKQPELKHAGVQVESVELPWRLFALVETDIQARFEALRALCEVFDHASFSLAGRERPALLVSAAHHEAPGADLLERIDRQLELLDGPILAYDDPRRAIGKRVRLEDGRIVAVRLAGETLARDWLKELWLTGRADSELRRWLLAPLGAAPGRPSQGAGGKTLCSCQNVSQQTVLGGIARGLDLDGLKREFGCGTGCGSCVPEIKRLLAAPRPMAANA

SEQ ID NO: 16262 - protein, 466 aa, Nostoc punctiforme PCC 73102
MSSTTVRRKSNTFYVILIAGAAALGGFLFGFDTAVINGAVLSLAKAFNTSSWVTGLAVSLALLGSAVGAFFAGQIADRYGRVKAMVVASVLFTISAIGSGMAFTIWDFIFWRVLGGIGIGVASVIAPAYIAECSPTHLRGRLGSLQQLAIVVGIFVALLSDYFIATSAGSADSPFLFGVAAWRWMFWTAVPPAVFYGMVALTIPESPRYLVAKGRESEAVNVLTKILGGDVLPKIEEIRQTVLRERQPKFSDLLSRSGGLLPIVWIGIGLSVLQQFVGINVIFYYSSVLWRAVGFSEKDSLSITVITGAVNIITTLIAIAFVDKFGRKPLLIIGSIGMTLTLGTMAYIFGNAPLDAAGNPSLAGSAGTVALIAANLYVFCFGFSWGPIVWVLLGEMFNNKIRAAALSVAAAIQWVANFLISTTFPPILQYFGLGSAYGLYTIAAATSFFFILFFIKETKGIELEDM

SEQ ID NO: 16263 - protein, 816 aa, Pseudomonas aeruginosa UCBPP-PA14
MKKIKLVMVGNGMAGVRTLEELLKLNSDFYDITVFGAEPHPNYNRILLSPVLAGEQTFEEIVLNDLNWYAENGIKLLLDRKVVQIDRVRRRVVAADGSEAEYDRLLLATGSVPFILPIPGNRLQGVIGYRDIADTQAMIDCARTHSHAVVIGGGLLGLEAANGLKQRGMDVTVVHLSDWLLERQLDRTAGKLLQGALEARGIRFRLNTQTQELMDNGSGRVCAVQFNDGDVIPADLVVMAAGIRPNTELAESAGIPCNRGILVNDTLQTYDPRIYAVGECANHRGIAYGLVAPLFEQAKVCANHLAHLGYARYQGSVTSTKLKVTGIDLFSAGDFIGGEGSETITLSDPIGGVYKKLVIKDDVLVGACLYGDTADGGWYFRQIRENHNVAQIRDHLMFGENALGDVGHQGQNSAASMPDTAEVCGCNGVCKGTIVKAIQEHGLFSVDEVKKHTKAASSCGSCAGLVEQILISTVGGAADVKPKSEKAICGCSDLNHGQIRKAIREHRLTSLDAVMRFMDWKTPNGCATCRPALNYYLISTWPGEAKDDPQSRLINERAHANIQKDGTYSVVPRMWGGVTNAAELRRIADVADKYQVPMVKVTGGQRIDLLGVKKDDLPAIWKDLDMPSGHAYGKSIRTVKTCVGSEFCRFGTQNSTQLGIDLEHDLFNMWSPHKVKLAVSGCPRNCAEAGIKDVGIIGVDSGWEMYIGGNGGIKTEVAEFFVKLKTAEEVREYNGAFLQLYREEAFYLERTVHYLQRVGMEHIRKAVVEDAENRKALNDRLQFALSFEQDPWKQRIEQPQLKKEFERIPLKQLENV

SEQ ID NO: 16264 - protein, 440 aa, Zymomonas mobilis
MSIEVKMPALSPTMTEGTLAKWLVKEGDAVKAGDILAEIETDKAIMEFETVDAGIIAKILVPEGSENIAVGQVIAVMAEAGEDVSQVAASASSQISEPSEKADVAQKETADSETISIDASLDKAISNAGYGNKTENMTASYQEKAGRIKASPLAKRLAKKNHVDLKQVSGSGPHGRIIKADIEAFVTGANQASSNPSVSTPEVSGKITHDTPHNSIKLSNMRRVIARRLTESKQNIPHIYLTVDVQMDALLKLRSELNESLAVQNIKISVNDMLIKAQALALKATPNVNVAFDGDQMLQFSQADISVAVSVEGGLITPILKQADTKSLSALSVEMKELIARAREGRLQPQEYQGGTSSISNMGMFGIKQFNAVINPPQASILAIGSGERRPWVIDDAITIATVATITGSFDHRVIDGADAAAFMSAFKHLVEKPLGILAQ

SEQ ID NO: 16265 - protein, 319 aa, Burkholderia mallei ATCC 23344
MPLNPKIAQVLDMIERAKRPDYHEQTPAQARAAYEKSAPILDVAPAPMFSVEDLRVPSRDGGAFGARLYLPVEPSLAEPLPVLVYYHGGGFTVGSVNTHDALCRMFARDAQCAVLSVDYRLAPEHKFPTAVDDAEDALVWLHAHASRFGIDSARLAVGGDSAGGTLATVCAVLARDRGIALALQLLIYPGTVGHQQTESHARLAKGYLLSADTIQWFFGHYVRDASDRDDWRFAPLDGTRGAPSFERVAPAWIATAQYDPLSDEGEAYADKLRAAGNRVTLVAYAGMIHEFFKMGGYVPEVRLAHADAVGALRAAFDGD

SEQ ID NO: 16266 - protein, 332 aa, Burkholderia mallei ATCC 23344
MSQVNRRVLLVSRPEREARVENFELVETPLAPLAEGEVRVRNHFLSIDPYMRGRMNAGRSYAEPQPLGEVMGGGTAGEVVESRNPAFAPGDRVIGAYGWQEYGTSAGKELRKVDTTRVPLSAYLGAAGMPGVTAWYGLNRIIRPRAGETLVVSAASGAVGSVVGQLAKLAGCRAVGIAGGADKCRYVVDTLGFDACVDYKAGRLADDLAAAAPDGVDGCFENVGGAVLDATLARMNPFGRIAMCGMIAAYDGAPAPLANPALILRERLLVQGFIVSEHFDVWPEALAQLASLVANRQLHYRETIAQGLERAPDALLGLLKGRNFGKQLVALV

SEQ ID NO: 16267 - protein, 128 aa, Bordetella bronchiseptica RB50
MSKQIIHTDAAPAAVGPYSQAVAATGAKTVYLSGQIGLEPGTGDLVSENFDAQVRQAFANMQAVIKEAGGTLDDIVKLTLFLTDLNKFAAANAIMAELIPQPFPARSTVGVASLPKGAQFEVEAVLVL

SEQ ID NO: 16268 - protein, 340 aa, Ginkgo biloba
MSSTGKIKIGINGFGRIGRLVARVALLRDDIELVAVNDPFISTDYMTYMFKYDSVHGQWKKHEVKVKDSNTLLFGEKAVTVFGCRNPEEIPWGETGVEYVVESTGVFTDKEKAAAHIKGGAKKVVITAPSKDAPMFVVGVNEHEYKPDLAIVSNASCTTNCLAPLAKVINDRFGIVEGLMTTVHSITATQKTVDGPSNKDWRGGRGAGFNIIPSSTGAAKAVGKVLPALNGKLTGMAFRVPTPDVSVVDLTVRLEKPASYDEIKAAIKEESEGKLKGILGYTEDDVVSTDFIGDNRSSIFDAKAGIALSDNFVKLVSWYDNEWGYSSRVIDLIVHMASTV

SEQ ID NO: 16269 - protein, 149 aa, Zea mays
SSVRPGRYKEKGRSLLFNLKDKSNPELRERVSSGDIAPERLCSMTAEELASKELSEWRLAKAEEFAQMVVLPNMEVDPRSLVRKTHKGEFQVEVEEPDGTEMHIYNESNNLEVTLLGVFQSMVRMFVCSNEQLWCHDSPGHFKSLWRWG

SEQ ID NO: 16270 - protein, 474 aa, Ehrlichia ruminantium str. Gardel
MIKKYRKKCMQNYDVVVIGGGPGGYKCAIRSAQLGLKVACVDKNEILGGTCLRVGCIPSKALLHFSHEYYHIKNHLDEVGITCNSLSFNLDKIMSFKNKNITELGNGINYLFASNKIDRLCGVGKIRSINSNNFDITVTGNNGEEKITAKYVVIATGSEVASFPGIEIDENNVVSSTAALSFKEVPKKLVVVGAGAIGLEMSSVWSRFGSEVTVVEFLDKIAPSMDIDISKALLASLKKQGINFKLSTKVTSIDKSSDNLTIHLESVKDGKSEIIEAEKVLISIGRIPYTDGLIDQNCIECDSRGFIKVNNKYETNIPGIFAIGDVIGGAMLAHKAEEEGIAVAELIAGNIPHVDYDIIPSVIYTHPAVASIGKTEESLKNINYAYNVGKSNFSANSRSKITNNGEGFVKVLTSKENNAILGVHIIGAYADTIINEAAIAMAYRASSEDVFRISHSHPDVNEAFKDACEAAYLK

SEQ ID NO: 16271 - protein, 340 aa, Taxus baccata
MGSTGKIKIGINGFGRIGRLVARVALQRDDIELVAVNDPFISTESLTSLFKYDSVHGQWKKHEVKVKDEKTLLFGEKHVAVFGCRNPEEIPWGEVGAEYVVESTGVFTDKDKAAAHLKGGAKKVVISAPSKDAPMFVVGVNEHEYKSDLTIVSNASCTTNCLAPLAKVINDRFGIVEGLMTTVHSITATQKTVDGPSNKDWRGGRAAGFNIIPSSTGAAKAVGKVLPVLNGKLTGMCFRVPTQDVSVVDLTVKLEKSATYGEIKAAIKEESEGKLKGILGYTEDDVVSTDFIGDSRSSIFDAKAGIALNDNFVKLVSWYDNEWGYSSRVIDLIVHMDSTA

SEQ ID NO: 16272 - protein, 337 aa, Craterostigma plantagineum
MAKVKIGINGFGRIGRLVARVALVRDDVELVAVNDPFITVDYMAYMFKYDTVHGQYKHHELKVKDEKTLLFGDKPVAVFGLRNPEEIPWAETGAEYVVESTGVFTEKEKAAAHLKGGAKKVIISAPSKDAPMFVVGVNEKTYTPDIDVVSNASCTTNCLAPLAKVIHDRFGIVEGLMTTVHSITATQKTVDGPSSKDWRGGRAASFNIIPSSTGAAKAVGKVLPDLNGKLTGMAFRVPTVDVSVVDLTVTLAKEASYDEIKAAIKEESEGKLKGILGYTEEDVVSSDFVGDSRSSIFDAKAGIALSKKFVKIVAWYDNEWGYSSRVVDLIRHMAAAK

SEQ ID NO: 16273 - protein, 530 aa, Coccidioides immitis RS
MSFNNPTQIFAEDVTEEKGEIARLSAFVGAIAVGDLVKSTLGPKGMDKILQSASTGEIMVTNDGATILKAIALDNAAAKVLVNISKVQDDEVGDGTTSVTVLAAELLREAEKLVEKRIHPQVIIDGYRIASKAALGALEQAAVDNSSDPVAFRKDLHSIARTTLSSKVLAQDRDHFASLACDAVLRLKGSTDLSHIQIIKKAGGKLSDSYLDEGFILDKKIGVNQPKRLENAKILVANTAMDTDKVKIFGARVKVDSTGKLAELEKAEKEKMKAKVDRIKAHGINCFVNRQLIYNWPEQLFTDAGIVSIEHADFDGIERLALVTGGEIASTFDHPDQVKLGHCDLIEEVIIGEDTLIKFSGVAAGQACTIVLRGATEQLLDEAERSLHDALAVLSQTVKEPKVTLGGGCAEMIMSRAVEQTAQNTTGKKQLAVDAFAQALKQLPTILADNAGLDSSDLVTRLRQAINKGLMSSGLDLLTPGGGIANMRELGVVESYKLKRAVVSSASEAAELLLRVDNIIRSAPRKRERV

SEQ ID NO: 16274 - protein, 501 aa, Ehrlichia ruminantium str. Gardel
MTNHSVILCILDGWGNNKNSQFNAIAQADTPYWDSIISQYPQSNIVTHGPDVGLPDRQIGNSEVGHISLGSGRIVLQDLCRINEEIKNIRKNTHLLEFTEQIKRNNGICHIAGLLSDGGIHSSLSHMLDIIDALSYLKIQVVIHIFLDGRDTPPISALKYINILCSHIKDLNNVSIATISGRYYSMDRDNRLDRTTKAYNSIAFGDGKRYEEPISAVQDNYNAGITDEFIIPCVIGNYQGMNPTDGFIMTNFRSDRVIQILKMITEDQNTNHITLKNTIGMIKYSNELNIPCLFPNKKISNTLGEIISNQQLHQLRIAETEKYAHVTFFFNGGREEVFENEERIIIPSPSVTTYDLVPEMSAYEITDTLIKKINLQKYSLIIINYANADMVGHTGNIEATKKAITTLDQCLGKILKCIHNTNYILVITADHGNAEEMFDVQNNMPYTAHTLNPVPFVVCNYPKKIKLKNGRLSDVAPTILEILNIKQPEEMTGISLIDTSN

SEQ ID NO: 16275 - protein, 525 aa, Phaseolus vulgaris
MASSSVTLKANAHLANSEKGHLFRQESSFLGERVKVGPNNSAFVTNQLARCSRSQKRVNHGVASAILTSNDAKESLSLQVPSFMRRRVDPKNVVSIILGGGPGKQLFPLTQRAATPAVPVGGCYRLIDIPMSNCINSGINKIFVLTQFNSASLNRHIARTYFGNGINFGDGTVEVLAATQTPGEAGKKWFQGTADAVRQFTWVFEDAKNTHVENVLILAGDHLYRMDYMDLIQSHVDRNADITVSCAAVGNSRASDYGLVKVDDRGRIIQFSEKPKGDDMTAMQADTSLLGLSPPDALKSPYIASMGVYVFKTDVLLNLLKCRHPTSNDFGSEIIPAAVRDHNVQSYFFRDYWEDIGTIKSFYDANLALTEESHEFEFYDPKTPIYTSPGFLPPTKIDKSRIVDAIISHGCFLRECTVQHSIVGERSRLDYGVEIQDTVMMGADYYQTESEIASLLAEGKVPIGIGRNTKIRNCIIDKNAKIGKDVIIKNKDDVQEADRPEDGFYIRSGITIIAEKATIEDGTVI

SEQ ID NO: 16276 - protein, 140 aa, Leifsonia xyli subsp. xyli str. CTCB07
MTTAVEETLVLVKPDGVARNLTGEILRRIEAKGYSLVDIRMVQADRVLLAKHYAEHEGKPFYEPLVEFMESGPLVAIRLAGNRVIEGFRSLAGATDPTTALPGTIRGDLARDWGLKVQQNLVHGSDSPTSAARELALWFG

SEQ ID NO: 16277 - protein, 515 aa, Phaseolus vulgaris
MASMASIGSLNVPCSSSSSSSNGGRKILPRALSFSASQLYGDKISTDSVSVAPKRVRNPVVVSPKAVSDSQNSQTCLDPDASKSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEYLVLAGDHLYRMDYEKFIQVHRESDADITVAALPMDENRATAFGLMKIDEEGRIIEFAEKPKGEQLKAMKVDTTIFGLDDERAKEMPYIASMGIYVVSKNVMLNLLREKFPAANDFGSEVIPGATSIGLRVQAYLYDGYWEDIGTIEAFYNANLGITKKPVPDFSFYGRSSPIYTQPRYLPPSKMLDADVTDSVIGEGCVIKNCKIHHSVVGLRSCISEGAIIEDTLLMGADYYETDADKRFLAAKGSVPIGIGRNSHVKRAIIDKNARIGENVKILNSDNVQEAARETDGYFIKSGIVTVIKDALIPSGTVI

SEQ ID NO: 16278 - protein, 240 aa, Bradyrhizobium japonicum USDA 110
MHALHVMTRDVVAVTPHTTIEEAAKIMLRMHISGLPVIDDAGNLVGIVSESDFLRRSEIGTGRKHAAWLKFFMGPRRAAAEFVHESGRKVEDVMTRQVVSAREETSLVDVVDLMEKHDIKRVPVMRGEATIGIVTRSNLLQAMASLAHEIPDPTADDEHIRERITRAVNAADWRPIGSRVDVRKGVVHLHGLITIDQARRATIVAAENTSGVKEVHDHLCLVDSYTGYYVESPEDLRAAG

SEQ ID NO: 16279 - protein, 396 aa, Fusobacterium nucleatum subsp. nucleatum ATCC 25586
MRISDRVKNMKYSAVRKLAPLAAEAEKKGIKVYRLNIGQPNIETPKLFFEGLKNIPDHVIRYADSRGISILLEQVIEVYARDGHILKKEDIIVTEGGSEALTFAMLAICNPNDEVLIPEPFYSNYKSFLDIAGAKIIPIPTDIKNDFALPKKEEIQKLITSKTKAILYSNPCNPTGKVYTEEEVKLLANLAAENDLFVIADEPYREFIYDDNDKHYSLLDIEKAKENVIIIDSVSKHYSACGARVGFLISKNKDFMTYIMKLCQARLAAPTVEQYAVASLMKAPKEYFKEIKEIYKRRRDIIVNSLNKIEGVTCSTPKGAIYAFAKLPVESSEDFCKWLLTEFVYDNSTVMLAPGEGFYETEGLGKNEVRFSFCVGENDIEKAMRVLEEALKVYKK

SEQ ID NO: 16280 - protein, 438 aa, Cordyceps bassiana
MAITKVHARSVYDSRGNPTVEVDLVTETGLHRAIVPSGASTGQHEAVELRDGDKAKWAGKGVTQAVANVNTVIGPALIKENLDVKDQSKVDEFLNSLDGTPNKGKLGANAILGVSLAVAKAGAAEKGVPLYAHISDLAGTKKPYVLPVPFMNVLNGGSHAGGRLAFQEFMIVPSEAASFTEAMRQGAEVYQKLKSLAKKKYGQSAGNVGDEGGVAPDIQTADEALDLIVESIEQAGYTGKIKIAMDVASSEFYKTEEKKYDLDFKNPESDPTQWLTYEQLAALYGDLCKKYPIVSIEDPFAEDDWEAWSYFYKTQDIQIVGDDLTVTNPLRIKKAIELKACNALLLKVNQIGTLTESIQAAKDSYADGWGVMVSHRSGETEDVTIADIVVGIRSGEIKTGAPCRSERLAKLNQILRIEEELGDLAVYAGCNFRNAVNQ

SEQ ID NO: 16281 - protein, 411 aa, Cryptococcus neoformans var. neoformans JEC21
MRQETLAFAEPEPLKPARSPSLRQSSKSPSRHPSPAASTPSFADAPLPPPPRSRFAPPRSSHPPLVSCRSVYNYTRLNHIEEGTYGVVFRARCNDTGEIYALKKLKLDEEKQGFPITSLREVMALMISGGHENVVGIREIVVGDTLNQVFIVMPFIEHDLKTLLADMPHPFLQSEVKTIMLQLLSAVAHCHANWILHRDLKTSNLLMNNRGQIKVADFGLARKFGDPLGEMTQLVVTLWYRSPELLLGGKEYTTAVDIWSIGCIFAELMQGEPLFPGRGEIDQINRIFQLLGRPNDESWPGYSTLPLVQKINPIGPMFSTLRQKFKHLTYEGHNLLSSLLCYDPERRITAEEALKHPYFSEHPLPKHPDLFSSFPSQAAGERKHKSLISPSAPVREDRMAKDSLADLDSFV

SEQ ID NO: 16282 - protein, 475 aa, Medicago truncatula
MGSSPNSKPKIVRGSAGYILEDVPHLTDYIPELPTYSNPLQDNPAYSVVKQYFVHIDDSVPQKIIANKDSPRGIHFRRAGPRQKVYFKSDEVQAAIVTCGGLCPGLNTVIRELVCGLYHMYGVKKVLGISGGYKGFYAHNTISLTPKTVNDIHKRGGTILGSSRGGHDTTKIVDSIQDRGINQVYIIGGDGTQRGAYRIFEEIRNRGLKVAVVGIPKTIDNDIPVIDKSFGFDTAVEEAQRAINAAHVEAESVENGIGVVKLMGRYSGFIAMYATLANRDVDCCLIPETPFFLEGPGGLFEYTERRLKENGHMVIVIAEGAGQELVTESIQSMHKQQDASGNKLLQDVGLWISHKLKDYFAKQKTMGITLKYIDPTYMIRAVPSNASDNVYCTLLAQSAVHGAMAGYTGFTSGLVHGRQAYIPFNRINEGQNTVVITDRMWARLLSSTNQPSFLIAKTAVEEKKKEEEEEDSFNL

SEQ ID NO: 16283 - protein, 431 aa, Cupriavidus oxalaticus
MRPGNLLLNWAAPFSNDLSSHCTMPQEAMKAPVVVLGAGLAAVSFASELRQAGYQGPLTVVGDEAEPPYDRPPLSKDFMGHGDAEKIRLDCKRAPEVEWLLGVAAQSFDPQAHTVTLSDGRTLPYGTLVLATGATPRTLPALQSAPMPVHTLRTLEDARRIQVGLRPQARLLIVGGGVIGLELAATARAAGVHVTLVETQPRLMGRAASSTLSDFVARYHAAQGVDLRFGRSVTGFTEGTVLLDDGARIAADMVVVGIGVVTNDALARAARLACDDGIFVDAFGRTTCPDVYAIGDVTRQRNPLSGRFERIETWSNAQNQGIAVARHLVDPAAPGYAELPWYWSDQGALRIQVAGLASGDEEIVRGEFSIESPKFTLIELQKGCIVGATCVNNARDFAPLRRLLAAGAQPDRAALANPATDLRKLAAAVGT

SEQ ID NO: 16284 - protein, 298 aa, Xanthomonas oryzae pv. oryzae KACC10331
MPFPVTMSEDDSSQSLEAPEKRRSWLERLSAAFSGEPHTRDELVALLRTAEQDGLIAADTLRMMEGAISVSELTVGDVMISRSQMVSLPVEARFIDLMKQVVESGHSRFPVHGENKDEVLGILLAKDLLRGVVADNGPGNVRELLRPAVLIPESKKLNVLLKEFRLSRNHMAIVVDEYGGVAGLVTIEDVLEQIVGEIDDEHDDAEDENSLIAIQADGRYVVDALTPIEDFNERFGAEFPDDEYDTVGGLVTDAIGHLPETGEELTLGRFAFRVAKADARRVHAFHVTILPPDPQDDA

SEQ ID NO: 16285 - protein, 476 aa, Ralstonia solanacearum GMI1000
MSLFRTKNLDHMIRTGQGDTGLKKVFGPLDLTFLGVGAIIGTGIFVLTGTGALTAGPALTLSFVVAALACGFAALCYAEFASTIPVSGSIYTYAYATLGELVAWIIGWDLMLEYGLATSAVSVGWSGYFQSLMAGFGLHLPAALMAAPGAIPGVQTLFNLPALLIMLIITAVLSLGVRESARFNNIMVAIKVAVVVLFIVVGARHVQPANWQPFMPFGMSGVFGAAALVFFAFIGFDAVTAAAEEVRNPERDLPIGIIGSLGVCTILYVVVAAIMTGIVPYTKFAGVDHPVSLALQMGGETWVAGFVDLGAIIGMTTVILVMGYGQTRVIFAMSRDGLLPKRLSRVHPRYATPFFNTWLVGIVFALIAAFVPLNVLAELINIGTLAAFSLIAIAVLVLRRKRPDLPRGFRCPGVPFVPAAAVVLCVFLMSQLQALTWIAFVVWMVIGLLVYFGYARSRSLLHAPDRAAVPGSEAAH

SEQ ID NO: 16286 - protein, 396 aa, Pseudomonas syringae pv. tomato str. DC3000
MSAQVLRKRICVLPGDGIGVEVMEAALPVIAALGLPFDLLHADIGWECWRREGETVPDDTWKVMASCDATLLGAITSKPLAEAEAELPLPLQGHSRRYVSPVIQLRQNLDLYANVRPVTDMTGENRFRFVVIRENTEGLYAGLDFGRIPDALVPLLEAREALGAAWQRAGQEDATVTLRLQTRSGLTRIFEYAFDYARNNNFSRVTFVDKPMVLRHSSAFARVIFEETAQRYPDITGAIENVDAVALWMVQRPERFGVIVAENMFGDILSDLGAGVMGGLGFAPSGNFGNSGAYFEPVHGSAPAHAGLTKANPSAMFLAIAMMLEHLGYPAQSDCITRAVSLVARSAVRTYDLGGSHTTCQVGEAIVQQCVELQGLLVDRRERSRSAQGERHVSAL

SEQ ID NO: 16287 - protein, 303 aa, Nicotiana tabacum
MEKYEKLEKVGEGTYGKVYKAKDKATGQLVALKKTRLEMDEEGIPPTALREISLLQMLSHSLYIVRLLCVEQIDKNGKPLLYLVFEYLDTDLKKFVDSHRKGPNPRPLPPSLIQSFLYQLCKGVAHCHSHGVLHRDLKPQNLLVDKEKGILKIADLGLGRAFTVPIKSYTHEIVTLWYRAPEVLLGSTHYSTAVDMWSVGCIFAEMVRRQALFPGDSEFQQLLHIFRLLGTPTEKQWPGVSSLRDWHVYPKWEPQNLASAVPALGPDGVDLLTKMLQYDPADRISAKAALDHPYFDSLDKSQF

SEQ ID NO: 16288 - protein, 469 aa, Corynebacterium glutamicum ATCC 13032
MTEHYDVVVLGAGPGGYVSAIRAAQLGKKVAVIEKQYWGGVCLNVGCIPSKSLIKNAEVAHTFTHEKKTFGINGEVTFNYEDAHKRSRGVSDKIVGGVHYLMKKNKIIEIHGLGNFKDAKTLEVTDGKDAGKTITFDDCIIATGSVVNTLRGVDFSENVVSFEEQILNPVAPKKMVIVGAGAIGMEFAYVLGNYGVDVTVIEFMDRVLPNEDAEVSKVIAKAYKKMGVKLLPGHATTAVRDNGDFVEVDYQKKGSDKTETLTVDRVMVSVGFRPRVEGFGLENTGVKLTERGAIEIDDYMRTNVDGIYAIGDVTAKLQLAHVAEAQGIVAAETIAGAETQTLGDYMMMPRATFCNPQVSSFGYTEEQAKEKWPDREIKVASFPFSANGKAVGLAETDGFAKIVADAEFGELLGAHLVGANASELINELVLAQNWDLTTEEISRSVHIHPTLSEAVKEAAHGISGHMINF

SEQ ID NO: 16289 - protein, 88 aa, Zea mays
  misc_feature (33)..(33): Xaa can be any naturally occurring amino acid
  misc_feature (77)..(77): Xaa can be any naturally occurring amino acid
MAFLYVVCVKPVVIKGLACCSIFGRKLDVARPXGRFMLKPHTSVVLDKYCDKSVYFDLDHIGNTNGQCDLYGFDALXPYDPLQSKFFE

SEQ ID NO: 16290 - protein, 526 aa, Triticum aestivum
MATESLRMLLGDASPWSVAGAAAAVALLWLGAWVLEWAWWTPRRLGRALRAQGLRGTRYRLFTGDVPENARLSREARLQPLPRGSHDITPRVQPMSCNVIKEHGKMSFTWFGPTPRVTIPDPELVREILSNKFGHYGKQKSSRFGKLLADGLANHEGDKWAKHRRILNPAFHHEKIKRMLPVFSTCCEEMITRWENSMPTGGLCEIDVFPEFQNLTGDVISRTAFGSNYQEGMKIFQLQGELCERLIQAFQTLFIPGYWFLPTKNNRRMRAIDREICMILRGIIGKKERAIKNNEASSDDLLGLLLESNMQQANGKANLGMSIEDIIEECKLFYFAGMETTSVWLTWTLIVLSMHPEWQEQAREEVLHQFGRTRPDFENLSRLKIVTMIWYEVLTLYPPAIFLARRTYKAMELGGIRYPAGVNLMLPLIFIHHDPDIWGKDASEFNPQRFADGISNAAKHPAAFFPFGGGPRICIGQNFALLEAKMALSTILQRFSFELSPSYIHAPYTVLILQPQHGAQIRLKKI

SEQ ID NO: 16291 - protein, 294 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKKHMDSSPEFSKDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRPLFPGDSEIDELFKIFRVMGTPNEDTWPGVTTLPDFKSAFPKWPSKDLATIVPNLDGAGLDLLDKMLRLDPSKRITARNALEHEYFKDIGYVP

SEQ ID NO: 16292 - protein, 85 aa, Oryza sativa
  misc_feature (66)..(66): Xaa can be any naturally occurring amino acid
HSNPVGNENYLHLYELGRLVVTEHNKKGNSLLEFEKLVSLKQQVVSCTFFYFTIYVNEGDAKKLYXLRFWEKPLMDFKCLQEFKP

SEQ ID NO: 16293 - protein, 146 aa, Zea mays
  misc_feature (31)..(31): Xaa can be any naturally occurring amino acid
  misc_feature (57)..(57): Xaa can be any naturally occurring amino acid
  misc_feature (65)..(65): Xaa can be any naturally occurring amino acid
  misc_feature (89)..(89): Xaa can be any naturally occurring amino acid
  misc_feature (113)..(113): Xaa can be any naturally occurring amino acid
MASLVAVSEKPVAIKGLAGSSISGTKIIRAXMAVDSRSIRRSLATVVVDKYGDKSVXYFDLDDIXITTGQWNLYGSDATSPYKPLHSKXFETIANPFTKRCLLLEILLLGDGXFWATSARSPDTGPLCSIEKGHQEPPQTSARDKI

SEQ ID NO: 16294 - protein, 544 aa, Burkholderia mallei ATCC 23344
MGKPLLGQMMDMPLLVSSLIAHAARHAGDVEIVSRRVEGDIHRYTYRDCEARSKRLAQALTGLGVGERIGTLAWNGYRHVEAYYGISGMGAVCHTINPRLFPEQIAYIVNHAEDRYVLFDLTFAPLVDQLAPQCPNVKGWIAMTDDAHLPKGATPYLCYETLVGAQDGDYAWPLLDERQASSLCYTSGTTGHPKGALYSHRSTVLHAYGAALPDAMGLSSRDAALPVVPMFHVNAWGLPYTAALTGTKLVLPGKDLDGKSLYELIESERVTFSAGVPTVWLGLLGYMREAGVRFSTLERTVIGGSACPPSMLETFEDVYDVRVIHAWGMTELSPLGTLAKLNWAQSQRGIGEQRRLLEKQGRVIYGIDMRIVGEDGRELPWDGVAFGDLQVRGPWVIDRYFGIDASPLVDGWFPTGDVATIDADGFLQITDRSKDVIKSGGEWISSIDVENVAVAHPAVAEAACIACAHPKWTERPLLVVVKRAGMDVTRDELLAFYEGKVAKWWIPDDVAFVDALPHTATGKLQKLKLREQFRGHVLPTAVDA

SEQ ID NO: 16295 - protein, 155 aa, Capsicum annuum
MANPKVFFDLTIGGQPAGRVVMEMFANDVPKTAENFRALCTGEKGVGRMGKPLHYKGSTFHRVMPGFMCQGGDFTAGNGTGGESIYGAKFADESFRGKHTGPGVLSMAIAPGTNGSQFFIICTAETELLDRKAVVFGQVVEGFDVISSVIISPNI

SEQ ID NO: 16296 - protein, 525 aa, Corynebacterium diphtheriae NCTC 13129
MTQQTSQKHNPVLVVDFGAQYAQLIARRVREANIYSEVVPHTATVEEIKAKNPAALILSGGPSSVYADGAPSLDPQVLELGIPVFGICYGFQAMTHALGGTVANTGNREYGRTEMTVDGGILHADLEETHKVWMSHGDAVSVAPEGFVVTAHSEGAPVAAFECAEKRMAGVQYHPEVLHSPHGQEVMVRFLTEIAGLEQNWTAANIAEELIDAVCAQVGPEGRAICGLSGGVDSAVAAALVQRAIGDRLTCVFVDHGLLRAGEREQVQTDFVAATGAKLVTVDEREAFLNKLAGVTEPEAKRKAIGAEFIRSFERAVAGILDDAPEGSTVDFLVQGTLYPDVVESGGGSGTANIKSHHNVGGLPDDVEFQLVEPLRLLFKDEVRAVGRELGLPEEIVNRQPFPGPGLGIRIIGEVTEERLETLRAADLIARTELTAAGLDSEIWQCPVVLLADVRSVGVQGDGRTYGHPIVLRPVSSEDAMTADWTRLPYDVLEKISTRITNEVSDVNRVVLDCTSKPPGTIEWE

SEQ ID NO: 16297 - protein, 228 aa, Bradyrhizobium japonicum USDA 110
MHARDVMVSPVVTVGPNATVRQVAQILLERRISAVPVVDADNKVLGIVSEGDLLHRAESGTERSPSWWLRLLTGDAQLATDYVKSHSIKVQDVMTQEVATAAPETPLHEIAMLLEERQIKRVPIVNKEGQLVGIVSRANLLQTIASARPKLEISLPDSVIRKRFFEELRKQPWAHTFNVNATVQNGVVDIWGFAPSVAERTAIRVAAEAIPGVATVNDHLLETPAFVY

SEQ ID NO: 16298 - protein, 121 aa, Chlamydia trachomatis D/UW-3/CX
MGNLIKELQDEQCRTDLADFCVGDTIRVATNISEGGKERVQVFQGTVMARKGGGAGETVSLHRVAYGEGMEKSFLLNSPKIVSIEVVKRGKVSRARLFYLRGKTGKAAKVKELIGSRAAKK

SEQ ID NO: 16299 - protein, 497 aa, Cordyceps bassiana
MTLTVQLSTPATGKYDQPIGLFINNEWVEGVDKKKFEVINPSTEEVITSVCEATEKDVDLAVAAARKAFETTWKETTPAERGVLMNKLADIAEKNTDLLAAVESLDNGKSITMAKGDVGAVVACIRYYAGWSDKIHGKTVDVAPDMHHYVTKEPIGVCGQIIPWNFPLLMLSWKIGPALATGNTIVMKTTEQTPLSALVFAQFVKEAGFPPGVFNLISGFGKTAGAALSAHMDVDKIAFTGSTLIGRTILKAAAFSNLKKVTLELGGKSPNIVFNDADIESAISWVNFGIYYNHGQCCCAGTRIFVQEGIYDKFLEAFKKRAAANTVGDPFDTKTFQGPQVSKLQYDRIMSYIQSGKEEGATVEIGGERHGDKGFFIKPTIFSNVRSDMKIMQEEIFGPVCSISKFSTEEEVIKLGNETTYGLAAAVHTKDLNTSIRVSNALKAGTVWVNCYNLLHASVPFGGFKESGIGRELGEAALDNYLQTKSVTVRLGGPMFG

SEQ ID NO: 16300 - protein, 104 aa, Zea mays
GRHSYESVSSIPQKSLYLNEQYLNVKKAMVDAFFGPPERSVYSASVQSTLLQMAKAVLGRFSDISSVKLKMPNIHFLPVNISSKDHGSIGKFDDDVYLPTEWDT

SEQ ID NO: 16301 - protein, 404 aa, Mycobacterium smegmatis str. MC2 155
MRELPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIIIFGADHVYRMDPEQMMQFHIESGAGATVAGIRVPRSEASAFGCIDADESGRIREFIEKPADPPGTPDDPEQTFVSMGNYIFTTKVLIDAIRADADDDHSDHDMGGDIIPRLVADGMAAVYDFKNNEVPGATERDHGYWRDVGTLDAFYDAHMDLVSVHPVFNLYNKRWPIRGESENLAPAKFVNGGSAQESVVGAGSIISAASVRNSVLSSNVVVDDGAIVEGSVLMPGVRIGRGAVVRHAILDKNVVVGPGEMVGVDLDKDRERFAISAGGVVAVGKGVWI

SEQ ID NO: 16302 - protein, 1442 aa, Mougeotia scalaris
MDRTIDISDEKWQSRFAAQSSQAAESQYSSDALLNEEYENASIHGSFVSYKELMKSSAEAPKPWEVDQIAYLEKMRRSGLTQRFGTMLVVEPPLRHAQKLHLLAHSENAVDLPGIEPRELEIGGDILPFFTSESGKALFSEAASKGDSVKTAIVTGRDGETKFYAICHRNACGVIIDLEPVVPKGIHTSYEPNLDTSSPPLSMEAALDIVQPAIQRLKAIPAGSVQEICDTVTREVRELLQYDRVIVYKFHPDQHGEVFAESAKEGLDPYVGLHYPSTDLPQAIRVLLLRVGIRMICDATQSMVKIVQPDDVEPVDLSDSTLRAPHGCHAQYMINMGSLSSITFAIVVESDKTVRAGEEPEKERTLWGIIVGHHSIPRFTPYPLRKAVQSLAETFGSLLTREIALAASWHEEKTLNMQKKLCDMLEADIPLGIVIDSPNIQDLVKCDGAALFFSGRFWLLGSTPTERQVADLAEWILKHLSKKGAVCTDSLAEAGYPNADELGSKTCGMVAVKVGKRDFVFWFREHTAKVVRWAGQRQKKEEIDDESKMMPRNSFKAFMEIVRERCLPWEDIELEAINGLRLMLQDALDVSRGADIPVVVGGTTIEGDPFDGAGYHESTSEKPVSAITSEVEAALSAVEACFLITDATQESRPIIYCSHVFSTLTGYSAGELEGGTLEKLEGLETDVAAASKLHLALSGRTQYSGRLLHYKKDGTPFWNLITCGPIKNGQNEVVNFVIVFQELAKYHEISSVPPNLVDGDLSAPEKGFPVSLIRYDGRLKEKSSRIVDEIIRLVKNPATIADSLALLGQMSAMASPAVSQVESVPVVEHRERHSSMHIAKPAATKTSRRRSLVEVLLGKGREIEAPVKEAFDSDVKSDDGKKRRAAKGIDLGTTLERLDYGFLVIDTRLDECPIIFMSDRYILQTQHTREENIGGDILFLDGEESSPAEVDKIRKAVQNNDELSLQLVAYRKNGDKFWALYHLSVAKDKDGNALYIINVVKDLGEAQISDAAFRKEDAEARKEAAEITRALHDLPDTAAYELWTVHSKFVASKPHRAWDSAWTAIKEVREKEGRLCLKHFKPIKPLGNGDSGSVVLVELRGTGHVFAAKIMEKERMIERNKVHRIASEREILNQLDHPFLPSLYASFQTTKHVCFITNFCPGGELYDFLEIQPYHRFEEHVAQFYAAEILTSLEYLHCQGVVYRDLNPENILLAEDGHIVLTDFDLSILSSTFPKLIREANGTSKRKSSRRPSKERAPTFVAEPTMRSNSFVGTEEYISPEIVTGEGHGPSIDWWSFGILIYEMLYGETPFCGSSMNKTFHNILNKEVAFPSPVPVSDMAKDLITSLLIKDSEKRLGSKLGAAEIKVHPFFHGINWPLIRNKKVVPPKVPNKLNSVVGGHEEQDISSNHWRLQDTNNDSNRSFPIMSFDGSIIDATEDRSTW

SEQ ID NO: 16303 - protein, 323 aa, Mycoplasma genitalium G37
MDKIAILTSGGDASGMNATIAYLTKYAIAKQLEVFYVKNGYYGLYHNHFITSKELDLTDFFFMGGTVIGSSRFKQFQDPSLRKQAVLNLKKRGINNLVVIGGDGSYMGAKALSELGLNCFCLPGTIDNDVNSSEFTIGFWTALEAIRVNVEAIYHTTKSHNRLAIIEVMGRDCSDLTIFGGLATNASFVVTSKNSLDLNGFEKAVRKVLQFQNYCVVLVSENIYGKNGLPSLEMVKEHFENNAIKCNLVSLGHTQRGFSPNSIELFQISLMAKHTIDLVVNNANSQVIGMKNNQAVNYDFNTAFNLPKADRTKLLNQVNTAII

SEQ ID NO: 16304 - protein, 403 aa, Arthrobacter keyseri
MGSSIGGVRTAQSLRLEGYEGRIVLVGEETELPYDKPPLSKTVLAGTATEASICLLDRDQAQELGIELQLGRAATGIDIAGNLLNLQGQEALHFDNLVIATGASARPSPWGQRPGIHVLRTLDDGRSLRADLAKGGHLAVVGAGFIGAEAAATARALGLEVTVIDPLPIPMSRIFNAEVGQWFGDLHSSNGVKTIFGTGVESIDGEQGSFALRLTNGQNLEAATILVGIGAVPNDAWLASSGLLVDNGLVLDEYCRTVDAPHIYGVGDVARWRHQKHGEDIRIEHWTNAVEQAACVAYNITHPETPRAYTPVEYVWSDQHDWKIQVVGRVGGKAEHVVIGHPEVHGRFAALYTVDGTSLSGAAIVNWPKALLACRRGMGTGITVQELREKLEPMLDPQPLAAS

SEQ ID NO: 16305 - protein, 896 aa, Ralstonia solanacearum GMI1000
MSAVPEQVLGATRASDVDPQETKEWLEALQGVIGAEGPDRAAFLLDKQLEYARINGVTSPLHAETPYINTIPVENQERIPGDQEIEHRIRSFTRWNAMAMVLRANKDTNVGGHISSFASAATLYDVGYNHFWHAPSDKHGGDMVFVQGHSAPGVYSRAFLLGRLSEDQLDSFRQEVDGKGISSYPHPWLMPDFWQFPTVSMGLGPIMAIYQARFTKYLASRSLIQNFENRKVWAFLGDGETDEPESLGAIGMAGREKLDNLVFVINCNLQRLDGPVRGNGKIIQELESEFRGAGWNVIKVIWGSRWDQLLARDTKGLLMSRMMECVDGEYQTFKSKSGAYVREFFFNTPELKAMVADWSDDDIWALNRGGHDPHKIFAAFKSATEHKGQPTVILAKTIKGYGMGEAGEAMNIAHQQKKMPVDAIRKLRDRFNIPVADDQLEHVPYVKFEEGSKELEYMRRARMDLGGYLPARRQKADALQVPALAAFDALLKATGEGREVSTTMAFVRILNILLKDKNVGKHVVPIVPDESRTFGMEGLFRQVGIWNQEGQKYVPQDHDQLMFYKESQTGQVLQEGINEAGAMCDWIAAATSYSTHGVAMIPFYIYYSMFGIQRIGDLCWAAGDMRSRGFLLGGTAGRTTLNGEGLQHEDGHSHVYHAAIPNCISYDPTFQYELAVVMQDGLRRMYVEQEDVYYYLTVMNENYEHPEMPAGAEADIIKGMYLFKKGVENSNAPRVQLLGSGTIFREVIAAAELLKKDWGVESDLWGCPSFTELAREGNAAARWNLLHPTDAPRESHVEKMLKGVRGPVIASTDYVRTFAEQIRAFVPRRYVVLGTDGFGRSDTREKLRHFFEVDRYWVTVASLKALADEGVLPREKVAEALKKYNLDPNKPNPMTV

SEQ ID NO: 16306 - protein, 491 aa, Malus x domestica
MTSILMGYDIGVMSGASIYIEKDLKVTDTQIEIMIGVIEIYSLIGSAMAGKTSDWVGRRYTIVISGAIFFIGAILMGFSTNYTFLMCGRFVAGIGVGYALTIAPVYSAEVSPTSSRGFLTSFPEVFVNIGILLGYLSNYAFSFCPLDLGWRLMLGVGAIPSVGLAVGVLAMPESPRWLVMQGRLGEAKRVLDRTSDSKEESMLRLADIKEAAGIPEECNDDIVQVSGHSHGEGVWKELLVHPTPTVRHILIAAIGFHFFQQASGIDALVLYSPRVFAKAGITSTNQLLLCTVGVGLSKTVFTLVATFFLDRVGRRPLLLTSMAGMVGALVCLGTSLTMVDQHEGVRMTWAVILCLCCVLAYVGFFSSGIGPIAWVYSSEIFPLRLRAQGCGMGVAVNRLMSGILSMTFISLYKAITMGGTFFLYAAIGTVGWIFFFTMLPETQGRTLEDMEVLFGKFHKWRKANKLLEKKKRVAHGDIGTSDPDNRAHLLA

SEQ ID NO: 16307 - protein, 165 aa, Triticum aestivum
  misc_feature (83)..(83): Xaa can be any naturally occurring amino acid
  misc_feature (101)..(101): Xaa can be any naturally occurring amino acid
  misc_feature (122)..(122): Xaa can be any naturally occurring amino acid
MAGMTVGNKLALAAVLLCAAAAMATAQQASGVRATYNFYNPQQNNWDLNAVSAYCATWDASKPLSWRMKYGWTAFCGPAGPTXQAACGQCLLVTNTATGAXITVRIVDQCSNGGLDLDYDTXFKPIDTNGRASRPATQVNTIRQCGTTELIDYHLSCTICLQYPE

SEQ ID NO: 16308 - protein, 291 aa, Campylobacter jejuni RM1221
MQFTFEQIFIAMLLTLFAGFSTAIGSIIAFFSRKDDLRVLSLGLGFSAGVMIYISFMEILPTALKDFKNYYNSHWAELLGLACFFGGILISLLIDKLIPEDVNPHEPKEDLSELKICPLPQKGQNPPKFHPGEKLHQINTKALKRTGIFTALAIAIHNFPEGFATFISSLDNLTLGIAIAIAVAIHNIPEGLAVSLPIYHATGDKKKAFIYSALSGFAEPLGAFVGALILLPFIGDLTLAISFAVIAGIMVFISLDELLPAAKTYDKAHDSLYGLIAGMMIMALSLNLLEY

SEQ ID NO: 16309 - protein, 424 aa, Ehrlichia ruminantium str. Gardel
MEYHMLFLANPFFHYKSNVLNIENVSVLDITNSIGTPVYCYSLNAIKNNYIQFKENLPNNSIICYAVKSNSNLSILSLLSSLGSGADAVSEGEIRRAITAGISPNKIVFSGVGKTEQEISFALDNRILQLNVESIEELQLINKISYHKNIIAPVSIRINPNINANTNDKITTGLKVNKFGIPEESLDQVFNSSLTNIKIIGISVHIGSQIANLGIFQNTIDKVKRIVKIFEQHNIHILRVDMGGGLGIPYKNSDIFPTIQEYTNLLKNNFEKESYNIICEPGRAIVGNTGILLAKVLYHKSNYEKNHLVLDTGMNDLIRPALYNAEHTIIPAVVSSKSHLSFDIVGPICESDDTFAHSYWINNVDNNEIVAICTVGAYGSSMSSNYNSRPLVPEVIVNKDNYHIIRHRQTYNDMLKDEIILKFK

SEQ ID NO: 16310 - protein, 362 aa, Campylobacter jejuni RM1221
MPADLNDYFNKKNRNSNNNGNNNRQNFNFKAPEFNFKGFGKFSPFIYGVIIIILFLIVAKPFMVINSGEMGIKSTTGKYDPNPLEPGLHFFLPFVQKITIIDTRVRQINYASIEGSNENLSSGSGVINKNSISVLDSRGLPVSIDVTVQYRLNPLQVPQTIATWSLNWENKIIDPVVRDVVRSVVGKYTAEELPTNRNTIAAQIEEGIRKTIEAQPNEPVELRAVQLREIILPSKVKEQIERVQIAKQEAERTKYEVERANQEALKKAALAEGEANATIISAKGKAMAVKIEADAQAYSNKEIANSLNTPLLNLKQIETQKEFNEALKVNQDAKIFLTPGGAVPNIWVDTKDAKKQSSANIN

SEQ ID NO: 16311 - protein, 444 aa, Bradyrhizobium japonicum USDA 110
MPTTQLPNTASLRPGFIWGVSTSSFQIEGATKEDGRGLSIWDIYCRSGEIKNHDTGDVACDHYHRYREDVGLMKTLGVQAYRFSVAWPRVLPLGLGSANEAGVSFYDRLIDELVAAGIEPWLCLYHWDLPQALEERGGWLNRESAAWFADYVTLIAARFGDRVKRFATFNEPSIFSLFSRSLGKREHSSEDKFHRMIHNVNLAHGAAVDVLRANVIGASIGCIHNRQPCRPSSASEADEAAAARLDVYWNAAFPDPQCRGEYPPSMRAAIEPHMQPGDLTRICRPLDWFGLNHYSPVYVKARADSMLGYDFGDKPASVPLTPIGWPIDPEAFSETLQAVRTRYGLPIYVLENGYGDSGQPDQTGAVIDPGRIEFLKAYINAMNNAAAHGVDVRGYFVWSLLDNFEWASGYSIRFGLTYVDYASLRRIPKSSFGWYAGLIRAVQP

SEQ ID NO: 16312 - protein, 203 aa, Triticum aestivum
  misc_feature (187)..(187): Xaa can be any naturally occurring amino acid
MMTRSPEPAAEQKASSSFGNLLSIFLRVSSSETKPPRRSFDAEGVVGLGIVAAMSRACLTAQPIAIGAAARRRGREEDELSESYTCVITHMAAGADEGGSMRKRVYFGFGDGGDGWFVEAAEEAPARADDFLSRCCLCNKRLDGLDIYMYRGEKAFCSSECRCHQMLMDDHAEKCGSEALRASSYSXSPCSAPMSFSPSVAAA

SEQ ID NO: 16313 - protein, 325 aa, Bradyrhizobium japonicum USDA 110
MIKATLEGRAALLADVGGTNARFALLTDGELGAITHMAVKDYATFQEALAAYLGASARAERPAHAILAASGAVQNARCALTNNSWIVDAEELRGAYGFSAVRLINDFEAVAWALPRLGPDSLLQLGGRQQVPGAPLAAIGPGTGLGMAVSIPHPGGQIVLASEGGHATLAGGSLREDAVIEHLRQRFGHVSAERILSGAGLENLYDALACIDGATPPKRRASDITRAGIEGTCPISRSAVDMFCAMLGSVAGNLALALTARGGIFIGGGILRHLPDYLAASQFRQRFEEKGRLRKFLEPIPAYLILDDDVAFVGLRNLMEVEGIG

SEQ ID NO: 16314 - protein, 228 aa, Leifsonia xyli subsp. xyli str. CTCB07
MTELTPHAMPAAVFWDMDGTLVDTEPYWMDAERELVASFGGVWTHDDALLMVGLGLWNSAEILRSRGVHMEADAIVAWLTGRVRERLADDGVPWRPGARELLASLRERHVPTALVTMSLRSMAEQIVDRIPFAAFDAIVSGDEVDEPKPHPEPYLRAARLLGVEVREAVAIEDSLVGLASAVASGAVAIGVPHIVPLPESEEHTLWPTLDGRSAEDVAAVAAARRAAL

SEQ ID NO: 16315 - protein, 374 aa, Oryza sativa (indica cultivar-group)
MTKHGAVVVPEDAVVAAAAVGRHFSFPPPRTGGVGGDSCKKLAAQQIDLGAAVIGSWLDSMKASSPRHRLVAPAVAAAAADAEHDEWMEKHPSALGKFEALAAAAKGKRIVVFLDYDGTLSPIVEDPDRAVMTDEMRDAVRGVAARFPTAIVSGRCRDKVLSFVGLEELYYAGSHGMDIQGPTNAAASKGGEEEEESVLCQPAREFLPMIGEAYAALVEKVEGVIPGAKVENNKFCLSVHFRRVDERRWGAVADQVRAVLRGYPRLRLTQGRKVLEVRPAIKWDKGEALRFLLSALGFSAAGDGEDDGDDDDAFPIYIGDDRTDEDAFRVLRARGHGAGILVSRFPKDTCASFSLRDPGEVKDFLRKLVTCAAA

SEQ ID NO: 16316 - protein, 331 aa, Streptomyces microflavus
MPIRMPSAHVPTIDISPLFGTDPDAKAHVARQINEACRGSGFFYASHHGIDVRRLQDVVNEFHRTMTDQEKHDLAIHAYNENNSHVRNGYYMARPGRKTVESWCYLNPSFGEDHPMIKAGTPMHEVNVWPDEERHPDFRSFGEQYYREVFRLSKVLLRGFALALGKPEEFFENEVTEEDTLSAVSMIRYPYLDPYPEAAIKTGPDGTRLSFEDHLDVSMITVLFQTEVQNLQVETVDGWQSLPTSGENFLINCGTYLGYLTNDYFPAPNHRVKYVNAERLSLPFFLHAGQNSVMKPFHPEDTGDRKLNPAVTYGEYLQEGFHALIAKNGQT

SEQ ID NO: 16317 - protein, 345 aa, Zea mays
MGYLWRVRLSSFAAGAATASAAGFFLLYKDHLLARAADAESNSASYSPPLATADTAFSAPPRAVAPADLQLSGSYASDIYTYLRSLEVDPQRRSRSDYIEAVQADVTAHMRSILVDWLVEVAEEYKLVADTLYLTISYVDRFLSVNALGRDKLQLLGVASMLIAAKFEEISPPHPEDFCYITDNTYTKEELLKMESDILKLLKFELGNPTIKTFLRRFIRSAHEDKKGSILLMEFLGSYLAELSLLDYGCLRFLPSVVAASVMFVARLTIDPNTNPWNTKLQKMTGYKVSELKDCIVAIHDLQLNRKCPSLTAIRDKYKQHKFKCVSLILVPVVIPTSYFEDLAE

SEQ ID NO: 16318 - protein, 257 aa, Oryza sativa
  misc_feature (176)..(176): Xaa can be any naturally occurring amino acid
MAAIRRFRPALLLAAILLLAAGAVEGKKGGKVDVALYYESLCPYSAMFVVGSLAKVFRDGLLDAVDLSLVPYGNARVKDGKISCQHGSEECFLNTVEACAIDAWPDLRVHFRFIYCVEDLVVNHKQREWESCFGKLNLDPKPVTDCYKGERGHQLSLKYGRQTDALQPPHKYVPLXWVVDGQPLYEDYENFEAYICKAYKGHPPKVCEGLARPPTPTVLEVAEAVNRVSYYDSGDIRLKPDEDGHAKIKKVVPDDDD

SEQ ID NO: 16319 - protein, 554 aa, Ralstonia solanacearum GMI1000
MSQVVEIKVPDIGDYKDVPVIELHVKAGDTVSAEDSLVTLESDKATMDVPSPKSGVVKEVKIKVGDAVSEGSLVLLLEEQGATAASAPQAAPAPAPVAAALAPAAQAPVSAPAAQPAAGGGTIEVKVPDIGDYKDVPVIEISVKVGDKVEAEQSLITLESDKATMDVPSPAAGTVKDIRVKVGDAVSEGTLIVVLEGAGGAAAAAPAPAPAPAAAAPSPAPAVAPVAAPAAAPATYTADTVGTIGKAAHASPSVRKYARELGVDVNLVGGTGPKNRITQEDVQRYVKGVMTGQAAAPGKAAAAAAPAGGGELNLLPWPKVDFTKFGPVEPKPLSRIKKISGANLHRNWVMIPHVTNNDEADITELEAFRVQMNKEHEKAGVKFTMLAFVIKAVVGALKKFPTFNASLDGDNLVFKQYYHIGFAADTPNGLVVPVIRDADKKGVVDIAREMAELSKAAREGKLKPDQMQGGCFSISSLGGIGGTHFTPIINAPEVAILGLSRGYQKPVWDGKQFVPRLTLPLSLSYDHRVIDGAEAARFNAYLAAVLADFRRVLL

SEQ ID NO: 16320 - protein, 438 aa, Corynebacterium glutamicum ATCC 13032
MQAKEEEKRAFDNDRAHVFHSWSAQDKISPKVWAAAEGSTLYDFDGNAFIDMGSQLVSANLGHNNPRLVEAIQRQAARLTNINPAFGNDVRSDVAAKIVSMARGEFSHVFFTNGGADAIEHSIRMARLHTGRNKILSAYRSYHGATGSAMMLTGEHRRLGNPTTDPDIYHFWAPFLHHSSFFATTQEEECERALKHLEDVIAFEGAGMIAAIVLEPVVGSSGIILPPAGYLNGVRELCNKHGILFIADEVMVGFGRTGKLFAYEHAGDDFQPDMITFAKGVNAGYAPLGGIVMTQSIRDTFGSEAYSGGLTYSGHPLAVAPAKAALEIYAEGEIIPRVARLGAELIEPRLRELAEENVAIADVRGIGFFWAVEFNADATAMAAGAAEFKERGVWPMISGNRFHIAPPLTTTDDELVALLDAVEAAAQAVELTFAGALF

SEQ ID NO: 16321 - protein, 428 aa, Acidovorax sp. JS42
MALLQWNERPAQVLQGGGVIGPDERLPWAQTGLMGIQHVIAMFGATVLAPILMGFDPNVAVLMSGIGTLIFFLITGGKVPSYLGSSFAFIGVVIAATAYAGKGPNANIGVALGGIIACGLVYTLVGVVVHLVGTGWIERFMPPVVTGAVVAVIGLNLAGIPIKNMAANNFEAWMQALTFVCVALVAVFTSGMLQRLLILVGLIIASLLYALLTNGMGLGKPIDVSGIANAAWFGLPQFHAPVFSAPAMLLIVPVVIILVAENLGHIKAVTAMTGKNLDQYMGRAFIGDGVATMVSGAVGGTGVTTYAENIGVMAATRIYSTAVFLVAALLAVLLGFSPKFGALIQAIPLPVMGGVSIVVFGLIAIAGAKIWVDNRVDFSQNKNLIVAAITLILGTGEFTLKFGDFALGGIGTATFGAIVLYAALNRGK

SEQ ID NO: 16322 - protein, 594 aa, Ralstonia solanacearum GMI1000
MSVVEIKVPDIGDYKDVDVIEVMVKAGDVVAVDQSLITLETDKATMDVPADVAGRIVEVKIKVGDKASQGTVIATVEAGAAAAAPAPTQAPAPAAAPAAAPAASAPAPQAAKHGGSADLECDMLVLGSGPGGYSAAFRSADLGMNTVLVERFGTLGGVCLNVGCIPSKALLHTAAIMDEVKAMASHGIVYSEPKVDLDQLRKHKETVVGKLTGGLAGMAKSRKVQVVRGVGTFLDPNHLEVQLTSGEGKQATGEKKVIRFAKAIIAAGSESVKLPFIPEDPRIVDSTGALELRQVPGKMLVIGGGIIGLEMATVYSTLGARIDVVEMLDSLMNGADRDLVKVWDKMNKSRFDKVMLKTKTVGVEAKPDGIYVRFEGEQAPAEPQRYDMVLVAVGRSPNGKRIGAEKAGVAVTDRGFIDVDKQQRTNVPHIYAIGDIVGQPMLAHKAVHEAHVAAEAAHGEKAYFDAKQIPSVAFTDPEVAWAGLTEDQCKAQGIKYGKGVFPWAASGRAIANGRDEGFTKVIFDEETHRIIGGGIVGTHAGDLISEICLAIEMGADAIDIGKTIHPHPTLGESVGMAAEIYEGVCTDVPPARKR

SEQ ID NO: 16323 - protein, 148 aa, Vigna radiata var. radiata
MADPLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMA

SEQ ID NO: 16324 - protein, 123 aa, Zea mays
MLLMALALALTAVALAAPPALRRSRFLADKTPPPLSYYDCVRKPPSVCLEPGSPGNTCCKGTCTNTLSSVEHCGNCNRKCKYGDTCCDGKCVDLLKDKKNCGECSNQCANSVKCEFGMCDYAG

SEQ ID NO: 16325 - protein, 531 aa, Burkholderia mallei ATCC 23344
MILPAASPLPRSLEPFDAPPIHASAPLLSVAELRDIETAAAAALPPHTLMERAGKSAAQWLAARLVSDPRPVWFAVGPGNNGGDALVAAAELRRLGFAADAWMPIEVKPDDARWALERARAANVPIDEAAPESFDGYGWLVDGLFGIGLARPLDGAFAAIAQRIAARARHTGRVLALDVPSGLDSDTGARVGGGTAVTATCTLSFIAAKPGLYTGDGRDLAGEIHVAPLDLGEPPAPAIRLNAPELFEARLPERAFASHKGTYGSLGIVGGDTGMCGAPILAARAALFAGAGKVHVGFVGTGAPPYDPPYPELMLHPADALPSASLTALAIGCGLGASERAARVLAALLPLDAPKLIDADALNLIATTPALAATLAARGRTGDAAVLTPHPLEAARLLATDAADVQRDRVAAARALCARFSAVVVLKGSGTVIAAPDGRLAINPTGNAALATGGTGDVLGGLIGAFLAQRMPRYEAALAGVYLHGLAAERLCAAGAGPAGLAAGELAPAVRALVNRLFYTRPAAPDEAPLY

SEQ ID NO: 16326 - protein, 762 aa, Azoarcus sp. BH72
MDQDFIAAALDYHRAPTRGKISVVPTKGLTNQRDLALAYSPGVAAACDAIVADPAEARELTSRGNLVAVVTNGTAVLGLGNIGPLAAKPVMEGKGCLFKKFANIDVFDIELAENDPDKLIDIIASLEPTLGGINLEDIKAPECFYIEKKLRERMKIPVFHDDQHGTAIISAAGLINGLKVIGKNIAEVKLVCSGAGAAAIACLDLMVSVGLKRENVYVCDSKGVIYQGREENMEPTKARYAQITEARTLGDVIAGADVFLGLSTAGVLKPEMVAKMADKPLIFALANPNPEILPADAKAVRPDCIIATGRSDFPNQVNNVLCFPFIFRGALDVGATTINEEMKLACVKAIAELAQAEQSDVVASAYGGAELSFGPEYIIPKPFDPRLIVKVAPAVAKAAMESGVATRPIEDFEAYIASLTDLVYTSGMVMKPVFSAAKRVPLEQKRVVYAEGEDERVLHATRVVIDEGLARPILVGRPSVIEMRIKKIGLNLVPGRDFDVVNPESDPRYRDLWNEYYRLKGRDGVTPDIAKAKMRRDTTLIGAMLLRTGDADALVCGTFGTYEYHFQHVQDVIGLRAGAKQFAAMNLLMLPKRTLAITDTYVNEDPSAEEVAEIARMAAEELRRFGIEPRVALLSHSNFGSSRSASARKMREASELLRQLAPELECDGEMHGDAALSVEIRNKVHPDSSLVGEANLLVMPNLDAANISFNLMKIANGDGVSVGPILLGAAKPVHILTPSATVRRLVNITALAVVDAQESRRA

SEQ ID NO: 16327 - protein, 540 aa, Burkholderia mallei ATCC 23344
MTLNSLPVWPALQAHYEEIRDAHLRDWFAPANDRAPTRAERFTFEGGGLAADFSKNRLTDATLALLVRLAREAGVEARRDAMFAGETVNPTEGRAALHTALRANAPDAPFQAQVAAERAKMARFADAVRSGAWTGYTGKRIRHVVNIGIGGSDLGPKMVVHALHHVATPDIATHFVSNVDGADLARVLERIDPEETLAIIVSKTFTTLETMTNARSLRDWFVANGCPEGALAKHFVGVSANPAEVVKFGIAEANVFEMWDWVGGRYSLWSAVGLSIMIAIGPERFDELLAGARDMDEHFRTAPLERNLPVLQGLVGIWYRNFFGAQSYLVAPYSEALHYLPSYLQQLEMESNGKSARIDGAFVDYPTSAVTWGEPGTNGQHAFFQMLHQGPTLVPIDFIAVLTPEHPLASHHPKLLANCFAQSEALMLGRTLDEARKIAGPAKPELAPHLTFPGNRPTTTLLVDALTPRTLGALIALYEHKVLVQAAVWNINPFDQWGVELGKILGKVVEADLTAAQVDPAKHDSSTSALIARARKALGE

SEQ ID NO: 16328 - protein, 666 aa, Chlamydia trachomatis D/UW-3/CX
MESLSVRSTIPLPLGAKKLSADRYRFSLFSSQAQQVTLVLLDPLSEIHEIPLSSTDHRTGAIWHIEIAGISSEWSYAYKLRGTDLSSQKFATDSYIADPYSKNIYSPQLFGSPKQEKDYAFSYLKHEDFDWEGDTPLHLPKENYFIYEMHVRSFTRDPSSQVSHPGTFLGIIEKIDHLKQLGVHAVELLPIFEFDETVHPFKNQDFPHLCNYWGYSSVNFFCPSRRYTYGADPCAPAREFKTLVKALHRAGIEVILDVVFNHTGFEGTSCPLPWIDLESYYMVNDHGDLMNFSGCGNTVNTNTPTTLKWILDALRYWVQEMHVDGFRFDLASVFSRDPQGVPLPLTPILQAISSDSILSETKLIAEPWDAGGLYQLGHFPSISTRWSEWNGCYRDHVKAFLNGDAHQVSSFASRISGSHDIYPNGKPTNSINYICSHDGFTLYDTVAYNDKHNEENGEYNRDGTSANYSYNFGCEGETTDPTICALRERQMKNFFLALFLSQGIPMIQSGDEYGHTAYGNNNHWCLDTKINYFLWDRLAERKELFSFLCQVIALRKAYTELFNTSFLSEDTITWLNTKGSPREWGADHYLAFELKHLNYSLFVAFYSGNERIEISLPKPRKEHLAYEKIVDSTTGFFSQILSPKLSLEPYSSLVAISRRKTSLESR

SEQ ID NO: 16329 - protein, 518 aa, Aspergillus oryzae
MIPLLILAALAVVFRLVWSIFTSLRHAQNARKWHCGAIPTYPGDILGINTLKEVLRADKEKLIPVLSAQRVETMTAREGRYVSTFRLRQMGRESIFTSDPKNMQAILATQFKEFELGSLRRNSLHPLLGSGIFSTDGEAWSRSRSLLRPQFTRDQVSDLDLEERHVQKAMAGMLADPATKWTPEIDIQSIFFRLTIDSATEFLFGDSVESQTAALSGSRIIEDKFPSYFDRGQWYAAQRARFEKLYWIVNNKESRETDRFVHAYVDRFIDAALAAVKEGKIDPEKRNSDHYVFLHGLTTATQDPVELRSQLLNILLAGRDTTASLLSWCVLLLARHPDIFQKLRNTILADFGDYRNPRNITFSSLKSCRYLHYFMNEVLRLYPIVPGNRRVALKDTTLPRGGGPDGSEPVYVRKGQPVVYSVFVTHRRKDIWGADAEVFNPDRWEDLKVGWEYLPFNGGPRICIGQQFALTEAGYVLVRLLQRFDQIVDARPEREIRFNATLTSAPWENVIVRLREGA

SEQ ID NO: 16330 - protein, 1007 aa, Zea mays
MAASASFLPILLLLLLLANAVRALNQDGVHLLEAKRALTVPPGALADWNPRDATPCAWTGVTCDDAGAVTAVSLPNLNLTGSFPAAALCRLPRLRSVDLNTNYIGPDLDPAPAALARCASLQRLDLSMNALVGPLPDALADLPDLLYLNLDSNNFSGPIPDSFARFRKLQSLSLVYNLLGGGVPPFLGAVATLLELNLSYNPFAPGPVPATLGGLSDLRVLWLAGCNLIGPIPPSLGRLANLTNLDLSTNGLTGPIPPEITGLASALQIELYNNSLTGPIPRGFGNLKELRAIDLAMNRLDGAIPEDLFHAPRLETVHLYSNKLTGPVPDSVARAPSLVELRLFANSLNGALPADLGKNAPLVCLDVSDNSISGEIPRGVCDRGELEELLMLDNHLSGHIPEGLARCRRLRRVRLSSNRIAGDVPDAVWGLPHMSLLELNDNQLTGEISPAIAGAANLTKLVLSNNRLTGSIPSEIGSVSNLYELSADGNMLSGPLPGSLGGLAELGRLVLRNNSLSGQLLQGIQIQSWKKLSELSLADNGFTGSIPPELGDLPVLNYLDLSGNELSGEVPMQLENLKLNQFNVSNNQLRGPLPPQYATETYRSSFLGNPGLCGEIAGLCADSEGGRLSRRYRGSGFAWMMRSIFMFAAAILVAGVAWFYWRYRSFSKSKLRVDRSKWTLTSFHKLSFSEYEILDCLDEDNVIGSGASGKVYKAVLSNGEVVAVKKLWSTAVKKEEGSASASAADNSFEAEVRTLGKIRHKNIVKLWCCCSCRDCKLLVYEYMANGSLGDVLHSSKAGLLDWATRYKVALDAAEGLSYLHHDSVPAIVHRDVKSNNILLDAEFSARVADFGVAKVVEGGTAAMSVIAGSCGYIAPEYAYTLRVTEKSDTYSFGVVLLELVTGKPPVDVELFGEKDLVKWVCSTMEHEGVEHVLDSRLDMGFKEEMVRVLHIGLLCASSLPINRPAMRRVVKMLQEVRAPPARVVVDRDGKLSPYYYYEDASSEQGSS

SEQ ID NO: 16331 - protein, 1089 aa, Campylobacter jejuni RM1221
MPKRTDIKSILLIGSGPIVIGQACEFDYSGTQAAKTLKELGYRVVLINSNPATIMTDPEFADATYIEPITKESILSIIKKEKIDAILPTMGGQVALNVAMEVYESGLLGDVKFLGANPGAIKKGEDRQVFKECMKKIGMDLPKSMYAYNYDEALKAVDEIGFPLMIRASYTLGGAGSGVVYNMDEFKELANTALALSPIHEILIEESLLGWKEYEMEVIRDRADNCIIVCSIENIDPMGVHTGDSITIAPALTLTDKEYQVMRNASFAILREIGVDTGGSNVQFAINPKNGRMIVIEMNPRVSRSSALASKATGYPIAKVATLLAVGFSLDEIKNDITGTPASFEPVIDYIVTKIPRFTFEKFPGANTTLGTAMKSVGEVMAIGRTFKESIQKVLCSLERSLSGFDRVKFEDRNDLVFKIRNANEKRLLYVAQAFREGFSVEELYELCKIDPWFLTQIKEIVDFEEQIDMDILNNKALLRKAKTMGFSDKMIALLVNLKDNLELSQNDIYYARMKQKIIAEFSEVDTCAGEFEALTPYLYSSINVSELTQSKNDTKDKKEKKVMIIGGGPNRIGQGIEFDYACVHASFALKDMGIKTIMYNCNPETVSTDYDTSDILYFEPIDFEHLRAVIEREKPDGVIVHFGGQTPLKFAKRLSAFGAKIIGTSSRVIDMAEDRKKFAEFITKLGINQPKNSTATSVEEAVLKASDIGYPVLVRPSYVLGGRAMRVVNDEAELRFYIQEAVDVSDKSPVLIDQFLDNATEIDVDAICDGKDVYVAGIMEHIEEAGIHSGDSACSLPPCNIDEKMQEFIAQKTADIALNLGVVGLLNIQFALHNNELYMIEVNPRASRTVPFVSKAMGIPLAKVATRVMWQGNLKEALKFYDTFKVVNFDTKILRPKTPKYMSVKEAVFPFAKLSGSDLELGPEMRSTGEVMGISKDFANSYAKSQIASFNHLPEQGVVFISLKDKDKKYTKKIAAEYVKLGFKLMATGGTCKEILESGFECELVHKISEGRPNVEDKLKNGEIHLVINTSDSHSFKGDTKKIRENIIRFKIPYFTNLRSALAGAKSIKAIQSKSCLDVKSLQEWLKS

SEQ ID NO: 16332 - protein, 320 aa, Aspergillus oryzae
MCIALISTAHPSYSLIVIDNRDEYLRRPTAPADWWPGLNSNILGGRDLARATQGTWMGITKEGKIAVLTNYREDTSEKATGTQSRGAIVNGWLTVAPEPRESTRDFAQRMVASATARNVGGFSLVCGYVNEPLAVISNRSSNIDQVTWLATEKGQTVGLSNTHFDDRSWPKIIDGEKLMIEAIQAHVGAGENEDGLIDRLLGLLSKNTLPNLSEGATAEDYLPHFRKSIFIPKLGVKEVHARSADGVAVPCAEEKATGAKQGDELDQSYLHGAYGTQKQTVILVSKDGRVRYFERTLYDNEVNAIPLGNGDRSYEFQVNQ

SEQ ID NO: 16333 - protein, 414 aa, Coccidioides immitis RS
MKNILRLSRAGARSLSGSPSHSPFLRYAVNAAWQRGYSAWQSPSRSDGLPGIDASKLSVTKTTSPKNLLPPKELVFGSTFTDHMLRVNWNTKDGWLAPEIVPYQNLSLDPATCVFHYAFECFEGMKAYKGKDGSIRLFRPDKNMARLNKSSKRIALPTFDGETMIKLIGELVKLDSRFIPQERGYSLYLRPTMIGTQSTLGVSPPGSAMLFVIASPVGPYYPTGFKAVSLEATDYAVRAWPGGVGDKKLGANYAPCIVPQLEASTRGFQQNLWLFGEEQYLTEVGTMNLFIAMKNKETGQNELITPPLDGTILEGVTRDSVLTLARERLTPKGWKVSERKLTMPELAEAADEGRLIEVFGAGTAAIVSPVRNISWKGRLVDCGLKKDEEAGKIALEMKNWIEGIQYGEEKHPWR

SEQ ID NO: 16334 - protein, 213 aa, Oryza sativa (indica cultivar-group)
MSRLGRYGPPAVRDSYSLLVLNVSFRTTADDLLALFDRCGEVLDIRIPRDRRTGDSRGFAFVRYKYEDEAQKAVDKLDGRTVDGRDIMVQFAKYGPNAERIHKGRIVEEISKPRGRSRSPSPKRRYRADYRDRGYRDDYRDRHYRDDYQDREYRRSRSIERYERERYQEKGYRRRSRSISPDYDRRHRKNGYACGDALPVSFLSYLTASMFKL

SEQ ID NO: 16335 - protein, 162 aa, Trema tomentosa
MSSSEVDKVFTEEQEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFEVTRFALLETIKEAVPEMWSPEMKNAWGEAYDQLVAAIKSEMKPSST

SEQ ID NO: 16336 - protein, 469 aa, Vibrio fischeri ES114
MSVENVLALIQENEVKFIDLRFTDTKGKEQHISIPSHQIDADFFEEGKMFDGSSVAGWKGINESDMVMMPDPASAVLDPFTEDSTLNIRCDILEPATLQGYDRDPRSIAKRSEEYMRSTGIADTVLIGPEPEFFLFDDVRFNTDMSGSFFKIDDIEAAWNSGTEYEGGNKGHRPGVKGGYFPVAPVDSSQDIRSAMCLIMEEMGLVVEAHHHEVATAGQNEIATRFNTLTTKADETQIYKYVVHNVAHAFGKTATFMPKPLVGDNGSGMHVHQSLAKDGVNLFAGDKYGGLSELAIYYIGGIIKHARAINAFANPSTNSYKRLVPGFEAPVMLAYSARNRSASIRIPVVPSPKARRIEVRFGDPAANPYLCYSAMLMAGLDGIKNKIHPGEAMDKDLYDLPAEEAAEIPTVAESLDIALKALDEDREFLTAGGVFSDDFIDSYIGLKSQDVEAINTAVHPLEFEMYYSV

SEQ ID NO: 16337 - protein, 377 aa, Arabidopsis thaliana
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDMKEKLSYIALDFEQELETSKTSSSVEKSFELPDGQVITIGAERFRCPEVLFQPSMIGMENPGIHETTYNSIMKCDVDIRKDLYGNIVLSGGTTMFGGIGDRMSKEITALAPSSMKIKVVAPPERKYSVWTGGSILASLSTFQQMWIAKAEYDESGPSIVHRKCF

SEQ ID NO: 16338 - protein, 157 aa, Zea mays
MAAAAAAPASVAPSSAPKAAGDNRKTVVSVDASELEKHVLAVDDSSVDRAVIARILRGSRYKVTAVESATRALELLALGLLPDVSMIITDYWMPGMTGYELLKRVKESAALRGIPVVIMSSENVPTRITRCLEEGAEGFLLKPVRPADVSRLCSRIR

SEQ ID NO: 16339 - protein, 306 aa, Arabidopsis thaliana
MPLNVVNDRDGSSRILLTDPAGSTAEVLLYGGQVVSWKNERREKLLYMSTKAQLKPPKAIRGGLPISFPQFGNFGALERHGFARNRFWSLDNDPSPLPPANQQSTVDLVLKSTEDDLKIWPHSFELRVRISISPGKLTIIPRVRNTDTKAFSFMFSLRNYLYVSDISEVRVEGLETLDYLDNLVRRERFTEQADAITFDGEVDKVYLNTPTKIAIIDHERKRTIELRKEGMPNAAVWNPWDKKAKSIADMGDEDYTTMLCVDSGAIESPIVLKPHEEWKGRQELSIVSSSYCSGQLDPRKVLYGDY

SEQ ID NO: 16340 - protein, 498 aa, Oryza sativa (japonica cultivar-group)
MGSADLVLKAACEGCGLAVGPLRHEYNVRANATTDKSFSIGRFVTGLPPFSKKKSAENKWSLHKEGLQGRQIPENMREKYNRKPWILEDETGQYQYQGQMEGSQSSTATYYLLMMHGKEFHAYPAGSWYNFSKIAQYKQLTLEEAEEKMNKRKTSATGYERWMMKAATNGPAAFGSDVKKLEPTNGTEKENARPKKGKNNEEGNNSDKGEEDEEEEAARKNRLALNKKSMDDDEEGGKDLDFDLDDEIEKGDDWEHEETFTDDDEAVDIDPEERADLAPEIPAPPEIKQDDEENEEEGGLSKSGKELKKLLGKAAGLNESDADEDDEDDDQEDESSPVLAPKQKDQPKDEPVDNSPAKPTPSGHARGTPPASKSKQKRKSGGGDDSKASGGAASKKAKVESDTKPSVAKDETPSSSKPASKATAASKTSANVSPVTEDEIRTVLLAVAPVTTQDLVSRFKSRLRGPEDKNAFAEILKKISKIQKTNGHNYVVLRDDKK

SEQ ID NO: 16341 - protein, 317 aa, Arabidopsis thaliana
  misc_feature (83)..(83): Xaa can be any naturally occurring amino acid
  misc_feature (104)..(104): Xaa can be any naturally occurring amino acid
MAATSLTAPPSFSGLRRISPKLDAAAVSSHQSFFHRVNSSTRLVSSSSSSHRSPRGVVAMAGSGKFFVGGNWKCNGTKDSIAXSLISDLNSATLEADVDVVVSXPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 16342 - protein, 120 aa, Brassica napus
  misc_feature (11)..(11): Xaa can be any naturally occurring amino acid
  misc_feature (20)..(20): Xaa can be any naturally occurring amino acid
  misc_feature (25)..(25): Xaa can be any naturally occurring amino acid
  misc_feature (29)..(29): Xaa can be any naturally occurring amino acid
  misc_feature (32)..(32): Xaa can be any naturally occurring amino acid
  misc_feature (35)..(38): Xaa can be any naturally occurring amino acid
  misc_feature (41)..(43): Xaa can be any naturally occurring amino acid
  misc_feature (46)..(46): Xaa can be any naturally occurring amino acid
  misc_feature (49)..(49): Xaa can be any naturally occurring amino acid
  misc_feature (53)..(55): Xaa can be any naturally occurring amino acid
  misc_feature (59)..(59): Xaa can be any naturally occurring amino acid
  misc_feature (61)..(61): Xaa can be any naturally occurring amino acid
  misc_feature (71)..(71): Xaa can be any naturally occurring amino acid
  misc_feature (74)..(74): Xaa can be any naturally occurring amino acid
  misc_feature (76)..(76): Xaa can be any naturally occurring amino acid
  misc_feature (78)..(78): Xaa can be any naturally occurring amino acid
  misc_feature (85)..(85): Xaa can be any naturally occurring amino acid
  misc_feature (87)..(87): Xaa can be any naturally occurring amino acid
  misc_feature (89)..(89): Xaa can be any naturally occurring amino acid
  misc_feature (97)..(101): Xaa can be any naturally occurring amino acid
  misc_feature (107)..(107): Xaa can be any naturally occurring amino acid
MAYSMLSSAGXVTSPAQATXGAPFXGLKXSSXFPXXXXGQXXXTFXVSXGRRXXXVEVXPXGGKKKFENLXYLXDXTXVNGVKEXYXLXPKGDSCGXXXXXHGFFYXEPPQGGELTPKPP

SEQ ID NO: 16343 - protein, 568 aa, Corynebacterium glutamicum ATCC 13032
MSAYETKEWLQHYPEWTPHSLEYGDTTLLDVYDNNLAINADKPATYFFGRSQTYGELDKEVRKTAAGLRALGVRPGDHVAIILPNCPQHIAAFYAVLKLGAVVIEHNPLYTAHELLEPFKDHGARVAIVWDKASPTVEQLRGQTQLETIVSVNMINAMPPLQRLALRLPIPALRKSRESLSGAAPNTVPFETLTSAAMGGDGDDVVSEPTVTKESVALILYTSGTTGRPKGAQLTHGNLFSNLLQGKHWVPGLGDKPERMLAALPMFHAYGLTMVGTLSVFIGGEMVLLPTPRIDLIMNVMKKHTPTWLPGVPTLYEKIVDASEKEGIPIKGVRNAFSGASTLSQRTVERWEKHTGGRLVEGYGLTETSPIIVGNPMSDHRRQGYVGIPFPDTIVRIANPENLDETMPDGSEGEVLVKGPQVFKGYLNQEEATKNSFHGEWYRTGDVGVMEEDGFIRLVARIKEVIITGGFNVYPAEVEEVLAEHPDIEDSAVVGIPREDGSENVVAAITLVEGAALDPDGLKEFARKNLTRYKVPRTFYHFEEMPRDQMGKIRRREVQAELLKKLGK

SEQ ID NO: 16344 - protein, 316 aa, Neurospora crassa
MAEQLILKGTLEGHNGWVTSLATSLENPNMLLSGSRDKSLIIWNLTRDETSYGYPKRRLHGHSHIVSDCVISSDGAYALSASWDKTLRLWELSTGTTTRRFVGHTNDVLSVSFSADNRQIVSGSRDRTIKLWNTLGDCKFTITEKGHTEWVSCVRFSPNPQNPVIVSSGWDKLVKVWELSSCKLQTDHIGHTGYINAVTISPDGSLCASGGKDGTTMLWDLNESKHLYSLNANDEIHALVFSPNRYWLCAATSSSIIIFDLEKKSKVDELKPEFQNIGKKSREPECVSLAWSADGQTLFAGYTDNIIRAWGVMSRA

SEQ ID NO: 16345 - protein, 234 aa, Oceanobacter sp. RED65
GKLATTSLYLKQPINVSELPGFSLGSCSVQDEAAQLAAQIMKPKEGELILDACCAPGGKTGHLLEASQGLAKITALDSDAKRLQRVHENLERLGYTAKVLQGEAQAPENWWDGQAFDGILLDVPCSATGVIRRHPDIKLLRQREDIDNLAQLQQAILSKAWTLLKPGGRLLYATCSVTQAENQNNIEAFLQTHPDSELVQLHFNTGLDTKYGWQFFPDKNAQDGFFYALLRKEA

SEQ ID NO: 16346 - protein, 248 aa, Corynebacterium glutamicum ATCC 13032
MTNGKLILLRHGQSEWNASNQFTGWVDVNLTEQGEAEAKRGGELLVEAGVLPGVVYTSLLRRAIRTANIALNAADRHWIPVIRDWRLNERHYGALQGLDKAATKEKYGDDQFMEWRRSYDTPPPELADDAEYSQANDPRYADLDVVPRTECLKDVVVRFVPYFEEEILPRAKKGETVLIAAHGNSLRALVKHLDGISDADIAELNIPTGIPLVYEIAEDGSVVNPGGTYLDPEAAAAGAAAVANQGNK

SEQ ID NO: 16347 - protein, 1552 aa, Aspergillus nidulans FGSC A4
MNPSSALMPKATAIPGCILRTSRQCSKHNQTSGIRASSSTRQYHVAAIESPARRRRDSTFMKRSDFIQARNFHATKVLAAIPDPYKVLGVDKGASAGDIKKAYYGMAKKYHPDTNKDPGAKEKFAEAQSAYELLSDKKKRETYDRFGSAAFDQNGGFDPSAGAGGNPFAGGGGFHGFGGGFGGGFPGGFAADINIEDLFGAFAGGARRSGRGRRGPFQEILVGEDIEVQTNISFMEAAKGTSQDIVITPLKECGTCKGDGLKEGAKRTQCRQCNGTGTRVHLMQGGFQVAATCDACGGAGLIVPRGSHCGTCKGDGVVRERKTVRVDIPGGVEDGMRLRISGEGDAPPTGTAAAPGTRTQRGDLYVSIRVSPDERFSRSGSDILYTASIPLTTALLGGEVLVPTLDGQVKVKVATGTGTGDRITLSGMGMKKLGGRSRGFSPNGDLKVEFKVAMPKYLTSNQRTILEVLADEMGDKTARRIMDIPRDGLSTAPAADASSGNESKSEGFLKSAWHKLMNHKKPAGSENSSDSSSNKDSNSSGDNGSSPLHDGKMVQSPMISCPLKQTNEIDWIQPLKDYIRQSYGEDPERYSQECATLNRLRQDMRGAGKDSATGRDLLYRYYGQLELLDLRFPVDENHIKISFTWYDAFTHKPTSQYSLAFEKASIIFNISAVLSCHAANQNRADDIGLKTAYHNFQASAGMFTYINENFLHAPSTDLNRETVKTLINITLAQGQEVFLEKQIMDHKKAGFLAKLASQASYLYAQAIEGTQEHAKGIFDKSWVTLLQVKSAHMGSVASYYQALADGESGSHGVAVARLQLAEKHSTSALSWAKSLPSSISPNTNLTSEAGPSLVDIVKFHLANVQSQLATFVKDNDFIYHQPVPSEAGLSAVSKLPAAKAIPVSELYQGQDIQRIIGPDIFQKLVPMSVTETASLYDEEKAKLIRAETEKVETADGEMAASLDYFKLPGSLNILKGGMDQEVMVDEEFQRWCQELAGHDSFAKAFDTLQDRKSEVLATLDQCAKQLDLEESVCEKMRSKYGADWSQQPSSRLNMTLRNDIRTYRDTVHEASASDAQLSATLRQYESDFDEMRSAGETDEADVLFQRAMIKAGSKQGKTKNGVTSPYSATEGSLLDDVYDDGVPSVAEQIARVESILKKLNLVKRERTQVLKDLKEKVRNDDISNVLILNKKSITGQESQLFEAELEKFHPHQMRIVQANHKQTALMKELTKTYGDLLQDKRVRAEQSKYESITRQRNSVMARYKKIYDSFNNLGSGIKQAQTFYAEMTETVDSLKKNVDTFINNRRSEGAQLLGQIEREKAAGTSDHEEREREKLRQLMERLSTEPKPPSVPPGSSTAGPAKAKSPPPPVKAPAYPTNIAPPKASPHFAPTVPQQHGTPVSHSPAPYSQYVPPGAGVSYLPSQSFQQGAAAPLSEGYNPMAYPIPASSMSPPPSQPFYSPTPTPFYTSPTPPVPSGQYMPQGYVPPPPPPRPQQPTYPPSTGPFPSGPGGYAQSRPYGSSQHHKAHSQSSPQTGPSVSANSSDPWAGLNAWK

SEQ ID NO: 16348 - protein, 510 aa, Desulfitobacterium hafniense DCB-2
MAQELVLVLDFGGQYNQLIARRVREAHVYSEMISYKTPVEEIKARNPKGIIFSGGPASVNQEGAPKVDEAIYELGIPIFGICYGMQLMTVQLGGKVMHPEVREYGKAMLHVDQAKGLWKGLGGERQCWMSHGDSVTELPEGFVIAAHTDHTPVAAMMDETRHFYGVQFHPEVKHTPDGQAMLKHFLFDICGCHGEWTMESFIDAQVKAIREKVGDRQVLCALSGGVDSSVAAVLVHKAIGDQLTCVFVDHGFMRKNEPEQVKKIFTEQFHLKLIFVDARERFMAKIGGVSDPETKRIGIGNEFIRLFEDEARKLGQIDFLVQGTLYPDIVESGTDTAETIKSHHNVGGLPEDMQFELIEPLDMLFKDEVREVGAELGIPDEIVWRQPFPGPGLAIRIIGEVTEEKLDILREADAVIVEEIRNAGLYKEVWQSFAVLPTIKSVGVMGDGRTYAYPIVVRAVTSEDAMTADWARLPYDLMEKISTRIVNEVKGVNRVVYDITSKPPGTIEWE

SEQ ID NO: 16349 - protein, 189 aa, Methanosarcina acetivorans C2A
MRELKILVVNNYGQFCHLIHRAVRDLDMDTKIIPNVTPIEDILAEEPDGLILSGGPEMERAGLCFDYVREIDIPILGICLGHQAIALAYGGHVHSGKKGGYAEIEIEVIEEDDILRGLGPKITVWASHADEVAILPEGFIHLARSDICEIEAMRHPTKPIYGVQWHPEVSHTKKGDELLTNFFEVCDRY

SEQ ID NO: 16350 - protein, 255 aa, Xanthomonas campestris pv. campestris str. ATCC 33913
MCLVALAWKTHPRWRLLLAGNRDEFHERPTAPLAQWAAPAERVLAGRDLRSGGSWVGLGLDGRAAVVTNVRDPLATASGRSRGHLIADYLSGSADAATYARELAAAGQEFPPFNLLLCDAERCEHLSNHPALARALAPGIHGMSNGPLDAHWPKTTALTHALAAWCDSGSDDLQPLWTALANPATAADADLPHTGVDRATERLLSAAFIRGASYGTRASTIVAVDHHGHGFIHERRFGPDGVFQGETRLDVAGMH

SEQ ID NO: 16351 - protein, 242 aa, Methanosarcina acetivorans C2A
MTQIGPFDLEKKAAVVAVILEKPLETSKKAAEKGADILEVRLDLLGIRNPESAAKIIREIKSETGLPVLVTNRSVAEGGKWEGKEVDRTELLVALLSLKDGPDAVDIELSASREDRDKVIKAAKAHGKTVIISSHDFSKTPSPQEMTATLAEMFLAEADIAKIAVMPGSMEDVLNLLKVTLEFKNTGKTVCTIAMGKPGKHTRVVAPLYGSVLTYASIESNAVAAPGQLPVDEVKKIMEMLK

SEQ ID NO: 16352 - protein, 666 aa, Phaseolus vulgaris
MAAISCILSLLLSSLIAQVSAQFNTEYCDNNKGNYTINSTYHNNLNTLLSTLSSHTQINYGFYNFSHGQNNDKVNAIGLCRGDVKPDECRRCLNDSALTITQLCPNQKEALLWLNTSKCLLRYSHRTIFGVMESSPGFYLTNVNNVTEADKFNQALSNLMRNPTVVAASGDSRLKYAADSAIAANFQTVYGLVQCTPDLSETDCNRCLDGAISEIPSCCGNKMGGRVLRPSCNIRFESAIFYDSNAKLDPDVTPPSPPPSSFTNTSPKESNNTITIVIAVVVSIVVVAVVSLLGLCIYLRRKKARKSPTVNQDDDDDDIEISQSLQFDFDTIRVATEDFSNSNKLGQGGFGAVYRGRLPNGQMIAVKRLSSGSSQGDTEFKNEVLLMAKLQHRNLVRLLGFCLEGRERLLIYEFVPNKSLDYFIFDPVKKAQLDWEMRYKIIRGIARGLLYLHEDSLLRIIHRDLKASNILLDEEMNPKIADFGMARLVLLDETHANTNRVVGTYGYMAPEYIMQGQFSVKSDIFSFGVLLLEIVSGQKNSGFRHGENVEDLLSFTWRNWRDGTAVNIVDPSLENNSRNEVMRCIHIGLLCVQENLTDRPTMATIMLMLSSYSLGLPIPSEPAFYANSTARSLPATSSWGHSSRATANQSAQESENENSITEPYPR

SEQ ID NO: 16353 - protein, 280 aa, Methanosarcina acetivorans C2A
MKRVFGVFGDPVGHSLSPAMHNSAFSALGMDCIYHAFRVRPENLRKAILGAEAMGFGGLNLTVPLKEEALKLDFIRPDPLAERIGAVNTVVFSETGEIRGYNTDGLGARQALLEAAVEIRGSKVVVAGAGGAARAVAFQLAADGAEITVVNRTEERAVELAKDVAAASLPGKINGTGLSGLKELLRDADILINTTTLGMHPNTDTTIATAEELHSGLTVFDIVYNPLETRLLKEAKVAGAKTVSGVLMLVYQGAEAFKLWTGVEAPAELMKKTVLEALQA

SEQ ID NO: 16354 - protein, 183 aa, Candida glabrata CBS 138
MLSRISMQKRFLSSTVAKLGKKVYFEPSVNGSRIGRIEFELYDDVVPKTAENFRALCTGEKGWGYKGVPFHRIIPQFMIQGGDTDLTNGFGGKSIYGNKFADENFTKTHDKPGLLSMANAGPNTNGSQFFITTVPCPWLDGKHVVFGEVTKGMDIVKTIESYGTMSGQPRAKIVVEESGEIKE

SEQ ID NO: 16355 - protein, 559 aa, Exiguobacterium sibiricum 255-15
MEKTIRSDLEIAQQTILRPISEIAEHIGLNDADYDTYGKYKAKLTDGLVKRLATKADGKLILVTAINPTAAGEGKSTVTVGLGQALHRLNHKTMICLREPSLGPTMGLKGGACGGGYSQVLPMEEINLHFTGDMHAITSAHNTISALLDNHLHQGNDLRIDPRRITWKRVLDLNDRALRQITIGLGGPAHGVPRQDGFDITVASEIMAVLCLADSITDLEKRISRIVVAYSYDQQPVTVKDIKASGAATLLLKEAFRPNLVQTVEGTPALIHGGPFANIAHGCNSLIATRTALKLSDYVVTEAGFGADLGAEKFFNIKSRIGHLHPDAVVVVATVRALKMHGGVAKDQLAEENLAALVEGLALLEKHVETMDLFGVPAVVALNRFATDTDTERETVLEWCRERNIRVAESEVFSQGGAGGEALAEQVFEALEEESQFTPLYPAELPLTQKIERIAKRVYGAADVHFEEKALRELERCTEQGLGHLPICMAKTPFSLTDDPSKYGRVEGFTITVREIKPSIGAGFIVALTGNVLTMPGLPKIPAANKMGISEDGTIYGLS

SEQ ID NO: 16356 - protein, 1010 aa, Exiguobacterium sibiricum 255-15
MQEVKKVLVIGSGPIVIGQAAEFDYSGTQACQTLREAGCEVMLMNSNPATIMTDPSTADHIYIEAMTLEKATAIIKRERPTHLLATVGGQTALNLALSLEEAGVLDQYQVKLLGTSLETIRDGEDRERFKQRMLELDQPLPISQTIETLEELEGFMEKAGVPLVVRPAFTLGGTGGGIAQTKEEARKLAANGLQASPISQCLVEASIAGYKEVEYEVMRDAFDTTIIVCNMENIDPVGVHTGDSVVFAPIQSISDKMNQILRTASREIVSALGVVGGCNIQFAIHPTEQTYYVIEVNPRVSRSSALASKATGYPIAKLATRLALGERLDDCINPVTKETMASFEPVLDYVTAKVPCFPFDLFPGSDRSLGTQMKATGESMAMGKTLEEALQKAWRGAGIEQAPLYPNWMKQADTEVLWQEVNQITDRRLLAMLALLDRKAATHEELAEKTQIQSLFLTTLETLILMQESLDLESKESLQQAKGFGFTDQQIAQITDVPLEVVQQQRNTFLIQPSFQMIDTCGAEFSSLTPYFYGSWSGRTEVTPSSRKKVAVLGAGPIRIGQGIEFDYCSVHAVRALQKAGYETIMINNNPETVSTDFEVADRLYVEPLTIEDVVHVLEAEQCRQVLVQFGGQTAITLAAELEELGYQLLGTTADTIDEMEDRDRFYQFLDRLQIDRILGQEVSNEEELTAIVKELGYPLMIRPSYVIGGKGMHRLTTATDLEKLLPEMVFPILVDAYIEGHEFEVDCISDKTTTYVPVIMEQIEAAGVHSGDSTMILPPVSALASLQDEIEQIAQTIGQHLDYQGAFNIQFVVKDQTVYVLEINPRASRTLPIVSKVTGQPLLEWAVQAAIGMKVEALPANRLTLPFHAVKTPVFSTLKLRGVDPMTGPVMRSTGETLQWTEAGLAKERFVFDQTTKTAMAKRTLRICGAGTDAWSEGAAVQPDTEFDTCLVFFSKSESEREQREKALAQGAIVITEEHLAQYFESVQTIPMCTVKPLSEWTTQKERIQ

SEQ ID NO: 16357 - protein, 380 aa, Exiguobacterium sibiricum 255-15
MSALLPTYLRHDIELVAGNGSFVQDKAGKNYLDFVMGIAVCNTGHRHPHVEQALQEQLQKLWHTSNLFMSSKQERVAAMLTENSHLSHVFFCNSGTEANEGAFKLIRKWTQKKEILTFSQSFHGRTFAMMGATGQDKIKAGFGEMVPDFKHLTFNDFDSLEMITNQTAAVWLEVIQGEGGVIVAENAWLEALMEKARQYDVKVVIDEVQTGIGRTGSRFAFEQTPLKPDIITVAKGLGSGFPVGAIITTPEATAVFTPGTHGSTFGGNPLAMAAAEATLDVLLNEQQMKQVQQKGLYLMQQLKQLPETMVVDVRGRGLMIGIEFHEPVSSLITALQQAGMLVVSAGPNVIRLLPSLCVTEQELDLAVGKIKTVCQQEVMM

SEQ ID NO: 16358 - protein, 174 aa, Triticum aestivum
MAPAVMASSATTVAPFQGLKSTAGLPVSRRSRGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 16359 - protein, 1010 aa, Geobacter sulfurreducens PCA
  misc_feature (191)..(191): Xaa can be any naturally occurring amino acid
MGISRRQFLQGGALAGAALALSGTPGEASADSPDLRTKGTKVTTTVCPFCSVGCGLIVHTKDGKVINAEGDPQHPINQGSLCPKGGALFQIANNDKRLQKVMYRAPGSDKWEEKSWDWALDRIALRMKETRDKSFKKTELNKKDNKEYVVNRTDGMAFFGGAGLDNEECYLWTKFARAMGVGQLEHQARLXHSSTVAGLAASFGRGAMTNHWIDLKNSDVIFAIGCNPAENHPISFKWIEAALDNGAKLISVDPRFTRTSSKADIYAQIRPGTDIAFLGGMINYAIQNRMIHEEYVREYTNATFIVSEQFDFQDGMFCAFDDQEKVYDLKSWAYSTGADGKPKRDMSMKDPKCVYQLMKNHYKRYDIDTVCAITGTPKEDYLKVVKAFCATGRPDKSGTILYAMGITQSTHGSQNVRAVALLQMLLGNIGIAGGGVNALRGESNVQGSTDYGLLFHILPGYLKSPEFDNVDLKAYVEKWTPKTKDPKSANWWGNTPKYTVSLLKAWYGDNATAENDFCYDYLPKRMGNYSYVKIMEKMAKGELEGLVCMGMNPAVGGPDSVAAREALGKLKWLVTADLWETETSIFWKRPGVDPKSIQTEVFMLPAASSIEKEGSISNSGRWAQWRYAAVHPLGDSRSDLHIIDEFYKRIKALYLKDGGAFPEPLTKLAWNYGTGHEPDVHLVAKEINGYFTKDVTIKEKDKVLEFKKGDQVPMFKYLQDDGSTVSGCWIYCGSYTNEGNQMARRDPSDPTGLGLFPKWTWCWPVNRRIIYNRASVNPAGEPFNPKRPVIAWDALEKKWKGDVPDGPWPPMKDDKEGKYPFIMLPEGHGRLYALDMKDGPFPEHYEPVESPAKNLLSKVQTNPVVKVPSNVSSDTSKFPLIGTTYRVTEHWQAGAMTRSLPWLVELVPDMFVEISETLAKQKGISQGDMVKVSTERGSIQAKALVTSRLKPFNVQGKLIEQVGMPWHFGYAGLATGDSGNVLTPTVGCANTGIPEFKAFLCNIEKGGKAA

SEQ ID NO: 16360 - protein, 534 aa, Burkholderia sp. 383
MRLANASCERPSHTSFATAPDHGFTTIGNHIMYDTEPLAATRGPAGGQPEPRRVRNFIDGDYRAGDRWFDKRSPLDNAVIARVAEASRADVDAAVQAARAALSGPWGGLTVAQRVDILYAVADGITRRFDDFLEAEVADTGKPVSLASHIDIPRGAANFKVFADVVKNVPGETFEMATPDGAGALNYAIRRPVGVVGVICPWNLPLLLMTWKVGPALACGNTVVVKPSEETPQTAALLGEVMNAAGVPRGVYNVVHGFGPGSAGEFLTTHPGVNAITFTGETRTGAAIMKAAADGARPVSLEMGGKNAAIVFADCDFDAAVEGTLRSCFANAGQVCLGTERVYVERPLFERFVAALKAGAEQLRPGRPEADTTGIGPLISQEHRDKVLSYYRKAAELGATVVTGGGVPDMPADLRDGAWVQPTIWTGLGDDSPIARDEIFGPCTLVMPFDSEAEVIGRANANAYGLSTAIWTTHLARAHRVAASIDVGIAWVNSWFLRDLRTAFGGAKQSGIGREGGVHSLEFYTELRNVCIKL

SEQ ID NO: 16361 - protein, 340 aa, Oryza sativa
MATTQLLSTVEHRETLPEGYARPESDRPRLAEVATDSNIPLIDLASPDKPRVIAEIAQACRTYGFFQVTNHGIAEELLEKVMAVALEFFRLPPEEKEKLYSDEPSKKIRLSTSFNVRKETVHNWRDYLRLHCHPLEEFVPEWPSNPAQFKEIMSTYCREVRQLGLRLLGAISVSLGLEEDYIEKVLGEQEQHMAVNYYPRCPEPDLTYGLPKHTDPNALTILLPDPHVAGLQVLRDGDQWIVVNPRPNALVVNLGDQIQALSNDAYKSVWHRAVVNAVQERMSVASFMCPCNSAVISPARKLVADGDAPVYRSFTYDEYYKKFWSRNLDQEHCLELFKGQ

SEQ ID NO: 16362 - protein, 294 aa, Medicago sativa
MEQYEKVEKIGEGTYGVVYKARDRATNETIALKKIRLEQEDEGVPSTAIREISLLKEMQHRNIVRLQDVVHSEKRLYLVFEYLDLDLKKFMDSSPEFAKDQRQIKMFLYQILCGIAYCHSHRVLHRDLKPQNLLIDRSSNAVKLADFGLARAFGIPVRTFTHEVVTLWYRAPEILLGSRHYSTPVDVWSVGCIFAEMINQRPLFPGDSEIDELFKIFRITGTPNEETWPGVTSLPDFKSAFPKWPAKDLATQVPNLEPAGLDLLSSTCRLDPTRRITARGALEHEYFKDIKFVP

SEQ ID NO: 16363 - protein, 323 aa, Triticum aestivum
YNKFVQKSRLVPVRNSRDIVDPRVRLMAFQESKDYYAKVGKAWKRGYLLYGPPGTGKSTMIAAMANFLDYDVYDLELTAVKNNTELRKLFIETTGKSIIVIEDIDCSIDLTGKRRKDKKASGDKDSDSDDKPKLPMDPEKDDATKVTLSGLLNFIDGLWSACGGERIIIFTTNHKEKLDPALIRRGRMDKHIEMSYCRFEGFKVLAKNYLDVIEHDLFGEIQRLLEETDMSPADVAENLMPMSKKKKRDPDLCFSGLVEALKQAKEGAAAAAAKAKAEEEAKEAEAKKVKEKEETEVKKAKEENKGKDKAPEKANGDIKEGDK

SEQ ID NO: 16364 - protein, 67 aa, Oryza sativa
SPNFYFYDPVKPIFTSPRFLPPTKVENCKVLNSIVSHGCFLTECSVDRSVIGVRSRLEPGVQLKVNC

SEQ ID NO: 16365 - protein, 122 aa, Zea mays
MPSQSTHTSSSLSSSTTPILPCSSAAALFRSVMAAVATETPFHVLAVDDSLPDRKLIERLLKTSSFQVTTVDSGSKALQFLGLHDQDSTVPPVHTHQLDVAANQDVAVNLIITDYCMPGMTG

SEQ ID NO: 16366 - protein, 682 aa, Kluyveromyces lactis
MSSVAASQNKINDLLEAIRQEFANVSQEANSYRLQNQKDYDFKINQQLAEMQQVRNTVYELELTHRKMKDAYEEEISRLKLELEQKDRQLASIAHGSTVGNVPGQVPQLSRNSGAQGNANIAPPNIPQPMVSQTVGTGMAPQMAPLNTQHPTQQTKSNAGEQAAANLAPVIQQQQQPQQQLPPQQQQQQQQQQQSNIPVTTAAPVQPAGGNLDQTVPNSISPQQQPTEQQQPASTATTAPATASTAPPTSAPSDQVGQDHYLVPADQRAVHAKPIPPFLLDLDSQLVPSHLKKQNNDYYVLHNPALPTDLDVELHKSLEHSSVVCCVRFSSDGEFLATGCNKTTQVYKVSTGELVARLSDDSASQPQPQPQNQTVTAETSTSNSNGSSAEDGTGNQNSAASTASSDLYIRSVCFSPDGKFLATGAEDKLIRIWDLETKKIVMTLKGHEQDIYSLDYFPSGNKLVSGSGDRTVRIWDLTTGTCSLTLSIEDGVTTVAVSPGEGKFIAAGSLDRTVRVWDSDTGFLVERLDSENELGTGHRDSVYSVVFTRDGKGVVSGSLDRSVKLWNLNGLSGQKSHAECEVTYTGHKDFVLSVATTQNDEYILSGSKDRGVLFWDTKSGNPLLMLQGHRNSVIYVTVANGHPLGPEYGVFATGSGDCKARIWKYSKKNGQQNSTQIKEIKE

SEQ ID NO: 16367 - protein, 306 aa, Oryza sativa (indica cultivar-group)
MATTRGPLPVEDVLRVNGSRRFAAALAAASPFASLADALLAARRIWLNEYLNLQTSTNLTYCATNELADWNARYREKFGFVFMICASGRTTPEVLAELKRRYENRPIVELEVAAHEELKITELRLAKLFASEPVAPPSSTVGGPTSQSDKAADRMRIIGAHLGSHTQHSANKAPEITGSSNRTRPPITTHVLDVARGSPASGIEVHLEMWKDASTPPSFNNKDFNGWVTLGSSVTNNDGRSGQLMDIVNNVAPGFYRISFNTSKYAPSGFFPYVSIIFEIKKNQTTEHFHVPLLHSPFSFTTYRGS

SEQ ID NO: 16368 - protein, 473 aa, Oryza sativa (indica cultivar-group)
MTSLPGRGVSPSSSDPLCEGNAAPSSSSSGQDLKQSKNSILSCVFSSPFSIFEAHQDSSAHRPLKPHSGSYAWSRFLRRIACTGSMWRFLGASKALTSSDVWFLGKCYKLSSEELSNSSDCESGNAAFLEDFSSRIWITYRKGFDAISDSKYTSDVNWGCMVRSSQMLVAQALIFHHLGRSWRKPSQKPYSPEYIGILHMFGDSEACAFSIHNLLQAGKSYGLAAGSWVGPYAMCRAWQTLVRTNREHHEAVDGNGNFPMALYVVSGDEDGERGGAPVVCIDVAAQLCCDFNKGQSTWSPILLLVPLVLGLDKLNPRYIPLLKETFTFPQSLGILGGKPGTSTYVAGVQDDRVLYLDPHEVQLAVDIAADNLEADTSSYHCSTVRDLALDLIDPSLAIGFYCRDKDDFDDFCSRASELVDKANGAPLFTVMQSVQPSKQMYNEESSSGDGMDIINVEGLDGSGETGEEEWQIL

SEQ ID NO: 16369 - protein, 450 aa, Aspergillus nidulans FGSC A4
MAKQIAGSKVLLLGSGFVTKPTVEVLSKADVEVTVACRTLESAKKLCEGFKNTKAISLDVNDDKALDEAMSKVDLAISLIPYTFHAQVIKSAIRTKKHVVTTSYVSPAMMELDQQCKDAGITVMNEIGLDPGIDHLYAVKTISEVHAEGGKITSFLSYCGGLPAPECSNNPLGYKFSWSSRGVLLALRNAAKFYQDGQEKSIAGPELMAAAKPYYIYPGFAFVAYPNRDSTPFRERYNIPEAQTLVRGTLRYQGFPEFIKVLVDMGFLSDEPQTYLSTPIAWKEATQKILGATSSDEKDLEWAISSKTTFPNNDERDRIISGLRWIGIFSDEKITPRGNPLDTLCATLEQKMQYGPEERDLVMLQHKFGIEHKDGSKEVRTSTLCEYGVPGGYSAMAKLVGIPCGVAVKLVLDGTINQTGVLAPMTWDICEPIQKTLKEEYGIEMIEKTL

SEQ ID NO: 16370 - protein, 396 aa, Bacillus subtilis
MAVKVVMPKLGMAMKQGEVSIWNKKVGDPVEKGESIASIQSEKIEMEIEAPEKGTLIDIKVKEGEEVPPGTAICYIGDANESVQEEAGAPVAEDNMPQAVQPVKQENKPAASKKDRMKISPVARKIAEKAGLDLKQLKGTGPGGRIVKDDVTKALAEQKKDQAKPVSEQKAQEIPVTGMRKVIAARMQESLANSAQLTITMKADITKLATLQKQLSPTAEERYGTKTDDHSFLSQEPPVLALQAHPVLNSFYQNERIITHPHVHLGMAVALENGLVVPVIRHAEKLSLIELAQSISENAKKAREGRAGSEELQGSTFSITNLGAFGVEHFTPILNPPETGILGIGASYDTPVYQGEEIVRSTILPLSLTFDHRACDGAPAAAFLKAMKTYLEKPQH

SEQ ID NO: 16371 - protein, 359 aa, Aspergillus nidulans FGSC A4
MVLHNPNNWHWVNKDVSAWAKTYLKEKLRAVSAEEDGVTAKVSDVLTMDGDVDVSQRKGKVITLFDVKLQLEYEGKTKDEEAVSGTITIPEVAHDTEEDEYVFDIDIYSDSPSKQPVKDLVRSKIVPQIRKELVQLAPALVAEHGKDIQHAPGENPSKGFTPAVSYPQTKKQEAPASKPATTTTTNKVSVNTTTVTASDEFRTTAEELFKTFTEPERLAAFTRGQPRQWDGAKVGGKYSIFDGNVTGEFVKLESPTLLVQKWRLAQWPEGHFSTLEINFDQNDVDGVTQMRVSWAGVPVGQEDVTKQNWELYYVRSIKQTFGSRSFVFTWRQLLITILTLFLGHMINLTIFSYSCHDNV

SEQ ID NO: 16372 - protein, 1068 aa, Aspergillus terreus
MDPVVRKPDPGGVQHRVTKALRAIVGHACRHPIHTLLVTALTAATTHLHVLEGTYQATHREASAWKWQIDDRPKVPEDGQSDFHWALVTLDLPGASVDASIPFLSNTLSGFLGAEQTTPTPDSSPSPDHSALTFRVPYSQLDGFLQAVEIIPSEKEDDSWRLRSPREEGSPRSLGHWLGSSWLSFLHRVHHAETVDLVIIGLSYLAMNMTVVSLFRVMRHLGSRFWLAASVLLSGAFAFVLGLGITTTCDVPVDMLLLFEGIPYLVLTVGFEKPIQLTRAVLCVSEELWGGGQRQVPNGASSDDSRQNQLIPNIIQLAVDREGWYIVRSYLLEIGALALGAVLRPKDSLGHFCFLAAWTLLIDAVLLFTFYATILCVKLEITRIRSPGGLGQVNAKHPSGIFGHKVKSTNITWWKLLTVGGFVLCHFLQLSPFFYRVMGEYMANGTLPPTAVSPFKEAANGLNEIYLTARVEGFETRVTVLPPLQYVLESAGFNISATKRSTFDGVLDGLESPLGRLCLMGALVVSLVLNNHLIHAARWHAWPQARESAVPDGSYLSVPCSATAPEVCTRPPEETEALLKSNQAESLTDDELVELCLRGKIAGYSLEKTLERIAAGSSRSVTRLEAFTRAVRIRRAAVSKTPSTQNLCSGLAESLLPYRDYNYELVHGACCENVVGYLPLPLGVAGPMVIDGQALFIPMATTEGVLVASASRGCKAINAGGGATTMLKGDGMTRGPCLRFPSAQRAAEAQRWVESPLGHEVLAAAFNATSRFARLQTLTVAQAGIYLYIRFRTTTGDAMGMNMISKGVEKALEAMAAEGGFPDMHTVTLSGNFCSDKKSAAINWIGGRGKSVIAEATIPAETVRQVLKTDVDALVELNTAKNLVGSAMAGSLGGFNAHASNLVQAVFLATGQDPAQNVESSSCITTMKNIDGNLHIAVSMPSMEVGTIGGGTILEAQGAMLDLLGVRGAHSTEPGANARRLARIVAAAVLAGELSTCAALAAGHLVNAHMQHNRTSKDAISGTEYGAIRTPVYVVILEHAGDIHFVQIEYKNTYLRRKVPTLSCNLGR

SEQ ID NO: 16373 - protein, 355 aa, Aspergillus nidulans FGSC A4
MTTNSTGNGGAVGQENINTDIVTLSRFFTEEQTKVPEATGDFTLLCHALQFSFKSIAYYIRRASLINLTGLAGSSNTTGDDQKKLDVIGNDLFVSAMRTSGKCRILVSEEEEEAIIFDEHPNARYAVVCDPIDGSSNLDAGVSVGTIFGIFRLPDDILGPGKKVTAKDVLLPGTEMVAAGFTMYGASAQLVITMKNGGVNGFTLENSLGEFILTHPNMKLPPSRAIYSVNEGNSMYWDDWCNAYFDSLKRPGEGKKPYSARYIGSMVADAYRTLLYGGVFAYPADSKSPKGKLRILYECAPMAMVFENAGGKAVNSRMERLLSVQPESIHDKSGVFLGSRDEVQKVIDTYNKYKK

SEQ ID NO: 16374 - protein, 1130 aa, Triticum aestivum
MSSSRAASSSSSRNRQSTQERVLAQTTLDAELNAEFEESSDSFDYSKLVEAQRDTPTVLQEGRSEKVIAYLQHIQRGKMIQSFGCLLALDEKSFNVIAFSENAPEMLTTVSHAVPSVDDPPRLDIGTNVRSLFTDQGAAALHKALGFADVSLLNPILVQCKTSGKPFYAIVHRATGCLVVDFEPVNPTEFPATAAGALQSYKLAAKAISKIQALPGGSMELLCNTVVKEVFDLTGYDRVMAYKFHEDNHGEVFAEITKPGLEPYLGLHYPATDIPQAARFLFMKNKVRLICDVRARPIKVIEDEALPFDISLCGSALRAAHSCHLQYMENMNSIASLVMAVVVNENEEDDEVGSEQPAQQQKKKILWGLIVCHHESPRYVPFPLRYACEFLAQVFAVHVNKEFEVQKQLREKSILRMQTILSDMLFKEASPLTIVSGAPNIMDLIKCDGAALLYGGKVWRLGTAPTESQIRDLALWLSEVHMDSTGLSTESLHDAGYPGASALGDTVCGMAVAKINSSDILFWFRSPTAKEIRWGGAKNDPSDMDDSRRMHPRLSFKAFLEVVKMKSLAWTDSEMDAIHSLQLILRGAVDGVVKPTGKASLDEQIGDLKLDGLAELQAVTSEMVRLMETATVPILAVDGNGLVNGWNQKAAELTGLRVDDAIGRHILTLVEESSVSVVQRMLYLALQGKEEKEVRFEVKTHGPKRDDGPVILVVNACASRDLHDDVVGVCFVAQDMTVHKLVMDKFTRVEGDYMAIIHNPNPLIPPIFGADESGWCCEWNAAMTKLTGWHREEVLDKMLLGEVFDSRNASCLLKNKDAFVSLCVVINSALAGEETEKAPFGFFDRSGKYTECLLSVNRRQNEGGLITGVFCFIHIPSHELQQALQVQQASEQKSLKRLKAFSYMRHAINNPLSGMLYSRKALKNTDLNEEQMRQIHVADNCHHQLNKILADLDQHNIMEKSSCLDLEMAEFVLQDVVVAAVSQVLIACQGKGIRVSCNLPERFMKQLVYGDGVRLQQILSDFLSISVKFSPVGSSVEISAKATKNSIGENLHLIDLELRIKHQGLGVPAELMAQMFEEDEPQQSEEGLGLLVSRNLLRLMNGDVRHLREAGVSIFILTAELACAPTAMEH

SEQ ID NO: 16375 - protein, 639 aa, uncultured Chloroflexi bacterium
MSNKKGLRPFTPLKLNLLSPVPSDIEIAQAADIKLITQVAEEAGLLPAELELYGNYKAKVRLEVLERLKDVPDGKYIDVTAITPTPLGEGKSTTMMGLSQALGAHLGKNVITCIRQPSQGPTFGIKGGAAGGGYSQVIPMEDFNLHLTGDIHAITAANNLLAAALDARMFHEARQPDDDKLFNALCPADKQGNRSFSPSMLRRIKKLGIDKTDPADLTAEERKRFARLDIDPDSITWRRVVDTNDRFLREITVGQGPEEKGMTRVTGFDITVASEIMAILALTTDLADMRERMGKIVIGTNRAGEAVTAEDLGVAGAMTVLMKDAIKPTLMQSLEGTPVFVHAGPFANIAHGQSSIIADKIALKLADYVVTESGFGADIGMEKFMDIKCRYSGLVPHVVVMVATVRALKMHGGGPRVVAGKPLDSAYTDENLDLLRAGLGNLQHHIKNALSYGVTVVVAVNSFASDTKAEVDLVRQAAMEAGAEDSVVCTHWMEGGKGATKLAEAVVKAAEKPSNFRFLYPLDISIKEKIETICKKIYGADGVEYSPEAEAKIELYTRLGFDKLPLCMAKTHLSLSHDPSLKGVPKGFTVPINDIRASVGAGFLYPLLGTMRTMPGLPTRPVFYDVDLDLETGRVVGLF

SEQ ID NO: 16376 - protein, 807 aa, Triticum aestivum
FGCLLALDEKSFNVIAFSENAPEMLTTVSHAVPSVNDPPRLDIGTNVRSLFTDQGATALHKALGFADVSLLNPILVQCKTSGKPFYAIVHRATGCLVVDFEPVNPTEFPASAAGALQSYKLAAKAISKIQALPGGSIELLCNTVVKEVFELTGYDRVMAYKFHEDNHGEVFAEITKPGLEPYLGLHYPATDIPQAARFLFMKNKVRMICDVRSRSIKVIEDEALPFDISLCGSALRAAHSCHLQYMENMNSIASLVMAVVVNENEEDDEVGSEQPAQQQQKKILWGLVVCHHESPRYVPFPLRYACEFLAQVFAVHVNKEFEVQKQLREKSILRTQTILSDMLFKEASPLTIVSGAPNIMDLIKCDGAALLYGDKVWRLGNAPTESQIRDLALWLSEVHMDSTGLSTESLHDAGYPGASALGDSVCGMAVAKINSSDILFWFRSHTAQEIRWGGAKNDPSDQDDSRRMHPRLSFKAFLEVVKMKSLAWTDSEMDAIHSLQLILRGTVDGVVKPTGKASLDEQIGDLKLDGLAELQAVTSEMVRLMETATVPILAVDGNGLVNGWNQKAAELTGLRVDDAIGRHILTLVEESSVSVVQRMLYLALQGKEEKEVRFEVKTHGPKRDDGPVILVVNACASRDLHDDVVGVCFVAQDVTVHKLVMDKFTRVEGDYMAIIHNPNPLIPPIFGADEFGWCCEWNAAMTKLTGWHREEVLNKMLLGEVFDSSNASCLLKNKDAFVSLCVVINSALAGEETEKAPFGFFDRSGKYTDCLLSVNRRENEGGLITGVFCFIHIPSHELQQALQVQQA

SEQ ID NO: 16377 - protein, 256 aa, Geobacter sulfurreducens PCA
MCLILFALDAHPRYRLVLAANRDEFYARPTAPAAFWDDAPQVLAGRDLTAGGTWCGVTRDGRIAAVTNYRDPGAHRVGARSRGELVAGFLGGDEAPSRWLEHLQRNGHDYNGFNLIFGDGNGLHYHSNRGAAASPLSPGIHGLSNHLLDTPWPKVARGRDALARLLATADEPAVDDLFAILANRTPAPDHLLPDTGVSLDWERLLSPLFITSPTYGTRSSTVILVDRSGQCTFVERSYNGAADHPRTVEYRFEVIT

SEQ ID NO: 16378 - protein, 505 aa, Debaryomyces hansenii CBS767
MNWYIIIFIAYFVRRLIILCKNYWLARQWGCEPMQEFGGRFGIISLINVIKARREGFLVDYQKQTYIETDTDTIKSRLFHKQLIHTKNAENVKAVVATQYDDFSIGKRHKFFKPLLGNGIFASEGERWQHSRTMLRPQFARERVAHVQALEPHLQVFAKHVRKSEGGVFNIQILFHKLTIDAATEFLFGESVDSLRDASIGYESLPTDIDGKAGFDDAFNISQNYMMLRALAQDLYFLFDSKEFREANRKIHKFTGHYVHKALETTQEELDAKSRDGYIFLYELVKQTRDPIILQDELLSIMLAGRNTTASLLSFLFFELARNPEIWSKLKREVYEHFGNGDDVKLEKITFESMKKCTYLKWVINETLRMYPSVPQNFRVAKKDTTLPRGGGKDQQSPIFVPKGQFVLYTTYSMHRLEAYYGKDADVYRPERWENLRNIGWAYMPFSSGPRVCLGQQFALTEASYITIRLAQMFPNLESHDSKYPPPKLTNSTMRHLDGVFISLH

SEQ ID NO: 16379 - protein, 419 aa, Oryza sativa (indica cultivar-group)
MENMRSENFNQGVSMEGVKHAPEMANTNRRALRDIKNIIGAPHQHMAVSKRGLLDKPAAKNQSGHRPMTRKFAATLANQPSIAPLAPIGSERQKRTADSAFHGPADMECTKITSDDLPLPMMSEMDEVMGSELKEIEMEDIEEAAPDIDSCDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKLELMSFFIIELSLVEYEMLKFQPSMLAAAAIYTAQCTINGFKSWNKCCELHTKYSEEQLMECSKMMVELHQKAGHGKLTGVHRKYSTFRYGCPAKSEPAVFLLKSVAL

SEQ ID NO: 16380 - protein, 283 aa, Corynebacterium glutamicum ATCC 13032
MNDSILLGLIGQGLDLSRTPAMHEAEGLAQGRATVYRRIDTLGSRASGQDLKTLLDAALYLGFNGLNITHPYKQAVLPLLDEVSEQATQLGAVNTVVIDATGHTTGHNTDVSGFGRGMEEGLPNAKLDSVVQVGAGGVGNAVAYALVTHGVQKLQVADLDTSRAQALADVINNAVGREAVVGVDARGIEDVIAAADGVVNATPMGMPAHPGTAFDVSCLTKDHWVGDVVYMPIETELLKAARALGCETLDGTRMAIHQAVDAFRLFTGLEPDVSRMRETFLSL

SEQ ID NO: 16381 - protein, 598 aa, Azoarcus sp. BH72
MLEQFSGILRRSPNPDPSAASGTALERVDLGRATVAYRPAIAVARDGTGLCIALGRPRFADPALQAIAAQQGPAVAWLQALRDQGESVIPSVRGRFNVVFIERDGAEALFATDRFGTWPLCYAEQDGALHFADRADALPGPGRRLSAQAVYEYLFFHMIPAPTTIFEGVARLPGGHVLQWKDGRATCRAWWQPRFDERERPSFESAKRQFLDIVENAVRRDAEGPVGCFLSGGTDSSTVTGMLCKVLGRPARSYSIGFDASGYDEMEYARIAARHFGADHHEYYVTPDDLLDGIPRVAVHYDQPFGNSSAVPAWICASRAQDEGVARLLAGDGGDELFGGNTRYAKQRVFGWYDSVPGLVRRGMLEPVLALPGMGRIPLMKKGVSYVEQARVPMPDRMHMYNMLLRLGTREVFEADFLARIDVDRPQQQQREVWQASSARSQVNRMLAYDWKYTLADNDLPKVIGTTQLAGVDVAFPLLSDELLDFSLTLPPDWKLRGLTLRWFFKEALRGFLPDQIITKKKHGFGLPFGVWACAHAGLKAQAHDALRSLAARGIVRPRFIDELFTTHLPAHPGYYGEMVWILMMLEFWLRAHDGSTL

SEQ ID NO: 16382 - protein, 402 aa, Campylobacter jejuni RM1221
MDYKQLKQEFNTPFYIYNFDFIKECFLNLKEAFKARKSQIFYAVKANSNLSLLQMLANLDSGFDCVSIGEVKRALKAGAKAYKIIFSGVGKTKEELRQALEYDILYINLESEAEMMLLESVAKELNLKARISIRVNPNVDAKTHPYISTGLNENKFGVEIDIARKMYLYAKNSSFLEPVGVHFHIGSQLLDISPIHEAAGIVAKLVRELKALQIDLKFFDIGGGLGVAYEKDECESDLYDYAQGILAQLHGLDLTIGMEPGRYLVAKSGEFVCSVLYEKQNKTKRFVVVDGAMNDLIRPSLYEAYHEIILPYNQAQESLCDVVGGICESGDFFAKARSLPSTQSGDIMVIKNTGAYGFSMSSNYNTRNKVCELALEEGQVRLIRQRENFENQIALEEKFLKA

SEQ ID NO: 16383 - protein, 715 aa, Yersinia pestis CO92
MKKILTVCPYCGSGCKLNLLVEDGEIVGAEPADGVTNQGALCLKGYYGWDFLNDTRLLTPRLTTPLLRRQRGEAFQPVSWEAAIAFITAKLSAIKERHGPDAIMMTGSSRGPGNEANYVMQKFARAAIGTNNIDCCARLCHGPSVAGLQQTLGNGAMSNSIGEIENTDCILVFGYNAADSHPIVARRILKAKNKGAKLIVCDPRHIETARIADQWLPLKNGANMALVNAFIHVLIEEKLYDANYVRDHTRGFDELKAGVAAYRPEDVEPITGLSAKAVRQAMRTYAAAPAATLLWGMGVTQWGQAVDVVKGLSSLALLTGNLGRPNVGVGPVRGQNNVQGACDMGVLPNTFPGYEKVTDSEARARFAHAWGVAELPAHVGYSITDVPHKVAEGKLKAYYVFGEDPIQTEPDLAAMRAAFAALDLVVVQDIFMTKTAELADVVLPATSWGEHEGVYTSADRGFQHFNKAIEPKGDVKPDWEIISLISTAMGYPMAYQNTQQIWDEMRGLCPPFAGVTYEKLAGLGYVQWPCPTEDHPGTPYLYTDNQFATADGKGLLSCAPWQPPHEQTDSDYPLALCTVREVGHYSCRSMTGNCGTLKILADEPGYVQIHPEDASYLGVIDQALIWISSRRGKVIARASVTERANRGAVYMTYQWWIGACNELTVDHVDPVSKTPEFKHCAVKVEAISDQTAAEQYVEQQYSQLKKRLSDAAVVP

SEQ ID NO: 16384 - protein, 427 aa, Azoarcus sp. BH72
MRTTPPFAETEGPAMTEARPTPTHTPMTQFRSAEGQLLVNGVPLTRLAVRVGQTPFYAYDRSLLDARVAQLRAALPSEIKLHYAMKANPMPALVGHMVRLVDGIDVASAGELQVALDAGADPKEISFAGPGKREQELLQAVAAGILINVESFRELPILAAAQDALGLPARVAVRVNPDFELKSSGMKMGGGPKQFGVDAEDVPRLLAEIGNAGLAFEGFHLFAGSQNLRPEAIVEAQQKSYALAVRLAEHAPTAVRFLNLGGGFGIPYFPGETPLDLAPIGDNLGAIVAAARQQLPEAEIVIELGRYLVGEAGIYVARVVDKKVSRGQIYLVTDGGLHHHLSASGNFGQVIRKNYPAAIGNRIEGSMRETVSVVGPLCTPLDLLADKMSLPAAEPGDLVVVYQSGAYGASASPQRFLGHPAVAEVLV

SEQ ID NO: 16385 - protein, 203 aa, Oryza sativa (indica cultivar-group)
MFSLAYGLWKYIFNKTEFHVLILGVDKAGKTTLLEKIKSIYLKGEGLTPDRIVPTVGLNIGRIEDANAKLVFWDLGGQVGLRTIWEKYYQEAHAIIYVIDAAAASSFEDAKSALEKVLRHEDLKGAPLLIFANKQDLPGVITDEELARYLQLKELDERPYKFQAVSAYDGRGIKSGIDWVVEQMERSKRTEVLRARAGLTGQI

SEQ ID NO: 16386 - protein, 526 aa, Coccidioides immitis RS
MDDDNANNPDAPLLSENRTSPRSWYQSRTLLGGEGAHAGAKAATEDLIPNGSGTWFIWALTLSAGLSGLLFGYDTGVISSTLVCIKTDLSHRELTTLDKSLITSSTSLFALISSPIAGALGDRLGRKPVILIADALFVVGALWQAATSDVSGMIVGRSLVGLAVGAASLITPLYIAELSPSEIRGRLVTVLALFITGGQVTAYVTGWLLSTAPSGWRWMVGLGALPALIQLFILIFLPETPRWLVKAGKDNEARLVLGKVYGKSDIIRQAVDRIIRDIENDINEESQRLAPQQDATSEASQCLNSMLQSWSSLFRIPSNRRALIIALAVTNFIFTLLAFSLIDRIGRRRILLSSIPIMAVSLLFCAAVFPAMDIFPTPGKGMAAGVDSNDYAAAPQPGLKPVLILISLTMYTASYASGLGNVPWQQSELFPLQVRSLGSALATATNWGSNFLVGLTFLPLMEFISPGWTFLIYAVVCIVGWLAVWAIYPEMSGLGLEDVKSLLVDGWGVRESLERFAKRRGNVVQT

SEQ ID NO: 16387 - protein, 343 aa, Rhodospirillum rubrum ATCC 11170
MGWDGARQGPPVLSLKAGEGEAARRDEFLATLRQAARDPGAFYLEGHGIDPSVIDQVEALSRRFFALPEDEKRAIDMVNSPHFHGYTRVGAELTRGAPDWREQLDIGSERPLLPQGPDTPAWARLQGPNQWPAALPDLRAAVLRLQAELTAVALALLERIALALGERADFFADLYEGGPDQLLKIIRYPGRAAGEGDQGVGPHKDSGLLTFVLQRDRGGLQIEREGHWVDVPPRPGTFAVNIGELLELATNGYLKATVHRVVSPPADSDRLSIAFFLGARLGSKVPLLDLPPDLAALATGPERDPDNPLFLDVGENRLKGRLRSHPDVARRHYADLLGPDGPS

SEQ ID NO: 16388 - protein, 391 aa, Rhodospirillum rubrum ATCC 11170
MIPPGNAIFAAAGASVFETMSQLAHEHGAINLGQGFPEALEPPEVIEAAARALRDGPHQYPSAWGVPALRQAVAEANERFWGLATDPTREVLVTSGATEALAACFLGLLNAGDEVIVLQPAFDCYQAQIRRAGAVAVGVALSAPDWTLPRAALAAAITPRTRAIVLNTPMNPCGKVFDGPELDFIAELLIAHDLVAICDEVYEHLTFEDRAPLPLMTRPGVRARCLRIGSAGKTFSVTGWKIGYVSGDAALLAPVARAHQVTTFSTPPFLQTAVAHGLRLADGYFDGLRATLRTRRDLLSRGLTEAGFEVLGCQGTYFLLAGTDGAEDDVGFCRRLVEEAGVTAIPLSGFFTPAGRRPLVRFCFAKRLETLEGGIARLVAWRGGQRWRRAS

SEQ ID NO: 16389 - protein, 620 aa, Coprinopsis cinerea okayama7#130
MEESPRGYTTGSLYSGDGTTTQPHTPHLGLTEAELYKRSIPDVPEDVDYYMEHLNDPNFDLKANRPGSISSTSYSMETKKKYPGWDQSDTESQFDRYSSTRAESRHSAVIEFDEESPYPEVRASVSSVDDPLMPVNTFRMWFLGLFFVFVITFFNQIFAMRYPSVYVTGIVVQLIALPCGKGLERILPKTVFNFFGYKWSLNPGPFSIKEHVCITVMANAVSWGIYITEVSLSQRVFYGVEVPYSFQILIALGSHIFGFSLAGFLRRFVVYPSSMIWPGALVNSALFNTLHKNYGVRDKGHMSRERFFLIATAASFVWYWVPGYLFTGLSMFSWICWIVPENVTVNALFGVNTGLGMSVLTFDWSMIAFVGSPLVTPWWSEMNTAVAFIVVFWIICPIIYFTNTWETSFFPISDYYSFDNTGGLYDATAILTDGVFDQAKYSAYSPVFMSSSLALAYGVAFAAFPAIFVHTFLWFRKDILRRFRSSLKDERDVHSRLMQYYPEVPGWWYAVVGVISFVFMVIALEVNPASQLPIWGLFLACGIGMILALPLAMLQAITNQSIPTQVMAELIIGYILPGRPMANMVFKGIMFSTGQQAVQFAGDLKLGHYMKIPPRLIPGC

SEQ ID NO: 16390 - protein, 346 aa, Pseudomonas aeruginosa UCBPP-PA14
MRSQDLHQRLADLGAKPLHCGRIVRAWLQGRALDACTARQPAEDFLPLGVRHGLPQVAAELEGIARLHSEHPASDGSSRLLVELADRQMVESVLLPRGGLCVSTQVGCAVGCVFCMTGRSGLLRQVGSLEMVAQVVLARRRRAVKKVVFMGMGEPAHNLDNVLEAIDLLGTDGGIGHKNLVFSTVGDPRVFERLPLQRVKPALALSLHSTRAELRRQLLPKAPPLSPEELVEAGEAYARRVDYPIQYQWTLLEGINDSLEEMDGILRLLKGRFAVMNLIPYNSMDGDAYRRPSGERIVELVRYLHSRGVLTKVRNSAGQDIDGGCGQLRARATQGTAERRIPARQA

SEQ ID NO: 16391 - protein, 153 aa, Bartonella bacilliformis
LTDTRGTAIMNRLFRAYEPYKGEIGGRINGVMISNDNGEAVAYALFNLEDRGAMVIDAGVKVYQGMIVGIHSRDNDLEVNVLKGKKLTNMRAAGKDEAIKLTPPVKMTLERALSWIQDDELVEVTPKNIRLRKLYLDPNERKRFEKTRSSILT

SEQ ID NO: 16392 - protein, 206 aa, Idiomarina loihiensis L2TR
MADQQLDYASAKFVTSAPDISKLPPDSGIEVAFAGRSNAGKSSALNTLTRQKALARTSKTPGRTQLINVFELTTGQRLIDLPGYGFAKVPLAVKEKWQRSLSEYLQQRDSLKGIVVLMDIRHPFRETDQELIYWAVDCDLPVLALLTKADKLKQGARKSTVLKAKQAAIAFNGDVQVEAFSSLKRIGVEQVEEKLNQWYSKEYDDE

SEQ ID NO: 16393 - protein, 823 aa, Oryza sativa
MGAAMLLAPMPLLLLASTPLAAVHLPTRCRLRLQLLSRAAPEAASATTTTTTAPDNHFSVEEYLISNCNLTQPQAHKASKSIAHLKSRSNPDAVLAFLADFGLSPKEVAAIVASNPRILCARIDRSLAPICSELRAVGLSPSQIARLAQITGRYFLCRSFVSKVRFWLPLFGSSERLLQASDWNYWLLTSDLEKVVEPNVSFLKECGLSARDISKLLVAAPRLVTMHPDYVKDAVRRAIQLGVAPGSQMFRHALSTAGCIGQDKIDAKVAVLKESLGWSQEEVNLAVSKAPRILVASEERLRRNAEFLIDEVGLQPQYVARRSVLLMYSLERRLVPRHLVVKLLKERGLIEQDRCFFNAVAPTEEKFLEKFVVPFEGCVPGLADAYESACAGKTPAQDGTRSRALFLLPVKTEAQISLTTGHDTAVRSRRDPSPPRRRAGAMQRLQKQLLPALRAAFPLPASHFSSRLLSASTATLSPTRFVDEDALVAACGLTGAEALKASKRLQKVPSNLDAALTFLAFLADFRLSKDDIAAASSRYPRFLHLKVDETLTSQVARLRDIGLSTPEIGRLITIAPCILSNPRTISRLEFYLSFLGSYPRVHSALRNNSSLLRRNNIESEVKPNIAFLEQCGLTTCDIAKILMSGSRILIMQPEHVKEIVACADKFGMPRESAGFRYALMAVTGISPVRVSAKLDFLRMVIGCSDAQLHIAVSRFPLILTYSEVKLSRSLEFLKAEVGLEPQYIVLRPALLGYSIQKRLMPRYHVMKVLNEKGLLKKDTDFYSMVKIVEESFFKKFLLPYHRSVPGLEKAYLAAREGKMFPEI

SEQ ID NO: 16394 - protein, 543 aa, Corynebacterium glutamicum ATCC 13032
MGDDLVQHLPGLNRRLPGVDKRNRIALSACGVLRAPENFQEEGIRRIGGNHSDEAGVLALKSLSFHTRCGFSPQWKNSLAQAAKTPATQWKGRRQRLLRHHKWWLLSRCEPQNLSCTRVYSAKEITSLDSMLTMPIPEYLHEILDDVRDTTSGELADYIPELKSADPNPLAVALCTVNGHIYSAGDDDIEFTMQSISKPFAYALALQECGFDEVSASVALEPSGEAFNELSLDGENRPMNPMINAGAIAINQLINGSDSTVEDRVEKIRHYFSELAGRELTIDRVLAESELAGADRNLSIAHMLRNYGVIEDEAHDAVLSYTLQCAIKVTTRDLAVMTATLAAGGTHPITGKKLLDARVCRLTLSVMASAGMYDEAGQWLSTVGIPAKSGVAGGLIGILPGQLGIATFSPRLNPKGNSVRGVKIFKQLSDDMGLHLMSTEQVSGHAVRSITRDGDTTFIQMQGAMNFSASESFLHAIVEHNFEGTEVVLDLTRVLSFHPVAIRMIKEGLKRIRDAGFEVFILDPDDVLPDFMFSDGTICKERV

SEQ ID NO: 16395 - protein, 929 aa, Mycobacterium sp. KMS
MTTEFVRQDLAQNSSTAAEHDRVRVIREGVASYLPDIDPDETSEWLESFDQLLERSGPARARYLLLRLLERSGEQRVAIPALTSTDYVNTIPTELEPWFPGDEDVERRYRAWIRWNAAIMVHRAQRPGVGVGGHISTYASSAALYEVGFNHFFRGKSHSGGGDQVFIQGHASPGIYARAYLEGRLTADQLDGFRQEHSHPGGGIPSYPHPRLMPDFWEFPTVSMGLGPMNAIYQARFNHYLHDRGIKDTTDQHVWAFLGDGEMDEPESRGLIHVAALEALDNLTFVVNCNLQRLDGPVRGNGKIIQELESFFRGAGWNVIKVVWGREWDALLHADRDGALVNLMNTTPDGDYQTYKANDGGYVRDHFFGRDPRTKALVEPMTDAEIWNLKRGGHDYRKVYAAYRAAMEHKGQPTVILAKTIKGYTLGKHFEGRNATHQMKKLALQDLKDFRDAQRIPIGDAQLEENPYLPPYYHPGPEAPEIRYMLDRRRALGGFVPERRTKSKALALPSSDAYKALKKGSGKQEVATTMATVRTFKEILRDKQIGHRIVPIIPDEARTFGMDSWFPNLKIYNRNGQLYTSVDAELMLAYRESEVGQILHEGINEAGSVGTFIAAGTSYATHNEPMIPIYIFYSMFGFQRTGDSFWAAADQMARGFVLGATAGRTTLVGEGLQHADGHSLLLASTNPAVVAYDPAFAYEIAYIIESGLHRMYGENPENVYFYLTIYNEPYVQPAEPENLDVEGLLRGIYRYRAAAEKKSNTAQILVSGVAMPSALKAAEMLAEEWDVAADVWSVTSWNELNRDGVQVEKDLLRHPDRPAGTPYITTALADAAGPVVAVSDWMRAVPEQIRPWVPGTYITLGTDGFGFSDTRPAARRFYNTDAESITVAVLEGLARDGNIDISVAVEAARRYEIDDVLAAPEQTSDPGVA

SEQ ID NO: 16396 - protein, 365 aa, uncultured candidate division OP8 bacterium
MRPMKGWPGDRVCRTIRFQPMPLQFKDLTAAELHAALAPEGVSLRLARRLQAAVLKRDAFPRTLPEVSDKMLARIREEVRLPKLVLKDKAVSARDGFAKYLFQGDGPEPFEAVRIPLLHRSGDEKYIACLSSQVGCALGCAFCATGRMGFVRNLSAWEMVDQVIRLSADSEHPIRGAVFMGMGEPMLNYEAVVRAARILCEPCGLAVSAKAVSISTAGVVPGIRRFTADRLPFRLVVSLTSADSARRREVMPLEQAYPLTDLMEAVREYHKSSGQRVILAWTMISGFNTREEDAVQLAALVRGLPIRLDLIDVNDATGRFKPPSSLELHEFRDALSKHLKMPVARRYSGGKDIRAACGMLAGRRN

SEQ ID NO: 16397 - protein, 91 aa, Narcissus pseudonarcissus
LTYYDTSITGVLRYGGIEDLKGIQVRRFLMWFDVEAIKVDLPPSDFVYFEVGWITKKLRVEQFQIVRSCEEKGRFEKLSAPVKEIGLLITE

SEQ ID NO: 16398 - protein, 453 aa, uncultured candidate division OP8 bacterium
MPFSSLHLHPTLLKALKELGFPRPTPIQADAIPPAMSGRDVMASAVTGSGKTAAFLLPILHQLIDRPRGTTRALVITPTRELAAQILEDLNDLAVHTPISAAAVFGGVSIRPQEHAFRRGVDVLIGTPGRLLDHFRAPYAKLAGLEHLVLDEADRMLDMGFLPDIRRILKHIPARRQTLFFSATMPAPIGVLAREMLRNPATVNINRIAAPAAGITQAVYPVAQELKAALLVALLKRDDIRDALVFTRTKHRANRLAEHLVRQGIKAERIHGNRSQGRRTEALAGFKAGKYRVLVATDIAARGIDVTELGHVVNFDVPLVPDDYIHRVGRTARAEATGDAFTFVSPQEQGDLTRIERVIGKQLPRITVPDFDYRARTESRLEVPLAERIAAIRSRKAEERARAKAKAERKAALPPPGPARVTPKPEPKRSAPAPRGRGSRRGGRRSGGGGRFR

SEQ ID NO: 16399 - protein, 718 aa, Rhizobium leguminosarum bv. viciae 3841
MSFSFSELDFLKPELGAEYTGSGTHFAVFSAHAEQMELCLFSPDGKNEIARLPLPKREGDIWSGYIAGVGPGTVYGYRAHGPYDPQAGHRFNPNKLLLDPYAKQVTGELKWDDALFGYQIGEDDLSFDARDSAPFTVKGVVQDPDFDWAGEEAIRRPWPDTIIYEAHVRGLTMTHPKVPDRLRGTFLGMCSDPIIDHLVKLGISAIELLPIQYFLDDRYLLENNLRNYWGYQTLGFFAPQSRYMSGDKITEIKTMVKKFHAAGIEVIMDVVYNHTAEGSEKGPTLSFRGLDNASYYILSPDDPRHTYDTTGTGNTLNAANPMVMRMVLDSLRYWVGVMHIDGFRFDLASTLGRQDMEFDRQGLFFGAIRQDPILAGVKLIAEPWDVGDGGYQVGGFPHPFREWNDKFRDDVRRFWKGDGGMVSEISQRITGSAVQFNHSDRGATSSINLLSAHDGFTLMDTVSFDDKHNDANGEDNRDGHSDNHSDNMGAEGVTDNEDINSLRARRRRNMMATLMLSQGVPMILAGDEVGNSQGGNNNAYCQDNEIGWTDWSGLDDPFLDFCRQAVAFRKAHPVLRQERFLTGETAEDGRIEIAWYKPDGGFMDEGAWNDDGLQVLGVYVSRSVHAPDTEEMDDLFLVFNAGGDCEVHLPVVNGLKQWSRVLDTGSETASFEVREPENPVIVYAQSVAVFAPKGQTEPPKGATKAERRRWFQFGRRSK

SEQ ID NO: 16400 - protein, 44 aa, Oryza sativa (japonica cultivar-group)
GTGRNKKNGNIFERWKCFDCQGFGLKSCPSCGKEGLTPEQRGER

SEQ ID NO: 16401 - protein, 202 aa, Arabidopsis thaliana
MVFWEITLGTAYFLGLRRTYRLALKIQRRLVTPKHPKIRQFLHRRTRKIFDVAISVHKNIQERDIEVGRNLGNWILRWLDKMKPAAQIRTRPELPHNSNSNMDKAKRLTELSRPKSHTNTTQTPQNRESDRHLFTSLKHFRHKPFPSVSMMIQPPRPNGTTTQYRHYYSGGLAASLIQPSYVTGGGFNGVVRKDILQWMAQR

SEQ ID NO: 16402 - protein, 243 aa, Burkholderia thailandensis E264
MIVSKRFASAVLVALALIGGAAAQPLPLPDRLIDLGSSAGERMLAESGARSAYASLGSHFVTQQTQSYCGVASLVMVLNALRVPAPAAAQYPPFHYFTQDNVLNDATEKIRPRAQIELHGMTLDQLGALAHALGASGDIRHASDVSIDAFRADAVAHLGRPGRYVLVNYLRSRLGQQTGGHISPLGAYDAAADRFLILDVSRYKYPPVWVTTADLHAAMNTPDADSGGRSRGYVLIDGAAGGG

SEQ ID NO: 16403 - protein, 536 aa, Desulfitobacterium hafniense DCB-2
MAGLATSFGSGAMTNSINEIPNAEVMFVIGSNTTEAHPIIGTKMKQALARGAKLIVADPREIELARDAHIWMRLKPGTDIALINGIMNIIVENGWEDRAFIEERTEGYQELRENLKKFPPEEVSKITGVPVELMAEAARLYTSVERAQIFYTLGITEHVCGTDNVMSLANLAMLTGNIGKESSGVNPLRGQNNVQGACDMGALPNVYPGYQSVTNPEARAKFEEAWGVSLNPNQGFMIPDMFDSAVKKELRAMYIMGEDPVLTDADANHVRKGLKALDFLVVQNIFMSETAELADVILPGASFAEKDGTFTNTERRVQRVNRAIKPIANTKADWEIICELSNRMGYPMAYPSPAEIMLEVASLAPQFAGVTYERLGKKGLQWPVPHAEHPGTKFLHQGKFTRGKGVFTVIEHQLPDELPDEEYPFLLTTGRKLQHYNISTRFSAALDEHAPEELAELNPKDARRLGIQDGEKIKVVSRRGEVVTKVWVTKRVPPGVLFMTLHYRESPTNVLTNGAYDKVTKTYEYKVCGVRVEALK

SEQ ID NO: 16404 - protein, 473 aa, Antirrhinum majus
MGSRNIVQQQNRAEAAVPGAMKQKNIAGEKKNRRALGDIGNLVTVRGVDGKAKAIPQVSRPVTRSFCAQLLANAQTAAADNNKINAKGAIVVDGVLPDRRVAAARVPAQKKAAVVKPRPEEIIVISPDSVAEKKEKPIEKEKAAEKSAKKKAPTLTSTLTARSKAASGVKTKTKEQIVDIDAADVNNDLAVVEYVEDMYKFYKSVENESRPHDYMGSQPEINEKMRAILIDWLVQVHHKFELSPETLYLTINIVDRYLASETTIRRELQLVGIGAMLIASKYEEIWAPEVHELVCISDNTYSDKQILVMEKKILGALEWYLTVPTPYVFLVRFIKASMTDSDVENMVYFLAELGMMNYATLIYCPSMIAAASVYAARCTLNKAPFWNETLQLHTGFSEPQLMDCAKLLVAFPKMAGDQKLKSIYRKYSNLERGAVALLSPAKSVFVFLIELLMNAIEKIQCSLFFTSEIWCRF

SEQ ID NO: 16405 - protein, 441 aa, Antirrhinum majus
MGSRHQVVQQQNRGDVVPGAIKQKSMAVEKKNRRALGDIGNVVTVRGVEGKALPQVSRPITRGFCAQLIANAEAAAAENNKNSLAVNAKGADGALPIKRAVARVPVQKKTVKSKPQEIIEISPDTEKKKAPVLEKEITGEKSLKKKAPTLTSTLTARSKAASVVRTKPKEQIVDIDAADVNNDLAVVEYVEDMYKFYKSAENDSRPHDYMDSQPEINEKMRAILIDWLVQVHYKFELSPETLYLTINIVDRYLASKTTSRRELQLLGMSSMLIASKYEEIWAPEVNDLVCISDGSYSNEQVLRMEKKILGALEWYLTVPTPYVFLVRFIKASLPDSDVEKNMVYFLAELGMMNYATIIMYCPSMIAAAAVYAARCTLNKMPIWNETLRMHTGFSEVQLMDCAKLLIDFHGGSTDQKLQGIYRKYSRLEKGAVALLPQPLLA

SEQ ID NO: 16406 - protein, 995 aa, Listeria innocua Clip11262
MGAKVSVRINGEARDVVEGTRILDYLNAEGIQHPHICYSEQIGPIQSCDTCMCEVDGELMRACSTNLTDGMEIKTNSELAKDAQLEAMDRILENHLLYCTVCDNNNGNCKVHNTTELLGVEKQDRPYREKGYLNDFTHPFYRYDPDQCILCGRCVEACQQVQVNETLSIDWERSQPRVIWDDDRPANLSSCVSCGLCATVCPCNALMEKSMLGQAGFMTGLDEDMLEPMIDMVKKVEPNYQTVFAVSEMEAAMRETRTKKTKTVCTFCGVGCTFEVWTKDRKILKVEPTGEGPVNKFATCVKGKFGWDFVNSEKRITTPLIREGNEFVPASWEDAIHLVATKLREIQAKYGNDSIGFISSSKTTNEENYLMQKLARQVFETNNIDNCSRYCQAPASDGLTRTVGIGADSGTVEDIESAGLVIIVGASPADGHPVLASRIKRAQKTRGQKLIVSDLRKHEMAERSDLFIHPKQGTDFVWLTAVAKYIIDQNWHDQVFMENRISNVADYLAFLEPFTLEYAEKETGLPAETLKLVAEMIHEADGTAVCWGMGVTQNIAGSHTSSAIANLLLVTGNFGRHGAGAYPLRGHNNVQGACDMGSLPNVLPGIQPLGNDEVRARFEEAYGVSISPEPGLKNNEMLDAIEAGTLHSMYVIGEEMAWVDSNSNHVQEILSSLDFFVVQDVFLSKTAQFADVVFPAAPSLEKEGTFTNTERRVQRLYEVLEPLGDSKPDWWIIQEVARACGRTDWNYDHPSEIMDEIASLAPFFAGVRYDRMQGFNSLVWPVSADGKDMPLLYEERFNFPDGKAQFSTLPYIAPITFPEEFNLTLNNGRLLEQFHEGNLTDKSKGLDYKLPEVFVEVSHELAKERDIESGSLVRLSSPYGRIKLRAVVTERMKGNEVYVPMHSVSSETAVNLLTSSAGDVRTKTPAYKQTKVNLTVLEKTGKNPLPDHNPRNRKRFPQNGAEVERKWSREDYQPISKVNCACGGNCGCGGKGRNH

SEQ ID NO: 16407 - protein, 392 aa, delta proteobacterium MLMS-1
MKNIRDIDIRGKRVLIRVDFNVPIDEQGNITDDIRIRGVLPTINHALDENAAVIICSHMGRPKGERRPEFSLAPAARRLSRLLDKEVKLAPDCVGPEVAEMAAALSPGEVLLLENLRFHPEEQANDEKFSRELAALAEVYINDAFAVAHRAHASVVGIPRFAPAKGAGFLLQKEMDYFHRSVGNPMRPLAAIIGGSKVSSKLGALTNLMDRVDKMLIGGAMANTFLRSQGLDVGRSKVEDDLLETARELIAKAHERGVKLYLPVDCIVAPELDAKAETKRVTCQEIPATWMALDIGPATTMLFTEALDDAKTIIWNGPMGVFEVDAFSRGTMAMVQTLTRSHALTIVGGGDTDVAVHRAGESANISYISTGGGAFLMLMEGKTLPGVAILEE

SEQ ID NO: 16408 - protein, 250 aa, delta proteobacterium MLMS-1
MRTPLLAGNWKMHLDQAAAAELAAAVAKVAAACPEREVMIAPPFTALAAAGQAAGQQVILAAQNVCWEAQGAFTGEIAPPMLRELGCGMALVGHSERRQLFHEDNSMINRRLGGALAHGLVPVLCIGETLAEREADRTMEVLASQLREGLAGISLDDPRQLVVAYEPVWAIGTGKTAGPEQAQEAHQFVRGLLAELYQKNIADGVRILYGGSVNAANVDTIMAQPDVDGALVGGASLDIASFERIIRFQV

SEQ ID NO: 16409 - protein, 339 aa, Desulfitobacterium hafniense DCB-2
MNNKDINILGIETSCDETSAAVLRNGCELLSHIISSQIKTHQKYGGVVPEVASREHILHLQSVVEQALQEAKMGFGDLAGIAVTYGPGLVGSLLVGVAGAKAMAYGAGIPLLGVNHLEGHIYANFLHNPGLKFPLLALLVSGGHSHLVYFEGHGKYQVLGQTRDDAAGEALDKVARTLGLGYPGGPYIQKAALEGNPHAYEFPRAMLEPGSLDFSFSGVKSAVLNTLNSARMKGETVNVADVAASFQEAIVDVLVRKTLLALARTKAPTLVLAGGVAANTLLRERLTEATQKRGIAFSYPPPILCTDNGAMIATAGYYRYLDKDYAPWNLNAIPGLNLA

SEQ ID NO: 16410 - protein, 384 aa, Zea mays
MNCALLVLVFFQLHPGYLVRVFLDRLDSKDRSWFLTPHSLWICSCSVKGRLVSGVVGGQSFAGGEEEEQQRDSADTDRGRSANIGVFICLKCSGVHRSLGTHVSKVLSVTLDQWTDDEINSMIEVGGNSYANAIYEAFLPEGYQKPHPDSSQEERADFIRSKYELQEFLKPSLRLVSSNKGSLEATSTSSRKHMDNSVSLSASFSSEAGMVEFIGILKVKVIRGTKLAVRDLMSSDPYVVLTLGQQIISADKHQHCSLQKAKTSVSKRNLNPVWNEELKLSVPQHYGPLKLQVFDHDMLSKDDEMGDAEIDLQPMISAATAFGDPDLLADMQIGKWLRSPDNALARDSAVNVVGGKVKQEVSLRLQNVESGEVELELEWIPLNQ

SEQ ID NO: 16411 - protein, 239 aa, Aegilops searsii
RPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSV

SEQ ID NO: 16412 - protein, 377 aa, Lactobacillus sanfranciscensis
MADKNYYDILGISKDATDKDISHAYRHLSKKYHPDINKEPGAEAKFKEITEAYEALSDKQKRANYDQYGSADGPQGFGGGGQGGGFGGGANYGDFSDIFSDLFGGGRRQRQDPTAPRRGEDLQYQLNLTFDEAIFGAKKTITYHRQAQCPDCHGTGAKPGTHPETCPDCYGSGVVMRTVNTPMGQMQTQTACPKCHGTGKIIKEKCPKCGGIGKIEEEHKVEVNVPAGVEEGQQMRLQGQGNAGENGGPYGDLYIIFSVSPSKEFRRNGSTIYYDKTISFTDAALGNEIDVKTVYGDGKLKIPAGTQTGTVFKLRGKGAPRLHSESKGDELVKVMIDTPKKLNADQKLALRAFAEASGDKSQENKGFFEKLKDKLNK

SEQ ID NO: 16413 - protein, 212 aa, Aspergillus nidulans FGSC A4
MTTQDPFTAALSQNKAWAAKVAREQPDLFRKLSTGQHPEILWIGCSDSRCPETTLLGLKPGDVFVHRNIANILQPSDLSSTAVIEFAVRHLGVKHVVVCGHTKCGGISAVMANKKLGILDSWLSPLRKLRDDNSDCLKSLPTDEALLKLVELNVLAGVKTVKQKSVVVEAMQKGLKVHGLVYDVGSGVLQELDTSASDKTVKKRLTLFKKDF

SEQ ID NO: 16414 - protein, 329 aa, Matthiola incana
RSEAAVTYDSPYPLYAMAFSSSRAGQRIAVGSFLEDYNNRIDILSFDSDSMTVKPLPNLSFEHPYPPTKLLFSPPSLRRPSGGDLLASSGDFLRLWEVSEDSSTVEPVSVLNNSKTSEFCAPLTSFDWNDVEPKRLGTCSIDTTCTIWDIEKSVVETQLIAHDKEVHDIAWGEARVFASVSADGSVRIFDLRDKEHSTIIYESPQPDTPLLRLAWNKQDLRYMATILMDSNKVVILDIRSPTMPVAELERHQASVNAIAWAPQSCKHICSAGDDTQALIWELPTVAGPNGIDPMSVYSAGSEINQLQWSSSQPDWIGIAFANKMQLLRV

SEQ ID NO: 16415 - protein, 256 aa, Coprinopsis cinerea okayama7#130
MAALTSSGESIISSSLSVSTPQISDIHDYFEIERTRREIVEGGYRRVALQFPDELLGYSVPVAKALRRGTGEEGGKVEVYILADTSYGNCCVDEVAASHVDADFIVHYGYACLSKTARLPVLYVFGKAEVDVEDCASGEGVGGGIRDGGGSVCYDDSGGWATDDCVCRAANTSVDQPPPHAFDLYGCLLRSYIENYSTRIRPVQSPTDEAVLHPPQSPRCFDVWYPRRNAGGFAVSPSHFSSSVSSPEEWTEELYD

SEQ ID NO: 16416 - protein, 222 aa, Triticum aestivum
MIRAASPRPPSAVRLRSRGASSSSSACPFRARGSGSRVAATSGRRRRNVISCCSSDDREGARGAAPPAPSDGSIQLYSQIEKVITEAAKQSNQGWSSTGDWIEIEGAWVLRPKSSAPSFVVHFIGGIFVGAAPQVTYRYFLERLADKGALVIATPYASGFDHFFIADQVQFKFDRCLRNLVEPVNDLPTFGVGHSLGSVIHLLIGSRYAVQRSGNILMSFNN

SEQ ID NO: 16417 - protein, 236 aa, Zea mays
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQQGQAVELEPEQQLDPRTQPAHDAEETAAEPPPAASNGTADGGNKRKAAAMEEEGMLAVMTVAAPESSTKPRLATTSSSLAVET

SEQ ID NO: 16418 - protein, 448 aa, Corynebacterium glutamicum ATCC 13032
MRFAIIGAGLAGLTAAYEIHKADPTAQIDVLEAGERIGGKLFTVPFASGPTDIGAEAFLAARSDAVEFFTELGLADSLVSPSAAKSQYFAGGALHAFPAGGVMGIPSNPPAGAQDTAFDWTPGQDISVGALVRRQYGDEIVDTVVSSLLGGVYSSTADDLGVRASVPALAAALDQLAEAGEPVTLSAAVKAVEAQREAAKTTSETRPVFQTFKGGYAELYEALAEQCGADIHLDSFVSAITKDGEGFAIKGGGEGTYDKVILAVPAPTAAVLLRDLAPAAAPHLRAIKLASSAVVGMRFDSSEGLPDNSGVLVAVNEPGITAKAFTFSSKKWPHLEARGGALVRASFGRLGDEASARMDEDLLVDAALDDLLTITGFDGRAAGLGEIFVQRWFGGLPAYGVDHIATVSAARAEIAAVPGVEAIGAWAGGVGVPAVIADAQAAVHRLLG

SEQ ID NO: 16419 - protein, 434 aa, Corynebacterium glutamicum ATCC 13032
MTSSNTARSAEWFEKAQKLTPGGVNSPVRAFGSVGGQARFIEKAHGSTLIDVDGNEYVDLVCSWGPMLMGHAHPAVVEAVQKAVVDGLSFGAPTIGEVELAQDIVKRTSVEEVRLVNSGTEATMSAVRLARGYTQRSKILKFEGCYHGHVDALLASAGSGVATFALPDSPGITGAQTSDTIVVPYNDIEAVRNAFAEYPGEIACIIAEAAGGNMGTVAPKDNFNDKLLAIAHADGALLILDEVMTGFRTSYRGWFGVDKVAADLVTFGKVVSGGLPAAAFGGKAEIMNMLAPQGPVYQAGTLSGNPVAVAAGRASLKLADESLYTTINANADRLHGLISDALTHEGVAHHIQRASNMLSIRFAEGEGHNFSDMKAADIFRFAPFFHTLLDNGVYAPPSVFETWFVSSALTDDDFSKIEQALKPAARAAAEAKAS

SEQ ID NO: 16420 - protein, 645 aa, Arabidopsis thaliana
  misc_feature (355)..(355): Xaa can be any naturally occurring amino acid
MGKQLAKKITWAIENFSSLHSKKIYSDPFIVGGCKWRFLVYPKGNNVDYLFLYLEVADYESLSPEWRRHARYLLNVVNQNSVKRSKQNEEQKWFDVQSPRWGRLSMFPLNEINAKDSGFLVNGELKIVAEIEVLEVIGKLDVSEETSTIMESMDFNGFQLLPSQVDFVRHMFEKHPEIASEFRLKNPNLRAGYMSLLLSLIETLRQSPQELNKVDLAEGYVALRSITDAGFKVDWLEKKLVEISEKKNKEEAGETRMQEINEELESLKQKCLDLEAQLEKEKAEEKEVADMRESEEYGRDKNEEEEESHRDGKKEKEDSFKSYPFSPKTESRLPMLQRKLHQVSMGKQFDKKITXTIKNFASLLSDLIYSDHFVVGGCKWHLRAYPKGYNNANSLSLFLGVAVPTSLPSGWRRHTKFRLTLVNQLSDKLSQSKLNELEQWFDEKTTNWGLSSMCPLNEIHAKDSGFLLNGELKIVVEIKVLETIGKLDVTEETSTITETVDVNGFQLLPSQAKSVSRMFAKHPELASDLRPKNPNLRTGYMSLLLSLIETLSQLPQQMSKDDLLDAYDALGSMRDAGFKLDWLEKKLYEVSEKKENEEASETGLQEMEEELKDMKQKCLEMEALVEKEKAKVSTAKAPISFDDIV

SEQ ID NO: 16421 - protein, 137 aa, Campylobacter jejuni RM1221
MEKTLSIIKPDAVKKGVIGKILDRFESNGLRIAAMKKVQLSKEQAENFYAVHKERPFFKDLVEFMISGPVVVSVLEGEGAVLKNRDLMGATNPKEAKAGTIRADFAESIDANAVHGSDSLENAKIEIDFFFKPNEIC

SEQ ID NO: 16422 - protein, 357 aa, Brassica napus
MGEEEKKQEAPEEKKMEEKKPEEEKKEEGKKVEADEKKGEDSEKKTQEGEATKDSKEDSPPAAPEAPAPPPPPQEIVLKVYMHCEGCARKVRRCLKGFEGVEDVMTDCKAGKVVVKGEKADPLKVLARVQRKTHREVVLLSPIPPPSQPPEKKAEEEKPKVEEKKVEPPVVVTVVLKVHMHCEACATEIKKRIMRMKGVESAESDLKASQVTVKGVFEPQKLVEYVYKRTGKHAAIMKIDPPPPPPPEEAAAAAEADKKDEGKGEDKGGGESKGEEGKGEKATTAKEGEGEAAENKNGGGGGEEEGKVVDVRKIENPYYYYYNYQLPRVAVPPMEMPPQAYPPQLFSDENPNSCSIM

SEQ ID NO: 16423 - protein, 340 aa, Bacillus licheniformis ATCC 14580
MKVKVAINGFGRIGRMVFRKAMLDEQIDIAAINASYPPETLAHLIKYDTNHGRYELDVKAGEDCLFVNGKKVMLTNQRDPKLLPWAQYGIDIAVEATGKFNSKEKAEAHIEAGAKKVILTAPGKNEDITIVMGVNERDFDAERHTIISNASCTTNCLAPVAKVLDDAFGIENGLVTTVHAFTNDQKNIDNPHKDLRRARACGSSIIPTTTGAAKALSLVMPHLKGRMHGLALRVPVSNVSLVDLVADLKSDVTAEDINEAFRMAAAGSMSGIIDVCDEPLVSSDFNTNPYSAVIDSLSTMVLENRKVKVLAWYDNEWGYSCRVVDLIRYAASRMKHPSAV

SEQ ID NO: 16424 - protein, 452 aa, Roseovarius nubinhibens ISM
MAQWTDSLPEAANAYLEGRRLDEVECIVSDLPGIARGKAVPASKFARQDYFHLPDSIFYQTITGGWAEAAGDEGFIERDMLLRPDMSTATAAPWTADWTLQVIHDAFDKTGAPIPYSPRNVLKRVVQLYRDQGLEPVVAPEMEFFIVARNIDPAQEIQPMMGRSGRPAAARQSYSMTAVDEFGPVIDDIYDFAEAQGFEIDGITQEGGAGQLEINLNHGDPVALADEVFYFKRLIREAALRHGSFATFMAKPIADEPGSAMHIHQSVLDLKTGENIFSTPEGEETDAFRHFLGGMQKHLPAAIAVLAPYVNSYRRYVKDHAAPINLAWARDNRTTGLRIPISGPKARRIENRLAGMDCNPYLGIAASLACGLLGMMNKVEPAAEFHGDAYEGDEDIPRVQGEALDLFEEATDLHEVLGREFARVYAIVKRAEYDEFLQVISPWEREHLLLNV

SEQ ID NO: 16425 - protein, 465 aa, Corynebacterium efficiens YS-314
MNASPTVTDQLVQTRKFKGLRARHIHFIALGSAIGTGLFYGSAGAIQAAGPSVLLVYLLGGAVVYFMLRALGEMSVRHPVRGSFAVYTRAHLGGWAGYITGWMFAFEMLIVCLADLTAIGIYMKFWFPDTAQWVWVAATLLIVGGANLASVRWFGELEFVFTLIKVTAVIAMIVGGAAILAFGLGNSPEVSGISNLWEHGGFFPNGIEGMIAAFILVLFAFGGTEIIGVAGSEAEDPEKSIPKAVNTVPARILLFYVGAILVILALNPWQTITGEESPFVQIFSTLGVNWAAGLLNLVVITAALSAINADLFGAGRVLTGLAKENLAPKIMGRVAGNGVPIMTTVIMIIVLILGVVLNVILPERVFEIVASLATFATVYVWLMILLAQVASRRQMSAQEVAGLKFPVPFYPFGQYFAILFIAFTFGIMVWYDNYHLALGVGVGFLVVMTILYYATGRPKAIAPAQ

SEQ ID NO: 16426 - protein, 271 aa, Matthiola incana
LSFEHPYPPTKLLFSPPSLRRPSGGDLLASSGDFLRLWEVSEDSSTVEPVSVLNNSKTSEFCAPLTSFDWNDVEPKRLGTCSIDTTCTIRDIEKSVVETQLIAHDKEVHDIAWGEARVFASVSADGSVRIFDLRDKEHSTIIYESPQPDTPLLRLAWNKQDLRYMATILMDSNKVVILDIRSPTMPVAELERHQASVNAIAWAPQSCKHICSAGDDTQALIWELPTVAGPNGIDPMSVYSAGSEINQLQWSSSQPDWIGIAFANKMQLLRV

SEQ ID NO: 16427 - protein, 981 aa, Arabidopsis thaliana
MDLSLIQGMSLPLYFLLTLFFFFFATAKTRRSSSTGTLPPGPPILPLVGNIFQLGFNPHRSLAAFSKTYGPIMSLKLGRLTAVVISSPEAAKEALRTHDHVMSARTFNDALRAFDHHKHSIVWIPPSARWRFLKKTITKYLLSPQNLDAIQSLRMRKVEELVSLVNEFRERGEAIDLARASFVTSFNIISNALFSVDLATYDSNSSSYEFHNTVVHLTDIAGIPNVGDYFQYMRFLDLQGTRKKAVLCIEKLFRVFQEFIDARLAKRFSRTEKEPKEASSIDMLDSLLDLTQQNEAELTMNDLKHLLLDVFVAGTDTNSSTMEWAMTELFRSTEKMVKAQSEIRQVIGQNGFVQESDIPSLPYLQAIVKETLRLHPAAPLIPRKSESDVQIMGFLVPKNTQVVVNVWAIGRDASVWENPMKFEPERFLLRETDVKGRDFELIPFGSGRRMCPGISMALKTMHMVLASLLYSFDWKLQNGVVPGNIDMSETFGLTLHKAKSLCAVVPSPPGPPRLPIIGNIHLVGRNPHHSFADLSKTYGPIMSLKFGSLNTVVVTSPEAAREVLRTYDQILSSRTPTNSIRSINHDKVSVVWLPPSSSRWRLLRKLSATQLFSPQRIEATKTLRENKVKELVSFMSESSEREEAVDISRATFITALNIISNILFSVDLGNYDSNKSGVFQDTVIGVMEAVGNPDAANFFPFLGFLDLQGNRKTLKACSERLFKVFRGFIDAKLAEKSLRDTNSKDVRERDFVDVLLDLTEGDEAELNTNDIVHLLLDLFGAGTDTNSSTVEWAMAELLRNPETMVKAQAEIDCVIGQKGVVEESDISALPYLQAVVKETFRLHPAAPLLVPRKAESDVEVLGFMVPKDTQVFVNVWAIGRDPNVWENSSRFKPERFLGKDIDLRGRDYELTPFGAGRRICPGLPLAVKTVPLMLASLLYSFDWKLPNGVGSEDLDMDETFGLTLHKTNPLHAVPVKKRGRN

SEQ ID NO: 16428 - protein, 244 aa, Zea mays
MEAGGAGAEGVMRVLLVDDSPVDRRVAQLLLSSNSCAGSFHVIAVDSAKKAMEFLGLKDGGKEQAIDMVLTDYCMPEMTGYDLLKAIKALNPLKPIPVIVMSSEDEPQRISRCLNAGAEDFIVKPLQSKDVQRLRNCSTVGRPSNKGGATLPCEENAVAKWSNNKLPPSAGAGAGASATSPSGRRANLAGVAMRQVLHSSRVEISQYLPLLLKLVVLAYAALCLGELLHRWSSGGSCSLSPWCA

SEQ ID NO: 16429 - protein, 152 aa, Coccidioides immitis RS
MAALPFFCRAVRPASHSLRPLFASTLSPLQIRLLSTEMKAAIDKAVASAPVVLFMKGTPETPQCGYSRASIQILGLQGVDPDKFTAFNVLEDLELRQGIKEYSDWPTIPQLFIDKEFIGGCDILMSMHQNGDLAKLLEEKGVLVPRESEAAK

SEQ ID NO: 16430 - protein, 418 aa, Aspergillus nidulans FGSC A4
MSATTARSDPFKPAARVAGQRQDVWSIVNEAAAASPVQPIVNMGQGFFGYNPPQFALDAAKAALDRVDCNQYSPTKGRPRLKKALADAYSPFFGRQLNPDTEVTITTGANEGMLSAFMGFIEQGDEVIIFEPFFDQYISNIEMPGGTIRYVPLQPPKDGATKTLPASEWSINFDELERTINPKTKMIVFSRDELERIGDLAVKHNLIILSDEVYDRLYYVPFTRIATMKPEYYERTLTVGSAGKAFYATGWRVGYLIGPEHLIKYVAGAHTRICYSSVSPLQEAAAVAFEEADKQGFWDQSREEMKRKMERFCEVFDELNIPYSDPEGGYFVLANMASVKLPEGYPFPPHVASRPRDFKLCWFLIHEVGVAAIPPTEFYTDANAHIAEDYLRFAVCKEDDVLETAKERLRGLKKYIVR

SEQ ID NO: 16431 - protein, 200 aa, Arabidopsis thaliana
  misc_feature (128)..(128): Xaa can be any naturally occurring amino acid
  misc_feature (164)..(164): Xaa can be any naturally occurring amino acid
  misc_feature (178)..(178): Xaa can be any naturally occurring amino acid
  misc_feature (184)..(184): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFCVPVSTVNSPGYYDWTGTGQLWXKVPLVPGCTDSAQSVEGSGRVKKEYPNAFHRIIGFXNTPSVQCISFIAYXPPSFTXKFPFAVGKPQNFIPPS

SEQ ID NO: 16432 - protein, 270 aa, Oryza sativa (japonica cultivar-group)
CVHISPYRKEASAMGASPSRPLEQSPSSSEGENHRVKYASYTTQGFRPHMEDALAVELDLDATTSFFGVYDGHGGAEVAMYCAKRFHTMLLEDVDYINNLPNAITSVCFRLDDDLQRSNEWRESLNPCANRNCLTNICANLHHFTEDYVPPSYEGSTACVVIIRGNQIIVGNVGDSRCVLSKNGQAISLSFDHKPHHEAERERIQRAGGHVFLQRILGMLATSRAIGDFAYKQNRNMPPSQQMVTCVPDIRVENITDDTEFLVIASDGVW

SEQ ID NO: 16433 - protein, 148 aa, Zea mays
SQSASAPRARWPSRSPRPHSRISPLPRPRSSAPNPRCCCSRAGDGAGGSGGGSDPRGGGQEGDGEEEKMGQGLSMSQKLTLAYAALVGAGGVMGYMKSGSQKSLAAGGISALGLYVVHTQLPVRPVLASSIGVGISAALLSVMGSRFK

SEQ ID NO: 16434 - protein, 457 aa, Mortierella alpina
MAAAPSVRTFTRAEILNAEALNEGKKDAEAPFLMIIDNKVYDVREFVPDHPGGSVILTHVGKDGTDVFDTFHPEAAWETLANFYVGDIDESDRDIKNDDFAAEVRKLRTLFQSLGYYDSSKAYYAFKVSFNLCIWGLSTVIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQTWFYFPILSFARLSWCLQSILFVLPNGQAHKPSGARVPISLVEQLSLAMHWTWYLATMFLFIKDPVNMLVYFLVSQPVCGNLLAIVFSLNHNGMPVISKEEAVDMDFFTKQIITGRDVHPGLFANWFTGGLNYQIEHHLFPSMPRHNFSKIQPAVETLCKKYNVRYHTTGMIEGTAEVFSRLNEVSKAASKMGKAQ

SEQ ID NO: 16435 - protein, 437 aa, Rhizobium leguminosarum bv. viciae 3841
METSFGDPLPREAHPTPRAAGKHGSVLKQLGPGLITGAADDDPSGIATYSQAGAQFGFNMLWTMLLTYPLMSAIQLISARIGRVTGCGLATNIGAIWPKPLVVGLVLLLFVANTINIGANLAAMGASAELATGIPSLPVTMVFAVLSLTLQMFIRYESYARYLKWLTLVLLSYVAVLLVVEIDWVVALKGFIWPSFPLSGDSFTVIVAILGTTISPYLFFWQSSQEVEEIDRKDSAEPLKNDPRQAPKELKRIRLDTFAGMAVSNIVAIAIIMSTAATLHAHGKTEIASAADVAEALKPLAGEFAFVLFSLGIIGTGMLSIPVLAGSAAYAFGESQDWKCGLEHKPWEAYGFYGVIAAATLLGLGLEFMPIDPIKMLFWSAVINGFVAVPIMVAMMTVVSRHGRMKEFTASKTALFFGWAATVVMAMAAIAMIVLKI

SEQ ID NO: 16436 - protein, 259 aa, Oryza sativa
LHRTAPERGGVTLIRAHHHASRLTSYQVSSFLLILPNHCIRVGVLLLLLLLLAECNGAIQAIGSHGSLLKSAVLRHISAPKPSILPAVYSRSMSVSSAQIEESGFETATVADILKSKGKSADGSWLWCTTDDSVYDAVKSMTQHNVGALVVVKPGQDKSIAGIVTERDYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 16437 - protein, 642 aa, Azoarcus sp. BH72
MCGIHGFYRFDGRAVERAHLSAMGDVTRHRGPDDEGQHIEPGGRCGIAMRRLSIIDLAGGHQPISNADDTLWVVCNGEIYNFRELRQELQARGYRFKTGSDSEVLLHLYDLHGDDFVHRLDGMFNFALWDARRQRLLIGRDHLGVKPLYVHQSASLLAFATEAKALLALPGMQPALNREVLGDYLHLGYVPAPHSMFAGIRKLPPATLLSVDAQGVREWRYWRLPQTVDRTVGEAEWVERIRAGMEAAVQRQMVADVPIGAFLSGGVDSSAVVAYMARHSDQPIRTYAIGFEGGEAEQLYNELPYARQVAGLFGTEHREIVVRPDVVGLLPRLLWHMDEPVADSAFITTYLVSEFARRDVKVILSGVGGDELFGGYRRYLGGHYLDKLARLPLWSRRLMARTAGLLPSDRHSKVLNTLRLARGLLASSELAPDDRYRHYLQVLPRDDVAALTRGQPGGSDALAAAFAAAGNDDALNRMFAVDAETQLPDDLLLLTDKMSMAVSLECRVPLLDRALVELAASIPESLKVRNGRLKHLMKSALADVLPPDILDRRKRGFGTPMGAWLKQQLAPVLRRLLAADVVRDRGLFDPAVVARLVADHEAARIDGTDALLALMNLEIWSRVHLDRHSVDDVTAELKSLIA

SEQ ID NO: 16438 - protein, 287 aa, Bordetella parapertussis 12822
MTLPASPPRYAVIGNPIAHSRSPQIHAMFSAQTGRPLRYERLLAPVDGFLPTVQAFRESGGLGLNVTVPFKLEAYALAEARLSERARLAGAVNTLSWRDGAWHGCNTDGVGLVNDLLRLGVALAGARVLLVGAGGAARGVLQPLAAAGCARIHIVNRTAARAAELAAAWRAAAPRTGTQVSAGALAQAAEPGGWDVAINATASSLQDAAPDLPGGLYAPDALAYDMMYGARPTAFMRQAEADGAARCADGLGMLVGQAAESFHIWHGVRPDPGPVLLALRTELLAAG

SEQ ID NO: 16439 - protein, 644 aa, Azoarcus sp. BH72
MCGIAGLFDTRGKRDFDRGLMSRMNDIQHHRGPDEGGYHFEPGVALAHRRLSIIDLATGQQPLFNEDGSVAVVFNGEIYNFQELVPELEALGHVFHTRSDTEVIVHAWEAWGEACVHRFRGMFAFVLHDRQRETLFLARDRLGVKPLFYALLADGTLAFGSELKVLTQHPGLDRRIDPLAVEEYFALGYIAEPRTIFEGARKLGPGESLCIRRGQPVVAPTRYWDVRFTLDNPLSLGDACAELTERLRESVRLRMISEVPLGAFLSGGVDSSAVVATMAALSDAPVNTCSIGFADPRFNESEFARMVAERYRTNHHVETVESDDFDLIDTLAALYDEPYADSSAIPTYRVCQLARKHVTVALSGDGGDESLGGYRRYRLHLMEERMRSALPLGVRQPLFGLLGRLYPKADWAPRVFRAKTTFQALARDAVEAYFHSVSILRRDMRSQLFSASFRAQLGGYDAIEVFRRHAAAAGTDDPLAFIQYLDLKTYLVGDINTKVDRASMAHSLEVREPLMDHPLVEWLATLPSALKMKGGEGKYVFKRAMEPMLPHDVLYRPKMGFSVPLARWFRGPLKQRVREAVLGGTLASTGIFNRPYLEHLLDAHQSGARDYSAPLWTLMMFEAFVRNLDRAAAPVAAGADLALA

SEQ ID NO: 16440 - protein, 252 aa, Aegilops speltoides
RPKGVTPKFSLAPLVPRLSELLGIAVKKAEDVIGPEVEKLVADLENGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSAGSSLVEEDKLELATSLLAKAKAKGVSLLLPSDVIIADKFAPDANSQTVAASAIPDGWMGLDIGPDSVKTFNDALDTTQTI

SEQ ID NO: 16441 - protein, 252 aa, Aegilops speltoides
RPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSAGSSLVEEDKLELATSLLAKAKAKGVSLLLPSDVIIADKFAPDANSQTVAASAIPDGWMGLDIGPDSVKTFNDALDTTQTI

SEQ ID NO: 16442 - protein, 372 aa, Bacillus licheniformis ATCC 14580
MTATRGLEGVVATTSSVSSIIDDTLTYVGYNIDDLTEKASFEEVVYLLWHLKLPNKEELAELKKQLSENAGIPKEVIDHFKSYPNGKVHPMAALRTAVSLLGLFDEEADQMDAEANYRKAVRLQAKMPALVAAFSRIRKGLEPIEPNPELGFAANFLYMLNGKEPSPVEVEAFDKALILHADHELNASTFTARVCVATLSDVYSGITAAIGALKGPLHGGANEAVMKMLSEIGEVENVDSYIHAKLEKKEKIMGFGHRVYRQGDPRAKHLKEMSRRLTNLTGESKWYEISERTEEIVTSQKKLPPNVDFYSASVYHSLGIDHDLFTPIFAISRVSGWLAHILEQYENNRLIRPRADYTGPDMQRFIPIEERS

SEQ ID NO: 16443 - protein, 530 aa, Lactobacillus plantarum WCFS1
MSEKTNTPNRKHKLIEYANGPSLEEINGTIEVPKNLNFWKTLFAYSGPGALVAVGYMDPGNWSTSITGGQNYQYMLMSVILISSLIAMLLQYMAAKLGIVSQMDLAQAIRARTSKSLGIVLWILTELAIMATDIAEVIGAAIALYLLFNIPLVIAVFITVLDVLVLLLLTKIGFRKIEAIVVCLILVILFVFVYQVALSNPDWGGVIKGLVPTADTFSTSRSVNGMTPLSGALGIIGATVMPHNLYLHSAISQTRKIDHNDEEDVARTVKFAAWDSNIQLSFAFVVNSLLLIMGVAVFKSGAVKDPSFFGLYEALSNTSMLSNGILISVAKSGALSALFAIALLASGQNSTITGTLTGQVIMEGFVHMRMPLWLRRLVTRLISVIPVLICVLLTSGKSAIDEHTALNNLMNNSQVFLAFALPFSMLPLLMMTDSAAEMGKRFKNSLWIKGLGWLSVIGLTFLNLLGLPDSILGFFGDNPSAGEQTFSKILAYLLIAAILALLVWTVFDLQRGNKRYVEQQLAAAAKEANK

SEQ ID NO: 16444 - protein, 362 aa, Corynebacterium diphtheriae NCTC 13129
MTETTLRSDTDAVILVGGKGTRLRPLTVSTPKPMLPTAGVPFLSHLLARIKAAGITHVVLGTSFKAEVFEDYFGDGADLGLEIEYVVEDKPLGTGGGIRNVYDKLRANTVMVFNGDVLGGTDLGGILDAHHAKNADLTMHLVRVPDPRAFGCVPTDAEGRVSAFLEKTEDPPTDQINAGCYVFRRELIGEIPADRVVSVERETFPRLLEEGRRVFGYVDNAYWRDMGTPSDFVRGSSDLVRGIAPSPLLEGKTGECLVDESAGVSDGALLLGGTVIGRGTEIGAGCRLDDTVVFDGVTIEPGAVIEDSIIGHGARIGANARITGCVIGEGAEIGARCELRDGMRVWPGVVIPTAGIRFSSDA

SEQ ID NO: 16445 - protein, 239 aa, Aegilops speltoides
RPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVAASAIPDGWMGLDIGPDSV

SEQ ID NO: 16446 - protein, 191 aa, Coccidioides immitis RS
MKVFASECTFDYSWEEVSTANWRKYCPWNNKSTHVVAVDVLSRTFDPESGILRTERLITCNQSAPQWILNLFGGSSTSHVYEVSYVDPSSKKVTMCSTNLTWSNVLSVRETVIYQPSQSMPASRTDFRQDAQITALCGGWHKLKNKIEELSVETFSQNAKKGREGFEAVLEMSRRVFREQKEMEALQQVPQ

SEQ ID NO: 16447 - protein, 344 aa, Arabidopsis thaliana
MKKNKVPTELIFSLPNDLLVNILARVSRLDYPILSLVSKRFSSVLTLPELYQTRSLVGLTENCLYVCLLSSRADRIPSWFKLCRRPILASDTRKSSGYVLATIPIPHSPPLHRSSLVAVGSNIYNIGGSISQSQSSSVSILDCWSHTWLEGPSMQVEREYPSASLLDGKIYVTGGCRLTFHGCGDQTDNVVVDGKLHSCGGYKGVAYNPNDGRWDSLGSEMNLGLKWSSSCVIENVIYYYYHNENIKWYDTKVRSWRTLNGLKTLPRFARYANVRLADYGGKMALFWDKFTGCGNQNRMIWCAIIALERRNNEEIWGNVEWSDAVLPHQVPMAYVCEYVVAVNV

SEQ ID NO: 16448 - protein, 173 aa, Brassica napus
MANQGAKKRKDENARHMAKLRRIIIACNVVYVIVRMVVFYSSFTWRHWIGLVVTSLGYAVPYKFLDGMAKPSVSDDGELIDGGFDMSRGGICGYLHDVLYITCFVQLASIISGKFWYAYLVIPAFGSYKASGLIKGFMSQGSEGGVEDEKTRKKREKMERKASRGQAVRTRTR

SEQ ID NO: 16449 - protein, 288 aa, Xanthomonas campestris pv. vesicatoria str. 85-10
MPVPNYPRPPFKPQQQSFPGRTEKMDPRPDHGEDSYVGHGQLKGKRALITGGDSGIGAAVAIAYAREGADVAIAFLPDEQEDAARIGALIEKAGVKALLVGCDISDPGQAAALIDKVNSTLGGLDILVNNAGYQKYFETFEDITLDEWRKTFDTNVHAAFNLVRLSVPLMTDGGSIINTASVQSKKPTPNILPYAATKGALANLTIGLAGVLAEKKIRVNAVLPGPIWTPFIPSGMDEESVENFGGQTPMGRPGQPVELASAYVMLAADTASYTSGTLLTISGGAVTL

SEQ ID NO: 16450 - protein, 245 aa, Picea glauca
MAEQAPEHQDRGMFGLFGKKKEEEGRQDDQISQTPATHTHNEAQTEAASYYPTSPHEVKHGPGHGHEGQLTPEEAEQQKHKGLVGKLHRTHSSSSSSSSDEEEEGGKKKEVGRKKKGAKDKTKEKLPSGGHHSSDHCGGEEKKKAGMVDKIKEKLPGHQEKLPAGGEHSSDQCGTKEEKKTGLLDKIKDKLPGHQEKLPGGGQHSSDQYGGKQEKKMGLLDKIKEKLPGHENKNDGEEEEKKHPH

SEQ ID NO: 16451 - protein, 155 aa, Picea glauca
MASADVEFRCFVGGLAWSTDDRSLQEAFSPYGEVVESKIISDRETGRSRGFGFVTFNDEQSMRDAIDAMNGKMLDGRSITVNPAQSRGNGGGGGGGGSRGYRGGGGGGGYGGSRDRGDRGYGGGGGGYGGGGGGYGGGGGSRYGGGGSEGGSWRR

SEQ ID NO: 16452 - protein, 346 aa, Coprinopsis cinerea okayama7#130
MASSFLFRRVAQQTARTGRVQWAPRFYSTGKPNPYGSSSSSSSFAATLAIVGAAGTGVVAYNLLSNDSLKTVYADSAASFSSSWPWGATNDNNNLDDGTAKFTYHVSKTVTKSVTTTDLDGTSTTTTASATASKSMERDVPATFAMNWWGWWPFGGGGDATAKTDGATETAPAPAPRDLSRANVYFNIAINNEPKGRIVFKLFDDLVPKTAKNFRELATGEHGFGYAGSGFHRIIPNFMIQGGDFTNHNGTGGKSIYGPRFPDENFALKHSKPGLLSMANAGPNTNGSQFFITTVVTPWLDGRHTVFGEVVEGMELVKEIESVGSGSGRPSKKVTISECGVLDQVD

SEQ ID NO: 16453 - protein, 345 aa, Cryptococcus neoformans var. neoformans B-3501A
MVNLADLSNSLASQDFTSIPVIDLSDAQSPSLQKRKAVAAEIRNACLNAGFFYVKNHGVPLQVVDRTFEQSKEFFNQPDGLKKSVDISKSGGNFRGYMGLLSENNDPKNKGDMHEAFNMGLDPSVDASAFIQDVKEGELRHSENLWPDKKDWQGADVFKQANLDYYKEVLGLGQSLFPLFALALDLPEDFFSDKIEHPAAIMRILFYPALGERQVDELMPGIGAHTDFECFTILRQDDVPSALQVQNRKGQWVDAPYMPDTFVINIGDQFARWTNDIFVSTRHRVLPALSKDRYSIPFFFGCDHDVPLIPPDTCVTADRPAKYETMTAGAYVHMRLSDIYKVKET

SEQ ID NO: 16454 - protein, 120 aa, Triticum aestivum
MEPGLASRVARSAAQPLSGCLSRHSLSPWLKIQNHIYPMPSLCHKVPSTAKCHTSMTTSYMETSDVTDLDWENLGFGLIETDFMYVAKCGTDGIFSKGEVLPFGPIALSPSAGVLNYGQG

SEQ ID NO: 16455 - protein, 633 aa, uncultured candidate division OP8 bacterium
MPAPKPLSMNLSPKSLDKRIGSETEPTIMNIRNIAIIAHVDHGKTTLVDVLLKQSGTFRENEKVSERAMDSGELEQERGITITAKPTSVEWKGTRINIVDTPGHADFGGEVERILSMVDGVLLLVDAAEGAMPQTKFVTGKALKLGLKPIVVVNKVDKPEQRAYEVQDEIFDLFSALDATADQLDFPTIFASAKNGWASAEPEGEKLNMDIIFDTILSYVPAPKVIMDQPFSMLATTLESDSFLGRILTGRVHSGTVKPGMSIKALNRKGEVIEQGRVSKLLAFRGLDRVPAESVSSGDLVAIAGLTKATVADTICDMAVTKALESQPVDPPTLSMLFAVNDSPLAGTEGTKVTSRMIRDRLYAEAEGNVALRITESENNDAFDVAGRGELQLGVLIEQMRREGFELSVSRPRVVMKEIDGKKMEPLEEVTVDVDEEYSGIVVEAISLRKGQMKEMRQAGAGKTRMVFHVPARGMIGYLGEFLTETRGTGIMARMFHSYVPFTGVLPGRRNGVLVSNCGGATVPYALFNLEGRGPLFLGAQVKVYEGMIIGEHSRPGDLEVNPLKGKQLTNVRASGTDEAVRLTTPRRLSLEQMIAYIQDDEQVEVTPQNIRMRKRYLDPNVRKRESRASEKS

SEQ ID NO: 16456 - protein, 362 aa, Mycobacterium tuberculosis CDC1551
MSASLPVFPWDTLADAKALAGAHPDGIVDLSVGTPVDPVAPLIQEALAAASAAPDYPATAGTARLRESVVAALARRYGITRLTEAAVLPVIGTKELIAWLPTLLGLGGADLVVVPELAYPTYDVGARLAGTRVLRADALTQLGPQSPALLYLNSPSNPTGRVLGVDHLRKVVEWARGRGVLVVSDECYLGLGWDAEPVSVLHPSVCDGDHTGLLAVHSLSKSSSLAGYRAGFVVGDLEIVAELLAVRKHAGMMVPAPVQAAMVAALDDDAHERQQRERYAQRRAALLPALGSAGFAVDYSDAGLYLWATRGEPCRDSAAWLAQRGILVAPGDFYGPGGAQHVRVALTATDERVAAAVGRLTC

SEQ ID NO: 16457 - protein, 600 aa, Cryptococcus neoformans var. neoformans B-3501A
MSCPSPGSSPSTSATVPLAVHRQNDYQTASPISLPPSLSPSASPVAIFRRAIVLHDHSDVEKNFPGESNTQENVGPIMSSVPFAASPLIAATTFSLAPNLEQQRGKRKRRRSGSDSDYSPPYSLRGGGRPQKSKTRRNANNGSHSSQCQNVRSSRRTTRSKARRANSPSSLIITSLEDIKLEDAAVKSEISRLGLTLRDVQGDGNCLFRCLSDQLYGTEKRHAEIRKIVCDYLDSHKETMEGFVVPFMKEGERYEGYVQRMRQSKQFGSHIEIQAAARIFQRDIRVVMSTASFTIPWRAESSCFFGDRKYDAKLDLPEGLAITLRDGIPPIQEGRTMLWLALFSQAEHFQSIRRQGDKDNGSANIDDHLAVPHAKDTSEAARRERGEIVGNKVESRSPISSHVAQLLASLPPGHGISSTYAEGVLSRVKGDLGEAIEILLEDIQSEADKESESSSDQRVEELLHELAPSNTACPSDSSAIEHCSLSSEGVSYRPRSPALSSTTGTRSRSESVSERSSNGSVTSDLAQSQSSRSTTVSSGQDAPRVTPEIISDSKLRTKSDKLGKDLQGMVLRSRESSREPKRSHDEPQKRRASLRLKNRL

SEQ ID NO: 16458 - protein, 208 aa, Oryza sativa (japonica cultivar-group)
MASYHQQQGGSTFMAIPTINFQMYSEIAGDDEWWEYIPCPFCYIEVEVHFLCDHLQEEHCFDMKNAVCPICADNLDKDTDEHFRVQHSHLLKRRKSSSFSCKPSSAAADKGSYEEDSYFEAPSHCMGRPAPDSSPDPLLSQFICCSLAPPVDSPRRSEADAEGHGSSSSDDQKRREQGVMDDASKEELEERLQRIEFVKQMLMTTIAY

SEQ ID NO: 16459 - protein, 292 aa, Idiomarina baltica OS145
MLTGSIVALVTPLTKHGNIDYNELEELVNFHVESGTDAIVAVGTTGESTTLSHEEHIDVVAAMVELANGRIKVIGGNGSNSTAEAVQLTEKMSHFGVDGFLNVTPYYNKPSVEGLIAHYSACADASDKPQILYNVPGRTALDMPPEVVEQLAEIDNVIGIKEATGDVSRVEELKRRCGNQFILLSGDDPTACEFMLRGGHGVISVTANVVPSRIKALVDAATRGEREKAEQIDSELRELNNALFVESNPIPVKWALALMGKCSANYRLPLTPPSEDSQLVIERALNQLHLLK

SEQ ID NO: 16460 - protein, 427 aa, Bordetella parapertussis 12822
MSTNAELFDRACRSIPGGVNSPVRAFRSVGGTPRFIQRAQGPYVWDAEGKQYIDYVGSWGPAILGHAHPEVVRAVQEAAVHGLSFGAPTEAEVELAEMLIARLPSLEQVRLVSSGTEATMTAIRLARGATGRHKIIKFEGCYHGHSDSLLVKAGSGLLTFGNPSSAGVPPEFVAHTLPLEFNNLAAVDAAFSQHGAEIACVIVEPVAGNMNLIKPAEGFLAGLRELCTRHGAVLIFDEVMTGFRVGPQGVQGLTGVRPDLTTLAKVIGGGMPVGAFGGRADLMAHITPLGGVYQAGTLSGNPVAVAAGLATMRLIGEPGFYERLSAQTARLAQGLQERARAAGVPFSADAIGGMFGLYFGDRVPASFAEVSACDTEAFKRFFHAMLERGIHFAPSAFEAGFVSATHDDAVIDATLEAAEQVFATLRA

SEQ ID NO: 16461 - protein, 345 aa, Candida glabrata CBS 138
MPVATERRASMDDFDTDIITLPRFIVENQKTVKTARGDFSLVLNALGFAFKFISQTIRRAELVNLIGLAGASNSTGDEQKKLDVLGDEIFINAMKGCGFIKLLVSEEQEDLIVFPTETGTYAICCDPIDGSSNLDAGVSVGTIVSIFKLLPGSTGSIKDVLRSGHDMVAACYAMYGASTHLMLTMGNGVDGFTLDTNLGEFILTQPNLRIPQLRPIYSVNEGNRLYWDELIVSFIDSLKEGQESNKGKPYSLRYIGAMVADVHRTFLYGGLFSYPGDRLKPDGKLRLLYEAFPMAFLVEQAGGKAVNDQGERILDLVPKHIHDKSSIWLGSSGEIDKFLKHIGKE

SEQ ID NO: 16462 - protein, 290 aa, Prosthecochloris aestuarii DSM 271
MCSITSILGLIGRNVNYSYSPFIHNTAAEMLRLPFYYTIFNIADARQIPDALNGMRALGIAGLNVTIPYKQVVTEYVDTLSAEAQAVGAVNTIVNNNGRLSGCNTDIAGVSHPLKPYKERLHQSPAGIFGNGGAALAAVEALRRDYHPSAIRLFVRDPDKGLALAEQVHAKHPEAPIEIFKIDAYDAIRDCHLLINATPIGTKGVQTAGNSALLPQEQKLLHDGQIIFDMVYNPLRTPFVNMAAEAGAVVIPGVEMLIAQAAESFCLWTGETMPVDSIREKILKKLTAQP

SEQ ID NO: 16463 - protein, 322 aa, Bacillus licheniformis ATCC 14580
MKKMKRIGVLTSGGDSPGMNAAVRAVVRKAIYHDVEVYGIYNGYSGLISGKIEKLEIGSVGDIIHRGGTKLYTARCPEFKTVEGREKGIANLKKYGIEGLVVIGGDGSYMGAKKLTEHGFPCVGVPGTIDNDIPGTDLTIGFDTALNTVIDAIDKIRDTATSHERTYVIEVMGRHAGDIALWSGLAGGAESILIPEADYDMEEIIARLKRGHERGKKHSIIIVAEGVGSGVEFGKRIEEATNLETRVSVLGHIQRGGSPTAADRVLASRLGAFAVELLLEGKGGRCVGIQNNQLVHHDIIEILEQKHTIDQSMYRLSQELSI

SEQ ID NO: 16464 - protein, 907 aa, Mycobacterium leprae
MASYLPDIDPEETAEWLESFDELLKHSGPSRARYLILRLLERAGEQRVTIPALTWTDYVNTIPTELEPWFPGDEDIERRYRTWIRWNAAIMVHRAQRPGVGVGGHISTYASSAALYEVGFNHFFRGKSHPSGGDQVFIQGHASPGIYARAFLEGRLSADQLDGFRQEHSHPGGGLPSYPHPRLMPDFWEFPTVSMGLGPLNAIYQARFNRYLHDRGIKDTSDQHVWCFLGDGEMDEPESRGLAHVASLEDLDNLIFVINCNLQRLDGPVRGNGKIIQELESFFRGAGWNVIKVVWGREWDALLHADRDGALVDLMNATPDGDYQTYKANDGRFVRDHFFGRDPRTKALVEHMSDQEIWNLKRGGHDYRKVYASYRAAVDHKGQPTVILAKTIKGYALGKHFESRNATHQMKKLTLEDLKEFRDTQRIPISDTELEENPYLPPYYHPGPDSPEIRYLLDRRRALGGFLPERRTKSGALTLPGRDTYAALKTGSGQQEVATTMAIVRTFKEVLRHKEVGPRIVPIIPDEARTFGMDSWFPSLKIYNHNGQLYTAVDAQLMLAYKESEVGQILHEGIDEAGSVGSFIAAGTSYSTHNEPMIPIYIFYSMFGFQRTGDGLWAAADQMARGFLLGATAGRTTLTGEGLQHADGHSLLLAATNPAVVTYDPAFAYEIAYIVESGLTRMFGEDPENVFFYITVYNEPYPQPPEPENFDPDGVLRGMYRYYTAKEQRSNKAHILASGVSMPAALTAAEMLSTQWDVAADVWSVTSWGELNRDGMSIETARLRYPDQPTSVPYVTQVLSEARSDNAGPVIAVSDWMRAVPEQIRPWVPGTYVTLGTDGFGFSDTRTATRRYFNTDAESQVVAVLEALARDGEIDPSVPVAATRQYQIDDVQAAPEQTSDPGPGVQN

SEQ ID NO: 16465 - protein, 476 aa, Arabidopsis thaliana
MSYNTGKESSPVSPLKKRRASWSELWVNHHHLLSSSPLDLAAKFQSLTPPISKSKTLLPDFTLLLPDLILIRVIQKIPNSQRKNLSLVCKRWFRLHGRLVRSFKVSDWEFLSSGRLISRFPNLETVDLVSGCLISPPNLGILVNHRIVSFTVGVGSYQSWSFFEENLLSVELVERGLKALAGGCSNLRKLVVTNTSELGLLNVAEECSRLQELELHKCSDSVLLGIGAFENLQILRLVGNVDGLYNSLVSDIGLMILAQGCKRLVKLELVGCEGGFDGIKEIGECCQMLEELTVCDNKMESGWLGGLRYCENLKTLKLVSCKKIDNDPDESLSCCCPALERLQLEKCQLRDKNTVKALFKMCEAAREIVFQDCWGLDNDIFSLAMAFGRVKLLYLEGCSLLTTSGLESVILHWHELEHLKVVSCKNIKDSEVSPSLSALFSALVELQWRPDTRSHLSSSLTGTGIGEKGGKFFKKT

SEQ ID NO: 16466 - protein, 406 aa, Bacillus licheniformis ATCC 14580
MSLKEKALHMHKVNQGKLESKSKVQVRNADDLSLAYSPGVAEPCKAIYDDNSKVYDYTMKGNMVAVVSDGTAVLGLGNIGPEAALPVMEGKAVLFKSFAGVDAFPICLNTSDVDKIVETVKLLEPTFGGVNLEDIAAPNCFVIEERLKKETKIPVFHDDQHGTAIVTVAGLVNALKLSGKTMSSVKVVANGAGAAGIAIIKLLYHFGVRDIIMCDTKGAIYEGRPNGMNAVKEEVAKYTNKNRIDGSLKDVIKDADVFIGVSVEGALTKEMVESMADKPIIFAMANPNPEIMPAEAHEAGASVVGTGRSDFPNQVNNVLAFPGIFRGALDVRATHINEEMKIAAVDAIASLVSDEELRPEYVIPAPFDPRVAPAVAKAVAKAAMETGVHESMSIQKKSLKKQESLQ

SEQ ID NO: 16467 - protein, 387 aa, Xanthomonas campestris pv. vesicatoria str. 85-10
MLALNYHGSRDVRVETVPDPLLVERDDLILRVTATAICGSDLHLYRGKIPDLRPGDILGHEFMGIVEEVGPDVTAVKPGDRVVIPFVVACGRCFHCVLQEFSACETTNTGKGAALNHKDMRPPAALFGFSHLYGGLSGGQAEYVRVPKANVGPLVVPDALHDEQVLFLSDILPTGYQAVVDAGVKQGSTVAIFGAGPVGLMAAACCRMLGAERIFMVDRHAYRLDFASRAYGVIPINFDEVDDPADVIVSQTDGRGVDASIEAVGFEAEGSAIETALTNLKLEGSSGVAIRQCIAATRRCGVVSVPGVYAGFIHAFMFGDAFDKGLTFKMGQTHVQKHMPHLLECIGNGQLKPSSIISHRMPLADAARGYELFDKKQDDCRKVVLTP

SEQ ID NO: 16468 - protein, 459 aa, Corynebacterium efficiens YS-314
MTAETETGIPGVPGTQAADQFNELPAHVWPRNAVRQEDGVVTVAGVPLPDLAEEYGTPLFVVDEDDFRARCRDMASAFGGPDRVHYASKAFLSKTVARWVDEEGLSLDIASENELGIALAADFPGERITAHGNNKDASFLRACVRNNLGHVVLDSAQELELLDYIAAGEGKVQPVLIRVKPGIEAHTHEFIATSHEDQKFGFSLASGAAFDAARAAVNAENLELVGLHCHVGSQVFDAQGFSLAAERVLELYSRIHDELGVTLAELDLGGGYGIAYTAAEEPLNVVEVAHDLLTAVGKTAAELGIEAPTVLVEPGRAIAGPSTVTVYEVGTIKDVDVDDETTRRYISVDGGMSDNIRPALYGAEYDARVVSRFTEGETTNTRVVGSHCESGDILINEATYPSDIHTGDLLALAATGAYCYAMSSRYNAFARPAVVSVRAGAAKLMLRRETLDDILSLEV

SEQ ID NO: 16469 - protein, 653 aa, Rhodospirillum rubrum ATCC 11170
MTAIAGLWQDDGVVHTAERVPRMGAALAAYGPARAGISDIAAAGLALTCRQSHITDTDMIDRQPLWDGDRRICVVADARIDNAAELALGFGWAVGEGERCSDAALILAAYRRWGPDCVGRLTGDFAFALWDDQEQRLLLARDHYGGRPLFFAHRPGLFAFASMPKGLFALGEFSNALDATELGAYVALLPQEGTRTLYRDLSRVPPGHYLLVQGERRRLVQYWPGQFREPARSGDYREHVEEFGRLYTQAVRACLRVRPGGGIGSHLSAGFDSASVTALAARELSAQAKGLTAFTGAPRDGFTGPYPSARVIDESGVAGEVARRFSNIEHRIIHAGPDGPLRDLERTLPYLETPFLNICNLGWARVIEETAARSGIKVLLIGAMGNLTASFEGQIHLARLFRQGRWWQLAILARGLTREGAGWRTVASAALGPYLPDWVRRLRHRNSPGVFAHTALSPAFAASMDMDGLAAARGSFPPRFSDSRTARLFMIRLADPGVYHHASLAEHGIDIRDPTADRRLLDFCLTIPEGFFIRDGRRASLFRDAMAGLLPDTMLNRRIRGVQAADWYEKMVASRDAMAAELERLRSSPMASRVLDLDRLCRLVADLPDPATPPEQIPAERFTSPDGAMAYRLALLRGLSMGRFIRMVEGGNG

SEQ ID NO: 16470 - protein, 442 aa, Mycobacterium smegmatis str. MC2 155
MSTSTVPPDGGEKVVVVGGNDWHEVVAAARAGAAAQAGERIVVNMGPQHPSTHGVLRLILEIEGEIITEARCGIGYLHTGIEKNLEYRNWTQGVTFVTRMDYLSPFFNETAYCLGVEKLLGITDDIPERASVIRVMLMELNRISSHLVALATGGMELGAMSAMFYGFREREEILRVFESITGLRMNHAYIRPGGLAADLPDDAITQVRRLVEILPKRLKDLEDLLNENYIWKARTVGVGYLDLTGCMALGITGPILRSTGLPHDLRKAQPYCGYENYEFDVITDDRCDSYGRYIIRVKEMHESVKIVEQCLARLKPGPVMISDKKLAWPADLKLGPDGLGNSPEHIAKIMGRSMEGLIHHFKLVTEGIRVPPGQVYVAVESPRGELGVHMVSDGGTRPYRVHYRDPSFTNLQAVAATCEGGMVADAIAAVASIDPVMGGVDR

SEQ ID NO: 16471 - protein, 1054 aa, Legionella pneumophila subsp. pneumophila str. Philadelphia 1
MENIMLEKQSIHLPEGLRAAINKAYRMDELSLITELSEQAALDPQQMMAIKTSATKLVQSVRSERKKSTGIDSFLTEYALSSDEGIALMCLAEALLRVPDNATIDNLIKDKLAGGDWGAHRGQSESFFVNATTWALMLTGKVLTPEKAENTLTKALLKLVNRSSEAVVRKAVDKAMRIMSKQFVMGRTINEALARAKKKEDRGYRYSYDMLGEAALTSADAARYFEAYKEAIISIGEKADKHSDVYRRPGISIKLSALHPRYSEFQYERVMAELPPKLLALSRLAKDYGIALTIDAEESERLDLSLDVIEKVFTDESLQGWNGFGLAVQSYQKRAFYVLDWVAALARSKQRRIMVRLIKGAYWDSEIKKTQMQGFSEYPVFTRKVFTDVSFQACAKKILTMTDAIYPQFATHNAYSVAMILNLVGGYRDFEFQCLHGMGNELYEQIVPANCYGIPCRIYAPVGSHEDLLPYLVRRLLENGANSSFVNRIVDDKAPISELVEDPVAKSRSLLDKINKNIPLPEDIFLPVRKNSKGFDFTNRLERALLQQELAKIESKEWQASPMIAGRKLSRDLLQTVMSPQQPAYAIGSVQQATLDDVEVALNQAKLAFELWSKKPVEERASCLNRFADLLQANMAELMVLTCREAGKTWSDGIAEVREAIDFCRYYAKKAQELMSSPQRFNGYTGELNELSLHPRGTILCISPWNFPLAIFTGQVVAGLVTGNCVIAKPAEQTPLIAAYAVKLMHQAGIPEGVIQLIPGAGETIGAALVADKRIKAVLFTGSTDTANLINRTLATRGGEIIPLIAETGGQNAMIVDSSALLEQVVVDAVTSAFGSAGQRCSALRVLYVQEEVYPRTVELLKGAMAELVVGDPQWLSTDVGPVIDKEALSILKNHVENMRKHHEILYQCTVDDEALSGYFMPPTAIAIDSISALEKEVFGPILHVIQFKRKDLDKVINQINQTSYGLTLGIHSRINETVDYIRQRVHAGNCYVNRNMIGAVVGLQPFGGEGLSGTGPKAGGPNYLIRLCHERTYTVDTTAAGGNASLMSIPEEG

SEQ ID NO: 16472 - protein, 274 aa, Synechococcus sp. RS9917
MSIRPLLALVLALCLTLVTACSGGAQAVDRSSATRYEDIVNTGKANDCPTLSDAARGSIALDIGGSYELRDVCMHPLQVSVKGEPANKRQEAQFVEGKILTRYTSSLDEVYGDLEVSEEGLSFSEKGGIDFQPITVLIPGGEEYPFTFSSKNLQAKASGAAITTSTDFEGTYRTPSYRTSNFIDPKGRALTTGVDYPQGLIGLGGDYEELQTENVKRYIDGTGVMSLSITKVDPETGEFAGVFTAIQPSDSDMGGREIVDVKITGELYGRLEEA

SEQ ID NO: 16473 - protein, 238 aa, Euptelea pleiosperma
MGRGRVQLKRIENKINRQVTFSKRRSGLLKKAHEISVLCDAEVALIVFSTKGKLFEYSTDSGMDMILDRYERYSSAERELVAHDPESQGSWSLEYAKLKAKLEVLQRNQRHFMGENVDSLSSKELQNLEQQLDSALKHIRTRKNHLMYESIAELQRKEKTLQEQNNQLEKKLKEKELTQQAHWEHQSSTSFLLSQTLPTLNIGGTYQVRGSGSEEEVAQPHARTNTLMPPWMLRHVNE

SEQ ID NO: 16474 - protein, 244 aa, Euptelea pleiosperma
MGRGRVQLKRIENKISRQVTFSKRRSGLLKKAHEISVLCEADVAVIVFSTKGKLFEYSTNSGMEGILERYERYYYAEQEVVATDPESLGNWSMEYAKLKAKVDVLQRTQRHFMGEDLDSLSLKELQHLEQQLDTAMKQIRSRKNQLMYESVVELQRKDKVLQEQNSMLEKKIKEMEKSIAQQRHWEQQNQGQNSPSFLLSQTLPSLTIGGTYQARCTGGEEEEARTQSRFNTHMPPWMLRHLNP

SEQ ID NO: 16475 - protein, 383 aa, Oryza sativa (japonica cultivar-group)
MRSPRSRALERDAGGVAVEHVELIPGMPDDVAVDCLARVPHGAHRAMRRVCRGWRSAAATPAFAMARAEAGANEDLVYLLQFANPAAAAAAAEEAKEDGDAPANSPAYGVAVYNVTTGEWRREKAAPPVPMFAQCAAVGTRLAVLGGWDPETFEPVADVHVLDASTGVWRSAPPMRSARSFFACAEAGGRIYVAGGHDKHKNALKTAEAYDAVADAWDPLPDMSEERDECDGMATVAGDRFLAVSGYRTARQGGFERDAEWFDPAARAWRRLDRVRAPPSAAHVVVRGRVWCIEGAAVMEWLGSRGGWREVGPSPPGLKAGTARAVCVGGGERVVVTGAIEDSDGGSGRHALWVFDVKTKNWTVVRPPPEFAGFAFSVAAVRI

SEQ ID NO: 16476 - protein, 299 aa, Arabidopsis thaliana
MDLNNKIFNILLPIVTVSFLLVFMPFSIFFKLLQFIRGCKESEKVNGKVVIITGSSSGIGEHLAYEYARRGAYLTLVARREDRLQVVADRCRKLGSPDVAVVRGDVSVIKDCKRFVQETISRFGRLDHLVNNAGIAEAKFFEDYSEISDVLPIVNTNFWGPVYATHFAIPHLKKTKGKIIAVASPAGWSGVPRMSIYAASKAAMINFYETLRIELHPEVGVTIVFPGLIENGNTNPDLLAEKQDWSQVVTIESAAECAKAVVNGICRGKTFVAEPSWVRVLFWLSAICPELLISKPKRN

SEQ ID NO: 16477 - protein, 95 aa, Halobacterium sp. NRC-1
MSDPLRELFDVIEDRKETMPENSYTASLLADDEKGENAALEKVGEEATEFLLAAKDGDTDELAHEGADVVYHMLVVLAQQDMDVEALLAELDDRR

SEQ ID NO: 16478 - protein, 497 aa, Candida glabrata CBS 138
MAYKTAATKTIKLPNGLTYEQPTGLFINNEFVESSDGKTMTIENPSTQEPIVDVFSATKEDVDYAVDCAERAFEKSDWATQDPKVRARYLSKLADLMEEQLELIASIETLDNGKTIALSRGDVQLSINCIRDAASYADKVDGRSIDTGDGYMNYTIREPIGVCAQIIPWNFPLMMLSWKVGPALAMGNCIVLKPASATPLNALYFSSLCKQVGIPAGVVNIIPGPGGMVGTALTTHPKVRKVAFTGSTDIGKDIAVKASASNLKKITLELGGKSAHLVFNDANLEKTLPNLVNGIFKNAGQICSSGSRIYAQAGIYDRLLKEFKAYIEKNIKVGNPFDESNFQGAITNKEQYNTILKYINIGKEEGAKVLTGGETAAEKGYFIKPTVFYDVKEDMRVVKEEIFGPCVTISKFEEIEDGVAMANDSEFGLGAGIETENLSTALKVAKMLHSGTVWINTYNDFDSRVPFGGYKQSGYGREMGSEVYECYTQTKAVRIKL

SEQ ID NO: 16479 - protein, 176 aa, Zea mays
  misc_feature (159)..(159): Xaa can be any naturally occurring amino acid
MAAAAAMMVSGGRAALAVAGVLCAVAAMAAAQQASNVRATYHLYNPAQNGWDLNRVSAYCATWDADKPLSWRQKHGWTAFCGPAGQKGQAACGKCIRVCGSATFTFPPAGLSQAIVGLLQVKNRATGASIVARIVDQCSNGGLDLDYETVFKKIDTNGXQGYQMGHLNVDYQFVAC

SEQ ID NO: 16480 - protein, 310 aa, Vibrio fischeri ES114
MASSIDIAKQVIQTEIEGLDYMAKRLGSEFEVAINAIINTKGRTIICGMGKSGIIGKKIAASFASTGTPSFFMHPGEAFHGDLGMVKPEDVFIAISNSGETDEVLKLLPFLRDNGNFVIAITGKENSTLATNSHCHLDISVPKEACPLQLAPTSSTTATLVMGDALTVALMDVREFQPENFARFHPGGSLGRRLLSKVQDEMFSDNIPSVASDADFTSIIHKISSSHLGLTLVNLKDDSLAIITDGDLRRAMESKGRDAFDLVAKDIASINPASISPESNIQKAYEIMESKGITSLIVVESNSVVGILKK

SEQ ID NO: 16481 - protein, 712 aa, Agrobacterium tumefaciens str. C58
MTVIPIVILCGVLSVVYAVWTTKSVLDADQGNERMREIAGYIREGAQAYLTRQYLTIAIVGLIVAVLAWYLLSAIAAIGFVIGAVLSGVAGFVGMHVSVRANLRTAQAASHSLGAGLDIAFKSGAITGMLVAGLALLGVSIYYFVLTSVLGHPPGSRAVIDALVSLGFGASLISIFARLGGGIFTKGADVGGDLVGKVEAGIPEDDPRNPATIADNVGDNVGDCAGMAADLFETYAVSVVATMVLAAIFFAGTPILESAMVYPLAICGACILTSIAGTFFVKLGTNNSIMGALYKGLIATGVFSVAGLAVATYATVGWGTIGTVAGMEITGTNLFFCGLVGLVVTALIVVITEYYTGTNKRPVNSIAQASVTGHGTNVIQGLAVSLESTALPAIVIVGGIIGTYQLGGLFGTGIAVTAMLGLAGMIVALDAFGPVTDNAGGIAEMAGLDPDVRKATDALDAVGNTTKAVTKGYAIGSAGLGALVLFAAYANDLSYFAANGDTYPYFKDIGEISFSLANPYVVAGLLFGGLIPYLFGGIAMTAVGKAASAIVEEVRRQFREKPGIMAGTEKPDYGRAVDLLTKAAIREMVIPSLLPVLAPLVVYFGVLLISGSKASAFAALGASLLGVIINGLFVAISMTSGGGAWDNAKKSFEDGFIDKDGVRHVKGSEAHKASVTGDTVGDPYKDTAGPAVNPAIKITNIVALLLLAVLAH

SEQ ID NO: 16482 - protein, 503 aa, Synechococcus sp. RS9917
MAGEHFFLELEPPEERLRHAPHVVIVGGGFAGVRACKALANAEVRITLIDKRNFNLFQPLLYQVATGLVSRGDVATPLRQLVGKQRNVQVLLGEVTQIHPAGKQIVFNGKAYSYDHLVLATGSGSTFFGHEDWRTFAPPMKILEHAEEIRRRLLMALEQAEQTPDPQVRQFLQTVVIVGGGPTGCEMAGAVSELMRNAMRREFRQLNPDTTRIVLVDPGDRVLRAMPEMLSESARKTLEGLGVEMLFKGRVQTMRPGEVTVGTPEGDRRLQAATVIWTAGVRPSHLGRKLAEEIDCDLDRGGRVVVEPDFSVKGHPEIRVVGDLCCYTHTKDGKPLPGMAGPATQAGGFVGKDIAAIVAGSNRPNFSWFDFGSMAVLDRVSAVADLRGFKFSGGIGWLLWAVAHLAFMPNTENRISLLIKWLFAVVSQERASMLLTGMPSQHMGLDAPDAPFPMKSGSGPSIASPDAALKAAIDYYSNHVSGLGDQAGEPSADSAEDSTAAIK

SEQ ID NO: 16483 - protein, 309 aa, Pinus banksiana
DGATDRTYCFSEVELISRKVAAGLAKLGLQQGQVVMLLLPNCIEFAFVFMGASVRGAIVTTANPFYKPGEIAKQAKAAGARIIITLAAYVEKLADLQSHDVLVITIDEAPKEGCHHISVLTEADETQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQGYGMTEAGPVLAMNLAFAKNPFP

SEQ ID NO: 16484 - protein, 645 aa, Oryza sativa (japonica cultivar-group)
MVRSGSVRRTAASSSPAAAAVPTAFTASPGDYRLLEEVGYGANAVVYRAVFLPSNRTVAVKCLDLDRVNSNLDDIRKEAQTMSLIDHPNVIRAYCSFVVDHNLWVIMPFMSEGSCLHLMKVAYPDGFEEPVIASILKETLKALEYLHRQGHIHRDVKRNIIQAGNILMDSPGIVKLGDFGVSACMFDRGDRQRSRNTFVGTPCWMAPEVLQPGAGYNFKKYVSNHLFTNLIWLFKISLRGKNSNYHKNTGNKVLLMTLQNAPPGLDYDRDKRFSKSFKEMVAMCLVKDQTKRPTAEKLLKHSFFKNAKPPELTVKSILTDLPPLWDRVKALQLKDAAQLALKKMPSSEQEALSMIHDDDPPEIKEDVDNDRINEADKEPFSGNHFGQPKILSGKHFRLNHEQTCVTAVSPGGNMHETSRGLVSEPGDADSERKVDGYRKQGEAAVKLASDKQKSCTKRTTNLSGPLALPTRASANSLSAPIRSSGGYVGSLGDKSKRSVVEIKGRFSVTSENVDLAKVQEVPTSGISRKLQEGSSLRKSASVGHWPVDAKPMDLITNLLSSLQQNEKADATQYRLGNMDGDTEVETSISEGERSLLVKIFELQSRMISLTDELITTKLQHVQLQEELKILYCHEEIIDTREVDNA

SEQ ID NO: 16485 - protein, 414 aa, Arabidopsis thaliana
MSGMLGLSAVMGKRPKQQVTARPRKCPIEKPEEIPDDLLIDVFSRLSIEDVARCRCLSRFWSSILRRRYFTELFHKMSSTRPRILFTFLYYGKRLFYSMPQDLDPSNHYSPLPYFSISYSPISAHYQMHFPKVLGASAKVCPPILGLICCKSSKTMIFNPSTRESKFISTTKRVGVKSTSFGYDPIDKLFKVLSMSDDFVCRVSTLGTEVVTWRTVECSVPHHPLHSEICMDGVLYYLARRVGDETPKPYMVAAFEVRLERFKFLPMDLRCKHIGCSAVIDYKGKLAVVWLNVDRDNQRHIESFELRVLNDVDEVKWSQIIYELPNYWNNLPADIDVSIVGMTSAGEIVLATSHIRHPFYIFYYSTVTLAIVQLRIDFGIEAPEANHCSTMSTFVNHVENVELACGLGLSSIAM

SEQ ID NO: 16486 - protein, 371 aa, Cryptococcus neoformans var. neoformans B-3501A
MPDLVVTTQELRPSSPVYGHARTIIKNNFVAMAGEYVGTTLFMLCCLGGTHVALLPEKSVTGDLSQPLNTSSLFYISLSIGLSLTVNVWIFFRVSGGLFNPAVSLGMVLAGCLPPMKGALLTVAQVLGGITGAAIINVLLPGELNAGTTLGGGASIAQGLFIEAILTALLMLTVFFTAAEKNEATFLSPLAIGMALFIAEMVGVPYSGGALNPVRSLGPAVVTHNFPGYHWIYWVGPALGSVLATCFYSLLKYLEYESVPGPGEAPHVPPFWRLPARGYLSTLSHPFAKRASTGTYSHEDDPEKGLRSGKDSQANTDNPTRVNRPGSGDAEIQSPVEDTTMANARLDRIEMLLTQLMQVRTSEGTQKSPAV

SEQ ID NO: 16487 - protein, 152 aa, Glycine max
  misc_feature (27)..(28): Xaa can be any naturally occurring amino acid
  misc_feature (76)..(76): Xaa can be any naturally occurring amino acid
  misc_feature (83)..(84): Xaa can be any naturally occurring amino acid
  misc_feature (86)..(86): Xaa can be any naturally occurring amino acid
  misc_feature (92)..(93): Xaa can be any naturally occurring amino acid
SSYTSIASNTQKADLSISTKERKENIXXLIVALQQLVSPYGKTDTSSVLKEAMEYIGFLHKQVKLLSAPYLESSPXAKMQGVXXCXLRSTGXXLLKGRRFLPLLLLRRGPPSCPCGPFPVPSCRTSAMPVSRSALRPDPKAFRISRGGSPPA

SEQ ID NO: 16488 - protein, 315 aa, Phaseolus lunatus
MSNFPVINFERLNGEERKDTMEKIKDACENWGFFELVNHGIPHDLLDTVERLTKEHYQKCMEERFKELMASKGLEAIQTEVKDMDWESTFHLRHLPESNISEVPDLVDEYRKVMKDFALRLEKLAEQLLDLLCENLGLEKGYLKKAFYGSRGPTFGTKVANYPPCPNPELVKGLRPHTDAGGIILLFQDDKVSGLQLLKDDQWVDVPPMRHSIVVNIGDQLEVITNGKYKSVEHRVIAQTDGTRMSIASFYNPGSDAVIYPAPELLEKEAEEKAQLYPKFVFEDYMKLYAKLKFQAKEPRFEAFKASNFDPIATA

SEQ ID NO: 16489 - protein, 430 aa, Xylella fastidiosa
MTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKVSLPVPMMNIINGGAHADNNVDFQEFMVLPVGFASFSEALRAGTEIFHALKSVLKGQGLSTAVGDEGGFAPDLRSNVEALDAILEAIGRAGYIAGEDVLLGLDVASSEFRDNGKYNLVGENKRLTSEQFVDFLDDWVTQYPIISIEDGLAEDDWAGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 16490 - protein, 477 aa, Bacillus cereus ATCC 10987
MASIYKFYLNGEWRESSSGETIEILSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGIDMVSFTGGTNTGKHLAKKAAMITLVLELGGKDPGIVREDADLQDAANHIVSGAFSYSGQRCTAIKRVLVHENVADELVSLLQEQVAKLSVGSPEQDSTIVPLIDDKSADFVQGLVDDAVEKGATIVIGNKRERNLIYPTLIDHVTEDMTVAWEEPFGPILPIIRVSSDEQAIEIANKSEFGLQASVFTKDINKAFAIANKIETGSVQINGRTERGPDHFPFIGVKGSGMGAQGIRKSLESMTREKVTVVNFK

SEQ ID NO: 16491 - protein, 468 aa, Burkholderia thailandensis E264
MQKGSAETDLHRGLGQRQMRLIALGAAIGVGLFLGSANAIKMAGPGIILSYIIGGAVIFVIMRALGEMAVHEPVAGSFSRYARNYLGPLAGYLTGWNYWFLWLVTCIAEITAVGIYMGIWFPDVPRWIWALAALATMGSVNLLTVKAYGEFEFWFALIKVVTIVVMIAVGIAMIALGIGNHGVPMGISNLWAHGGFFPNGAQGVLMSMQMVMFAYLGVEMIGLTAGEAENPQKTIPGAINSVFWRILLFYGGALFVILSIYPWNEIGTQGSPFVMTFERLGIKTAAGIINFVVLTAALSSCNGGIFSTGRMLYNLAQQGHAPRTFGETTASGVPRRAILVSMAALLVGVLLNYLVPEKVFVWVTSISTFGAIWTWGVILVAQMKFRASLAPAQERALRFRMPFWPYGSWVALTFLVLVVGLMAYFPDTRIALYVGPAWLVLLVVLYYALKLEPEGGKEAGLARGYERG

SEQ ID NO: 16492 - protein, 485 aa, Candida glabrata CBS 138
MLSLFRCAVTRAPHIASKGISVQISRNLANSLIVQNKRRLNTKSYFLQEQKKDDKKAQSILTDDLLFKAGIDVEEGKKEGQQKQHETEEGNEEQQSENSSNKKRKRRMTSADKKKERYANYFYIFTFSSLAGLGLYMCRDWEENEDDEMKKDIDNGYTPDLMYKRFRARFNSVFTYFQEPPFPDLLPPPPPAPYQRPLTLVITLEDFLVHSEWDQKHGWRTAKRPGADYFLGYLSQYYEIVLFSSNYMMYAEKIAEKMDPIHAFISYNLFKEHCVYKDGVHIKDLSKLNRDLKKVMIIDTDENSYKLQPENAIPMDPWDGKADDKLLRLIPFLEYMATQQVEDVRPILKSYHNKRELPAEFEQRVQKLKNKFEQDQKKKNDSNWLLKLLGLAPVINGIGGGNKFPLDMIREEGEKNYVRFMKLIEEEKEKMRIQQEQMSGQTFTLKDYVEGNIPTPEEQMKMQLEKQKEIDALFEQKKKEQQANK

SEQ ID NO: 16493 - protein, 92 aa, Solanum tuberosum
LLIVGRVVGDVLDPFTRSVDLRVVYNNKDVNNACVLKPSQVVMQPRVHIGGDDLRNFYTLIMVDPDAPSPSDPNLREYLHWLVTDIPATTGT

SEQ ID NO: 16494 - protein, 369 aa, Pinus armandii
LHSYCFERVAEFADRPCLIDGATDRTYSFAEVELISRKVAAGLAKLGLQQGQVVMLLLPNCIEFAFVFMGASVRGAIVTTANPFYKPWEIAKQAKAAGARIIVTQAAYVEKLADLQSHDVLVITIDDAPKEGCKYISVLTEADETQCPVVKIHPDDVVALPYSSGTTGLPKGVMLTHKSLVSSVAQQVDGENPNLYFHSEDVILCVLPLFHIYSLNSVLLCALRAGAATLIMQKFNLTTCLELMQKYKVTVAPIVPPIVLDITKSPIVSQYDVSSVRIIMSGAAPLGKELEDALRERFPKAIFGQGYGMTEAGPVLAMNLAFAKNPFPVKSGSCGTVVRNAQIKILDTETGESLPHNQAGEICIRGPEI

SEQ ID NO: 16495 - protein, 581 aa, Corynebacterium efficiens YS-314
MSTPAARVLSMLSTMQDVPLSLSRILKYGSTVHGDTIVTTYDGGEQEQLTFADIGARAAALAHALHDSFGITGDQRVGSLLYNCGEHLETMFAVSCMGAVFNPINKQLMNHQISYIINHAEDEVIVADPRLAGQLGEVLKSCPGVRAVIFIGDSDIREPASHLPESVEAYSYESLLDGRSTHYDWPVQDERTAAAIGYSTGTTGAPKGVVYSHRSLYLQSLSLRTTDSLSVTHGETFLCCVPIYHVLSWGVPIAAFMSGTPLVMPGSDLSAPTLAKIISTTLPRVAHGVPTLWIQLMVHYLKNPPERMSLRELYVGGSAVPPVLITLWEERYGVDVVHVWGMTETSTVGTVSRPPSGASGSARWAYRVSQGRFPASLEYRVVNDGQVMASTDRNEGEIQVRGPWVTGSYFQPPTQTEGGLAHTFDGEQVDDGRESFTADGWLRTGDVGSVTSDGFLTIQDRARDVIRSGGEWIYSAQLENLIMATPEVVECAVIGFPDDKWVERPLAVTLLYPNVEPTRETAEKLRDQLRDRLPNWMLPEYWTFVSEIDKTSVGKFDKKDLRMHLANGEFEVIKLKGPGEK

SEQ ID NO: 16496 - protein, 482 aa, Neisseria meningitidis
GSADAEYDVVVLGGGPGGYSAAFAAADEGLKVAIVERYKTLGGVCLNVGCIPSKALLHNAAVIDEVRHLAANGIKYPEPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASARKITKANFPWAASGRAIANGCDKPFTKLIFDAETGRIIGGGIVGPNGGDMIGEVYLAIEMGCDAADIGKTIHPHPTLGESIGMAAEVALGTCTDLPPQKK

SEQ ID NO: 16497 - protein, 310 aa, Arabidopsis thaliana
MRPPVTGGRGGGGFRGGRDGGGRGFGGGRSFGGGRSGDRGRSGPRGRGRGAPRGRGGPPRGGMKGGSKVIVEPHRHAGVFIAKGKEDALVTKNLVPGEAVYNEKRISVQNEDGTKVEYRVWNPFRSKLAAAILGGVDLDNIWIKPGAKVLYLGAASGTTVSHVSDLVGPEGCVYAVEFSHRSGRDLVNMAKKRTNVIPIIEDARHPAKYRMLVGMVDVIFSDVAQPDQARILALNASFFLKTGGHFVISIKANCIDSTVAAEAVFQSEVKKLQQEQFKPAEQVTLEPFERDHACVVGGYRMPKKQKAPAS

SEQ ID NO: 16498 - protein, 371 aa, Pinus armandii
LPLHSYCFERVAEFADRPCLIDGATDRTYSFAEVELISRKVAAGLAKLGLQQGQVVMLLLPNCIEFAFVFMGASVRGAIVTTANPFYKPWEIAKQAKAAGARIIVTQAAYVEKLADLQSHDVLVITVDDAPKEGCKHISVLTEADETQCPIVKIHPDDVVALPYSSGTTGLPKGVMLTHKSLVSSVAQQVDGENPNLYFHSEDVILCVLPLSHIYSLNSVLLCALRAGAATLIMQKFNLTTCLELMQKYKVTVAPIVPPIVLDITKSPIVSQYDVSSVRIIMSGAAPLGKELEDALRERFPKAIFGQGYGMTEAGPVLAMNLAFAKNPFPVKSGSCGTVVRNAQIKILDTETGESLPHNQAGEICIRGPEI

SEQ ID NO: 16499 - protein, 156 aa, Oryza sativa (japonica cultivar-group)
MACSPRVFLSASATPPPPSAAASSSSPFLSTGHVSSAPSTSRWTVQYKQPGHTFYRRTHVQSFLAFASTDASEGKRSSGDNVVMVDPLEAKRLAAQQMQQIQAREKLKRRRRAEAINGALAMIGLTVGLVLEGQTGKGILAQLAGYLTALSSLFGQ

SEQ ID NO: 16500 - protein, 803 aa, uncultured delta proteobacterium
MIVSLSWLKQYIDISISPVELSECLTMAGLEVEGMEYPNNFLKDVIVAEVISTCKHINADHLMVCQVDNGAEHVQVVCGAPNVRAGAKYPLALPGATMPNNMTISRSKLRGEVSNGMLCSAKELNIGDNQSGIMELDYSYETGTSILKTMNLNEVIFELSVTPNRPDWLSVTGVAREISALLNIPFKMPEIFVNETGEDIKILTQVTNEAPELCQRYAARVIEGITIKESPKWLKERLKSVGIRSINNVVDITNFVLMELGQPLHAFDFDLLEEQRIVIKKAGNEFLFNTLDGAQHKLDPSSLMICDGNKPVAIAGIMGGENSEIHAGTTRVFLESAYFNPPDIRKISKQTGIRTESSYRFERGVDPDCVVFALNRAACLISELAGGRIAKGVIDCYPEPIQQSVIKLSTSSVNKMLGLKLSSKDIRGYLQALGMYIDTGEDSDILLVTPPNFRQDIKRSVDLIEEVARMHGYDKIPVTFPTTEVIASPQYQHQELREKSHQSMVSLGFMEIINYSFISRDSIANLGLSPDSELIKAVEIKNPLSEDQSIMRTTLIPGILNTMRGNLNHKNLNLSLFEIGKVFIPTSNELPDEREMLIALITGKRTNLSWMGKNDPVDFFDIKGVLETLFEQMSLPSPELKENNNITYLSNSQNAAILINGKAVGEIGMISKKVKAAFDLKQDAFIFQLDLAKLMPFALSIPTFKHIFKFPAVERDIAIVVDEHVKWSEVLFAIKNIRISILEKIELFDIFRDAEKVGQGRKSMAINFLFRSEIKTLNDNEVNKSINKIIQTLSKVINAILRV

SEQ ID NO: 16501 - protein, 1073 aa, Oryza sativa (japonica cultivar-group)
MVTPRAPELLQQDQDEEMLVPDQDVVVEGPQPMEDSGSTVENEQVPETSTSRFTWTIEDFSNHRKLYSDVFVVGGHKWRVLVFPTGNSVQSLSMYLDIADANEQPHGWSKYAQFSLAVINQLDSKYSLRKGDLYDPTKGYIVNDKCIIEAEVAVRKIVDFWNYDSKKETGYVGLKNQGATCYMNSLLQTLYHIPYFRKHSDNSVSTKELTKSFGWDTVDSFLQHDVQELNRVLCEKLENKMKGTTVEGTIQQLFEGHHMNYIECINVDYKSTRKESFYDLALDVKGCSDVYASFDKYVEVERLEGDNKYQSEKHGLQDAKKGMLFIDFPPVLQVQLKRFEYDFVRDTMVKINDRYEFPLQLDLDKDDGKYLSPEADRRVRNLYTLHSVLVHSGGGHGGHYYAFIRPALSDIWYKFDDERVTKEDMKRALEEQYGGEEELPHTNPGLNTTPLRFTKHSNAYMLVYIRESDREKIICNLDENDIPEHLKIRLRKENEEREYKKKEKAEAHMFTALKVARDSDFAEQIGKHIYFDLVDYDNIQSLRAPKHLTINQAKVDLSKEFGIPVQSQRFWLWAKRQNHTFRPVRPLTLQEEASSIGHLTDPSNKSLNSELKLFLEVALGQPKFIDLGLLVDNLTQIMTCVQENHPISVPPKTKDDILIFFKLYDPEKEELRYVGKLLVKASGKPADIVQKLQEMAGFQSDEDIELYEEVMFEPSVMCEPININDSFLSSQLEDGDIICYQKRCSPEKLDHYRCADVPSFFEYIQNRQVVHFRLLENPKDDDFTLELSKRFTYDDVVEKVANQLGLDDPSKLRLTQHLPYSQMPKSHYIKYRGLDHLSDMLRNGNQMSDILYYEILDIPLPVLQDLITLRVAFYHATNNEVSSHFIRLPKGSTMSDLIEDMKSKVELSYSDAEFRLFEVYKNKIRKVYQPSEKISVNEFNGLLCVEEVPEEEKNAGVRDRLVHVCHFIIEKQHIDYYGEPFFFLIRDGETLSDIKVRIQKKLLVSDEQFAKWKFAYIAHNRLAGEYFQDSDIVLSRFQKDVYGPWEQCLGLEHSDVTPKRSCLSNQVYAYDSY

SEQ ID NO: 16502 - protein, 560 aa, Aspergillus oryzae
MHLIGPAVSTKWHWMNCHPFSGEVVTTHYDSWSSLPCGDGPITWIYIDASDSSRSISYNQAKVIVRKLIAGLRAWGVQKGDCVAIHSFNDIYYSMLVLAINGAGGVYTGTNPSYTPMELGHHIRASHAKFIISEPEIIAPIQAAMKETGIPESNLLVFDVQGQTVPAGLKSWKGLFSAGEEDWVRFDDLKTCEETAAARLFSSGTTGLPKATTLTHRNFIAQHELVFEIEKRPYQIRRLMALPMFHAAAAPSTHWSPLKGGHVVHVMRRFDLVSFITNVEKYQITDLAVVPPIAVALVMSPQVQERPYLKSVRVASCGAAPLSKEVQEKLRVMLADGAPCTQVWGMTETCCIATRFGAYEQDDTGSVGRLIPNVEAKLVDDDGNNISAYGVRGEICVRGPTVTPGYFENAAANASSFDQDGWYHTGDIAYCDKDTQKWYIVDRKKELIKVRGFQVAPPELEAVLLSHPLIVDAAVIGLSGVLPDSELPRAYVTRRPGTGDKLTEKEVQDYLGQRLAKYKALTGGVRFMDAIPKNASGKILKRVLREEAQKEVKAGFRPKL

SEQ ID NO: 16503 - protein, 461 aa, Arabidopsis thaliana
MDRVGSLPDELLSHILSFLTTKEAALTSLLSKRWRYLIAFVPNLAFDDIVFLHPEEGKPERDEIRQSFMDFVDRVLALQAESPIKKFSLKCRIGVDSDRVDGWISNVLNRGVSELDLLIILGMTMEDSYRLSPKGFASKTLVKLEIGCGIDISWVAGSIFLPMLKTLVLDSVWFYVDKFETLLLALPALEELVLVDVNWLDSDVTISNASLKTLTIDSDGHLGTFSFDTPSLVYFCYSDYAAEDYPVVKMENLREARIFLLVTDNEIERVRLPINDGLEDAMDNVVLRFGHVGKLMNGIRNVEYLELSADTLEVLSLCCESMPVFKNLKSLAIKSTEGRGWQAMPVLLRNCPHLEFLLIEGLLHHVTDKCGDACDCVPREDKGRSLTSCPEMDIYADEDGPTNLEAPGMFEQITQLFTLYDEFYTCDVQFMVRGSLYKKLTAQCCVFKEENLPHRLVRTLG

SEQ ID NO: 16504 - protein, 327 aa, Burkholderia thailandensis E264
MIAKINDDRALALARDVLDIEASAVRALADQLDGEFVAAVGLLLECRGRVVVSGIGKSGHIARKIAATLASTGTPAFFVHPAEASHGDLGMVTKDDVFVAISNSGESEELVAILPLIKRLGAKLIAMTGRPASSLATLSDVHLNAGVAKEACPLNLAPTASTTAALALGDALAVAVLDARGFGSDDFARSHPGGALGRRLLTYVRDVMRTGDEVPAVPLGATLSDALFQITAKRMGMTAVVDDAGRVAGIFTDGDLRRVLERDGDFRRLPIVDVMTRNPRTIAPDHLAVEAVELMERHRINQMLVVDEHGALIGALNMHDLFSKKVI

SEQ ID NO: 16505 - protein, 390 aa, Rhizobium leguminosarum bv. viciae 3841
MSNGSEPFDLASLITAHDEGNFADAVVPPIFQTSLFTFSDYDDMIASYRGEKVRPIYTRGLNPTVRAFEEMLAKLEGAEDALGFASGMAAISSAVLSFVEPGDRIVAVKHVYPDAFRLFGTILKRMKIEVTYVDGRDEEAVARALPGAKLFYMESPTSWVMEAHDVGALAALARQHGVVSMIDNSWASPFFQRPLTLGVDLVIHSASKYLGGHSDVVAGVIAGSKAMIARVKAEAYPYLGGKLSPFDAWLLIRGLRTLPLRMRAHETSALEIARRLQKLDVVETVCHPGLANRLPAGLNGTSGLFSFIFREGVDIRAFADHLKLFKLGVSWGGHESLIVPGEVVLQQKAQPNSAHAFGIHARSVRLHVGLEGTEALWRDIEKALAAASQS

SEQ ID NO: 16506 - protein, 351 aa, Mycobacterium avium subsp. paratuberculosis K-10
MTQLADRPTGHGETLTAAVQDVALHAQALTMVQALNRALHDAMAADERVLVFGEDVAVQGGVFRVTEGLAEAFGESRCFDTPLAESAIIGIAVGLALRGFVPVPEIQFDGFSYPAFDQVVSHLAKYRTRTRGAIDMPVTVRVPSFGGIGAAEHHSESTESYWAHTAGLKVVVPSNPADAYWLLRHAIACPDPVMYLEPKRRYQGRGLVDAGRPEPPIGRAMVRRAGTDVTVVTYGSLVGTAVGAAEEAQRQRGWSLEVIDLRSLVPLDFDTIATSIHRTGRCVVMHEGPRTLGYGAELAARIQEELFYELEAPVLRACGFDTPYPPARLEKWWLPGPDRLLDCVERTLELP

SEQ ID NO: 16507 - protein, 121 aa, Burkholderia thailandensis E264
MSHDPNCLFCKIAAGEIPSTKVHEDAEFVAFRDIRPAADTHVLVIPRKHLPTLSAVTTDDAPLLGRMMVLVARLAEQLGCAYTGGETGFRTVINTGPGGGQEVYHLHAHILAGPRPWRRMG

SEQ ID NO: 16508 - protein, 82 aa, Zea mays
PKVPPHKNLSAREVSPDKRSNERSPSPRRSLSPRSPALQKASPSKEMSPERRSNERSPSPGSPAPLRKVDAASRSQSPYAAE

SEQ ID NO: 16509 - protein, 428 aa, Pyrococcus abyssi [sequence omitted]

SEQ ID NO: 16510 - protein, 218 aa, Zea mays
  misc_feature (55)..(55): Xaa can be any naturally occurring amino acid
EAHFRCESGTGHGGGGGRGGGRGRGRGRGRGRDEEEDLPLHKAARSGDAAAVESXLHLAAWAGHVDVVRCLCKHKADVGAAAMGDTAALHFASQKGHVEVARELLASGASVKAKNRKGFTALHFAAQNSHLDLVKYLVKKGVDVTAKTKGGQTALHVAEDDEVRAFLKECEQSLKKGAELPSEKDDSAEKEGDSKSSGEVMKDEEDAEQGEKRKANWL

SEQ ID NO: 16511 - protein, 347 aa, Halobacterium sp. NRC-1
MRAAVYQGPGEIAVEEVPKPDIESPEDAVIRVTHTAVCGSDLWFYRGDSDREAGSRVGHEPMGIVEEVGDDVTSVAPGDRVIAPFAISCGECEFCRQGLYTSCVEDESWGSEANGGGQGEYVKCPFADGTLVRVPDRYADDEDVLESLLPLTDVMGTGHHAAVSAGVGEGDTAVVVGDGAVGLCGVLAAQRLGAERIIAMGHHEDRLELAAEFGATDTISARGDDAIERARDLTHGGANHVMECVGAASAMDSAIAIARPGGTVGYVGVPYGVEDGGLDVFTMFSDNITIRGGVAPVRAYAEELMADVLQGTLDPSPIFTKTVDLDGVPEGYAAMDDREAIKVLVKA

SEQ ID NO: 16512 - protein, 242 aa, Glycine max
MPPCPLFPFNPFHLLSNSLSLSKISLKSEKSLSLSKIRNNLKQIEMESNTPVIAKKVLSIIRVAFFMLRKGISKGKLMMHLNNMMLKRPGKAIANLMFHHHHNHGVSGNNLQFSTAREYEFSCSNTPNNFFAAALASNNKRHRHNPFFTCAHAPPTLDDDAVTVNAVKGVLEMLNNEAFEEASPAVATALSGFGRSPMVRKLIRVTDSPFPLGESEDDKDNQVDKAAEEFIKRFYKELRKQT

SEQ ID NO: 16513 - protein, 401 aa, Medicago truncatula
MATKRSVGTLKEGELKGKRVFVRVDLNVPLDDNLNITDDTRIRAAVPTIKYLTGYGAKVILSSHLGRPKGVTPKYSLKPLVPRLSELLETQVKISDDCIGEEVEKLVAQIPEGGVLLLENVRFHKEEEKNEPEFAKKLASLADLYVNDAFGTAHRAHASTEGVAKYLKPSVAGFLMQKELDYLVGAVSNPKKPFAAIVGGSKVSSKIGVIESLLEKVDILLLGGGMIYTFYKAQGYSIGSSLVEEDKLDLATSLMEKAKAKGVSLLLPTDVVIADKFSADANDKIVPASSIPDGWMGLDIGPDSIKTFNEALDKSQTIIWNGPMGVFEFDKFAAGTEAIAKKLAEVSGKGVTTIIGGGDSVAAVEKVGLADKMSHISTGGGASLELLEGKPLPGVLALDDA

SEQ ID NO: 16514 - protein, 401 aa, Medicago truncatula
MATKRSVGTLKEAELKGKRVFVRVDLNVPLDDNLNITDDTRIRAAVPTIKYLTGYGAKVILSSHLGRPKGVTPKYSLKPLVPRLSELLGTQVKIADDSIGEEVEKLVAQIPEGGVLLLENVRFHKEEEKNDPEFAKKLASLADLYVNDAFGTAHRAHASTEGVAKYLKPSVAGFLMQKELDYLVGAVSNPKKPFAAIVGGSKVSSKIGVIESLLEKVDILLLGGGMIFTFYKAQGYAVGSSLVEEDKLDLATTLIEKAKAKGVSLLLPTDVVIADKFAADANDKIVPASSIPDGWMGLDIGPDSIKTFNEALDKSQTIIWNGPMGVFEFDKFAAGTEAIAKKLAEVSGKGVTTIIGGGDSVAAVEKVGLADKMSHISTGGGASLELLEGKPLPGVLALDDA

SEQ ID NO: 16515 - protein, 296 aa, Lactobacillus plantarum WCFS1
MNQPELRDPRYLYKTDGFDKQDQETPALQAKMRPEPDCGEKSYQGHDKLLNRRVLITGGDSGIGRATAIAFAREGADVAIQYLPGEEPDAEAVAELVRAAGRQALLLPCDFKDVDVVTDLVDRTIAEFGGIDTLVLNAGQQISQPSLAKLPIEQVRATFEVNIVAMFALAQAALPKMPAGGSIVTTTSIQAYAPSGHLLDYAATKAAIKNFTINLAAEAAEKGIRVNGVAPGPIWTPLQLDQGQPIEALPKFGQDTLLKRAGQPAELAPVYVFLASNDASYVTAQIYGVTGGGVIN

SEQ ID NO: 16516 - protein, 525 aa, Legionella pneumophila subsp. pneumophila str. Philadelphia 1
MNDLKKSPLLILDFGSQYTQLIARRVREMGVYCEIYPYHINHEQFKKLNPCGVILSGGPSTVTHDANPRAPQWLFDSGLPLLGICYGMQTMAVQLGGQVHSSALREFGYAELRLHGHSQLLNNIEDRILADGSALLDVWMSHGDKVTELPPGFKIICETRNAPIAGMADESRQMYGLQFHPEVTHTLQGLRILQRFVVDICKASTDWTPEHIIDEAINKIREQVGTEKVLLGLSGGVDSSVVAALLHRAIGEQLVCVFVDTGLLRLNEAEQVLSMFGRHMGIRIIAVNAEDKFLTALKGVTCPEEKRKIIGRTFIEVFDEEAQKLTEIKWLAQGTIYPDVIESAATSTNDAAVVIKSHHNVGGLPDTLNLKLLEPIRELFKDEVRQVGLELGLPHDMVYRHPFPGPGLGVRILAEVKKEYADILRKADAIFIEELHNAQLYHKISQAFAVFLPVKSVGVMGDGRRYDYVICLRAVETVDFMTAHWSQLPWDFLGKVSNRIINEVEGVSRVTYDISGKPPATIEWE

SEQ ID NO: 16517 - protein, 479 aa, Medicago truncatula
MASATAPTTISLLPTTKSSSPSTTPCPSRIHLSSFLGARPLRRLGFAAADPLLAVQVASKVRTVSGRGVRGVVSMAKKSVGDLSGAELKGKKVFVRADLNVPLDDNQNITDDTRIRAAIPTIKYLIQNGAKVILSSHLGRPKGVTPKYSLAPLVPRLSELIGIEVIKAEDSIGPEVEKLVASLPDGGVLLLENVRFYKEEEKNDPEHAKKLAALADLYVNDAFGTAHRAHASTEGVTKYLKPSVAGFLLQKELDYLVGAVSSPKRPFAAIVGGSKVSSKIGVIESLLEKVDILLLGGGMIFTFYKAQGLAVGSSLVEEDKLELATTLIAKAKAKGVSLLLPSDVVIADKFAPDANSQIVPASAIPDGWMGLDIGPDSIKTFNEALDTTQTIIWNGPMGVFEFDKFAVGTESIAKKLADLSGKGVTTIIGGGDSVAAVEKVGVADVMSHISTGGGASLELLEGKELPGVLALDEATPVAV

SEQ ID NO: 16518 - protein, 365 aa, Pinus armandii
CFERVAEFADRPCLIDGATDRTYSFAEVELISRKVAAGLAKLGLQQGQVVMLLLPNCIEFAFVFMGASVRGAIVTTANPFYKPWEIAKQAKAAGARIIVTQAAYVEKLADLQSHDVLVITIDDAPKEGCKHISVLTEADETQCPVVKIHPDDVVALPYSSGTTGLPKGVMLTHKSLVSSVAQQVDGENPNLYFHSEDAILCVLPLFHIYSLNSVLLCALRAGAATLIMQKFNLTTCLELMQKYKVTVAPIVPPIVLDITKSPIVSQYDVSSVRIIMSGAAPLGKELEDALRERFPKAIFGQGYGMTEAGPVLAMNLAFAKNPFPVKSGSCGTVVRNAQIKILDTETGESLPHNQAGEICIRGPEI

SEQ ID NO: 16519 - protein, 554 aa, Burkholderia sp. 383
MNPSQPHLHDAPAPSAHAYPLLIKQLLHTPLATRPEQEIVYGDQVRHDYWTFRHRIGQLASGLTSLGVGAGDTVAVMDWDSHRYLECYYAIPMMGAVLMTANVRLSPDQLLHTLNHCGARVVLVHRDFLPLLDGIRDRLVAAQRFVLIADGAETGLPDGFADEYERLVAASSPDFVFGDFDENTRATTFYTTGTTGLPKGVAFSHRQLVLHTLAGMAALSGARDRGRLHRDDVYMPITPMFHVHAWGLPYIATALGLKQVYPGRYSPDGLVALIARESVTFSHCVPTLLGMILDCPASASVDLSSWKVLVGGSPLPEGLARAALARGIDVYTGYGMSETCPLMTIAQVDASPMANGTADDDLARRTKAGLPLPLVDLRIVDAQFRDVPHDGRAAGEVVVRMPWATAGYLGDAPATASLWAGGYLHTNDIGVIDPDGRLQITDRIKDVIKTGGEWVSSLALEDILSRHPAVRESAVIGVKDARWGERPLALVVLADDHVGRVGPAELQAHVKQVADRGLISRYAVPERLLIVDAIEKTSVGKINKRALRERYQPA

SEQ ID NO: 16520 - protein, 385 aa, Glycine max
  misc_feature (330)..(330): Xaa can be any naturally occurring amino acid
MMTNQNVVTHEVINTLIAMAASISNSTVLPSATVPESMAVLGGFWGLPHNKNLVKRLEGAKVSAWIDSMRASSPTRAKSESQEKRSWILYHPSALNTFEQIVYSAKGKQIVVFLDYDGTLSPIVADPNKAFMTRKMRATLKGIARHFPTAIVTGRCRDKVYNFVKLAELYYAGSHGMDITGPTKSPKQGNNNNKAVLFQPASQFLPMIDEVYKILLEKTKTVPGAKVENNKFCLSVHFRCVDEKSWAALAEKVRLVLIEYPQLRLTQGRKVLEIRPTIKWDKGKALEFLLESLGYENSNDVFPIYIGDDRTDEDAFRVTNAATPSLLVSXLKVLRSRGQGIGILVSRVAKETDASYSLQDPSEVEQFLRRLVEWKRSSTVTPASV

SEQ ID NO: 16521 - protein, 273 aa, Glycine max
  misc_feature (150)..(150): Xaa can be any naturally occurring amino acid
  misc_feature (176)..(176): Xaa can be any naturally occurring amino acid
MIPLKTHPHSPFIFSVSKTNPLYFSLLPTSISLLSLKQPPPSLSSNLLRVSNVGVSVCRTEHHEEEEDKGVSLELHDLSPNGEVYQKTLQLVECSMFAALTGLVYFLSNSLAIENYFSCFFSLPIVISSMRWGVDAGRKTLVATTILLLXLSGPVKALTYLLKHGIVGFTMGTLWXVRALGAVGFVLISSFLIRENILALITINIHASLTFLLTAAGVTSIPSMNVIYTLFGILVLINSGCFMFLLHLLYSVFLTRMGMKSSLRLPRWLERAI

SEQ ID NO: 16522 - protein, 434 aa, Streptococcus intermedius
MSIITDVYAREVLDSRGNPTLEVEVYTESGAFGRGMVPSGASTGEHEAVELRDGDKSRYGGLGTQKAVDNVNNIIAEAVIGYDVRDQQAIDRAMIALDGTPNKGKLGANAILGVSIAVARAAADYLEIPLYSYLGGFNTKVLPTPMMNIINGGSHSDAPIAFQEFMIVPAGAPTFKEALRWGAEIFHALKKILKSRGLATAVGDEGGFAPRFDGTEDGVETILAAIEAAGYVPGKDVFLGFDCASSEFYDKERKVYDYTKFEGEGAAVRTADEQIDYLEELVNKYPIITIEDGMDENDWDGWKKLTERLGKKVQPVGDDFFVTNTSYLEKGINEACANSILIKVNQIGTLTETFDAIEMAKEAGYTAVVSHRSGETEDSTIADIAVAANAGQIKTGSLSRTDRIAKYNQLLRIEDQLGEVAEYRGLKSFYNLSK

SEQ ID NO: 16523 - protein, 498 aa, Yersinia pseudotuberculosis IP 32953
MSEYHEKNNALFKSITALDGALFINGEFRKGAGGRLPVENPATGKVIGHLAAATPEEIEEAVAAARRAFPAWAAERPKARANALHRLGDLIAADALNMARIMTIEQGKPVNEAQGEILKLAEICHFYGEEATRVQGDVVPNDPPGFQSLVVREPVGVVGAITPWNYPAELVGWKLCASLAAGCTLIIKPAELTPYTALAIAEKCLEAGIPAGVVNVLTGKGEQVGQALVEHPQVDKIAFTGSSAVGLHIQQSCPQVKRLSLELGGNGPMVVAACADVAAAVKGAVRRSFRNCGQVCIAINRIYVHRSCYRAFVSKMGVATNGLRLGNGLDDPAADLGAMASVEPLNKTRAHLEDALAKGARLVAGGKAPEGVEYAKGHFFRPTVLADCTHQMRVMTEETFGPLVGLAPFDDIDEVISRANDTPYGLAAYIYARDLAAIHRLSAALDYGNVAINNVDASMMNAPYGGRKQSGVGYEHGREGLLEYFNFKHIRLYHGIGD

SEQ ID NO: 16524 - protein, 468 aa, Brassica napus
LWDVDAGLTHPDKYFHSNDNPIIAGALLGVGIVNCGIKNDCDPALALLGEYIDKEDSSVRIGAIMGLGIAYAGSQNDQLRSSLSPILNDAKAPLDVIAFAALSLGMIYVGSCNEEVAQSIIFALMDRSEAQLGDALTRFLPLGLGLLYLGKQESVEATAEVSKTFNEKIRKYCDMTLLSCAYAGTGNVLKVQDLLAQCGEHLEKGDIHQGPAVLGIAMVAMSEELGLDMAIRSLERVLQYGEQNIRRAVPLALGLLCISNPKVNVMDTLSRLSHDTDSEVAMAAIISLGLIGAGTNNARIAGMLRNLSSYYYKDASLLFCVRIAQGFVHMGKGLLTLSPFHSERLLLSPTALAGIVTLLHACLDMKSIILGKYHYVLYFLVLAMQPRMMLTVDENLKPISVPVRVGQAVDVVGQAGRPKTITGFQTHSTPVLLAAGERAELATDKYIPLSPILEGFIILKENPDYREE

SEQ ID NO: 16525 - protein, 254 aa, uncultured delta proteobacterium
MPDDLKQIAKQMIKSKYVIAMTGAGISVESGIPDFRSPGGLWSRFDPFEYAHIDAFKRDPAKVWKMLLEIDEVLNQAKPNRAHYALAKLEAAGILKAIITQNIDNMHQRAGSKNVIEFHGNAETLTCTKCKKKFTREEITMESIPPLCECKGVIRPDVVFFGETIPAHATRMAGKEVEKCAMILVIGTSADVAPASRLPIKAKEGGAIIVEINLRETRLITPIADFRITDKAGDGLMKLVNEVDEILNTHDSIY

SEQ ID NO: 16526 - protein, 110 aa, Triticum aestivum
  misc_feature (60)..(60): Xaa can be any naturally occurring amino acid
  misc_feature (72)..(72): Xaa can be any naturally occurring amino acid
  misc_feature (94)..(94): Xaa can be any naturally occurring amino acid
MASTGRSMLLSLLLFAVTLSLLEMYRAKFASSELMTIAGGFVCSLLFLLLLTFIGNYQEXSGDRTGWGALLXSTTCTLIVAGTVHRVCITTCSXFPLDPLRVDSLDLRMI

SEQ ID NO: 16527 - protein, 209 aa, Neisseria gonorrhoeae
MNLFQNAKFFTTVNHLKDLPDTPLEIAFVGRSNAGKSSAINTLTNHVRLAYVSKTPGRTQHINFFELQNGNFMVDLPGYGYAQVPEAVRAHWVNLLGDYLRHRKELIGLVLIMDARHPLKELDIRMLDFFHTTGRPVHILLSKADKLSKNEQIKTLSQVKKLLKPYSDRQNISVQLFSSLKKQGIDEANRTVGSWFDAADAAASSPEEN

SEQ ID NO: 16528 - protein, 428 aa, Pseudomonas syringae pv. phaseolicola 1448A
MAKIVDIKGREVLDSRGNPTVEADVVLDNGIVGSACAPSGASTGSREALELRDGDKSRYMGKGVLKAVANINGPIRDLLLGKDPVDQKALDHAMIKLDGTENKASLGANAILAVSLAAAKAAAQDQDLPLYAHIANLNGTPGVYSMPVPMMNIINGGEHADNNIDIQEFMIQPVGAKTFAEGLRWGTEIFHHLKAVLKARGLNTAVGDEGGFAPNLASNKEALDAIAEAVANAGYTLGTDVTLALDCAASEFYKNGKYKLSEEGEYSSAEFAEYLAELTRKHPIISIEDGLDESDWDGWKVLTDKIGEKVQLVGDDLFVTNTKILKEGIDKKIANSILIKFNQIGSLTETLEAIQMAKAAGYTAIISHRSGETEDSTIADLAVGTSAGQIKTGSLCRSDRVSKYNQLLRIEEQLGSKAAYRGRAEFRG

SEQ ID NO: 16529 - protein, 333 aa, Burkholderia thailandensis E264
MPLTRRRARRFPNTFIAYGGSQMNDYNYLDSARQVFDIESRALAGLSARVDESFGDAVDAILRSSGRVVVCGMGKSGIIGRKIAATLASTGTPSFFMHPGEAYHGDLGMVTPADTFLAISYSGETDEVIKLIPFLKSNRNYLVALTGNARSTLAQAAHSHLDAGVEQEACPLQLAPTSSTTAALAMGDALAVTLMKARGFRPENFARFHPGGSLGRRLLSKVDDEMAAGDLPFVDERAQAIDVLQVMTRGRLGLAIVRRETGFGIITDGDVRRAVEAYGDTLFRRVASDLMSKDPAMVPLGTRVEDALLMMETRRINALLVFDGEDVVGVFKK

SEQ ID NO: 16530 - protein, 336 aa, Aspergillus oryzae
MSTPIFPVIDYSRIISSNPMIAAQEKDKLFQSFKDVGFIYLKGFNFPPEFIDTLFSHLHKFFSLPEEQKLAIEGGEKQAFRGWFAPARTAKNPEKADQKEAFGLGNDKDETRPNRWPSNWPEFRRDFTTFYEECYKMHLELLRALTEKVGLDRESLIPSVKAKDCYSALLHYYETSLESFDTRVRSAPHTDFGTLTLLFNDSNGGLQVKNQEGQWVDAPPMRGHAIVNVGDLLSRWFNGQLKSTQHRVVQPPAETRETENGTTTVIPSRYAIAWFGHPNRDAVVEPLKECVTAEWTQKFKAVVAGKHVKERMARLLEHGYLPEKWTDDMHRKPIAV

SEQ ID NO: 16531 - protein, 205 aa, Brassica napus
MFSLMHGLWTYMFSKTEFHVLILGIDKAGKTTFLEKLKTIYSISEGLPHDRIVPTVGLNIGRIEVANAKIVFWDLGGQPGLRSIWEKYYEEAHALIYLIDAACPSRFEDSKSALEKALRHEDLQGAPLLILANKQDLPNAVSAEELDRYLDLKKLDERVYMFEAASGYDGRGIKESIEWLVGVMERSKRTEALRARAGYVPVPTS

SEQ ID NO: 16532 - protein, 142 aa, Brassica napus
  misc_feature (41)..(41): Xaa can be any naturally occurring amino acid
MEQTFIMIKPDGVQRGLVGEIICRFEKKGFTLKAVLIVGMXGLKLITVDRPFAEKHYQDLSAKPFFSSLVDYIISGPVVAMIWEGKNVVLTGRKIIGATNPAASEPGTIRGDYAIDIGRNVIHGSDSVESANKEAALWFPDG

SEQ ID NO: 16533 - protein, 355 aa, Synechococcus sp. CC9311
MSLSAYSKELIATANALAESGKGILAVDESTKTIGKRLGGIQVENTEANRQAYRGMLFTTAGLGDFISGAILYEETLFQSHADGETMVQKLNKAGIIPGIKVDKGLCPLPGAKSVETVCTGLDGLVERAADYYAQGARFAKWRAVLQITADGCPSDLAIRENAWGLARYARSVQESGLVPIIEPEILMDGDHSIEVTAAVQEQILKEVYFACQLNGVLLEGTLLKPSMTIQGADCAHKSDPQIVAEMTVRTLERCVPASVPGIVFLSGGLSEEAASVYLNNMNKISRKAQWNLGFSYGRALQHSCLKAWAGKDQVAGQAALLARAKANSEASQARYVPGSQPSSDEQLFVAGYTY

SEQ ID NO: 16534 - protein, 122 aa, Prosthecochloris aestuarii DSM 271
MDQLIQVVEAAQERQDLPEIRPGDTIKMQLRVIEGEKERLQAYEGVIISDSGAGTNRTITVRKISNGVGVERIIPLNSPNIESIEVRKYGKTRRAKLSYLRKRTGKAALRVKERKVSAPAGK

SEQ ID NO: 16535 - protein, 371 aa, Oryza sativa (indica cultivar-group)
MSTTAKLLALAVFAAAAILSLDSRSDVRQLEIRDGDVELIPLLNGAAGPESIVFGDAGEGPYTSVSDGRVLKWLPPPERRWVEHSCSVPELLDSCRGSKDTKREQECGRPLGLKFNSKTGELYVADAYLGLRVVSPGENVSRPLVPKWTESPFSFSNGVEIDHETGVIYFTETSTRFQRREFLNIVITGDNTGRLLKYDPKENKVEVLVDGLCFPNGLAMSNDGSYLLLAETTTGKILRYWIKTPKASTIEEVVQLPGFPDNIKMSPRGGFWVGLHAKRGKIAEWSISYPWLRKVILKLPAQRIQRITSFLTGFGRQVIALRLSEDGKTIEAMSVHGDVRKLFKSISEVEEKNGNLWIGSVLSPFLGLYRI

SEQ ID NO: 16536 - protein, 270 aa, Glycine max
MCIALFLWQAHPLYPFLLLNNRDEYHNRPTKPVSWWEDIDIVGGRDEIAGGTWLACSREGRVAFLTNVLELRSLPEAKSRGDLPVSFLKSGKHPKEFAESLKMEAHYYNGFNLIVADIPSKCMVYISNSPKGQPITIKEVSPGLHVLSNAKLDSKWHKAQRLEVGFKEQLAKYGEGEIPVKEVVHKLMKDKTKADNSHLPHICSLDWEFNLSSIFVEVETPLGLYGTRSSAALIVTSSEEVSFFEAYLDEGMWKEHLIDFHIQKMTKGHT

SEQ ID NO: 16537 - protein, 222 aa, Synechococcus sp. CC9311
MPAADAAFIDELRFNDKGLIPAIAQDWLDGAILMQAWMNRAALELTLSTGEVHYWSRSRQEMWHKGATSGHIQHLKGFRYDCDADVLLLTIEQDGDVACHTGARSCFYDNGPVPSEGGHEAAAPPADACTELMRVIEDRRNCPDEGSYTNRLLEGGDNQILKKIGEESAEFVMACKDNNANEIAGEAADLIFHLQVALAHHNVSWRDVQAVLANRRGAPRRS

SEQ ID NO: 16538 - protein, 644 aa, Rhodospirillum rubrum ATCC 11170
MAAFCGVVRMDDEPADADEAASMAGAFAAAPGGRPTLRRDRAGAFAAVSLPLTPEDRFDRQPWTGRDGRITLLFDGRLDDRAGLIDRLGLDGKRAEGMADGALVAAAYERWGTAILAGLAGFWVLAVWDAAARRLVLARDPMGGRSLFYHRQGPVITFAASTLALLRLPRVERVLDETVLGDLLMLTMGERDRTFYRDISRVPSAHLVVCTPEGTVIDPFWHPPVGGELRLPRDEDYVEAARELLERAVRANLRSLRPVAVLGSGGLDSAGVAATAARLLAPRPLPLYCRVPPTDWSGPELSTSYPDERPKLAALAALHPNLRVMSVEQAGPHRFDEDQTCLFQRYGLAARAADNIGWLLGAVDQARAAGHRVLLTGDYGNTTLSAPGRGAPMALLRQGRLMALARELAGWRRQRGWSWPKVARETLLYRIPGLSPLRSLGRNPGSWRSWTLTRPEAVRALGLEARARAAGAPGFPMPTTTPAASRALILERYGRLRGDLAAQTTAVDGFELRSPLAYLPLVEFTLRVPSPQFCRDGRLRWLARRTLADRLPPEILMEDRLGAQHPEWFDTLSSLRESYQADLPRLAKSPLVATLLDLERAGHLLDSWPDIARDAAPRHHDHALALVRGLHVARFVRWNEGGND

SEQ ID NO: 16539 - protein, 128 aa, Synechococcus sp. CC9311
MGRHLIENNASSTRVMRHIISVALVALIGLIMPSFALAADVAHGEQVFSANCAACHMGGGNVVNGQRTLKQDDLKAYLSDYNDGHESAIAHQVTNGKNGMPAFGSKLGSDDISDVAAYVESQSVKGWA

SEQ ID NO: 16540 - protein, 236 aa, Haemophilus influenzae R2866
MTEKNKPICVVLTGAGISAESGIPTFRSEDGLWAGHKVEEVCTPEALQKNRAKVLDFYNQRRKNAAAAKPNAAHLALVELEKAYDVRIITQNVDDLHERAGSSKVLHLHGELNKARSSFDESYIVDCFGDQKLEDKDPNGHPMRPYIVFFGEMVPMLERAVDIVEQADVVLVIGTSLQVYPANGLVNEAPRKAPIYVIDPNPNTGFVRKQVIAIKEKAGEGVPKVVAELLENTKNS

SEQ ID NO: 16541 - protein, 764 aa, Salinibacter ruber DSM 13855
MQLWPVGLIVSEVCGLIFVVHVERCRLLCAFELSLCCMDASSPSSIDTSPQNRGDRHIQPGKPYPRGATWDGIGVNFALHSAHADRVELLLFEDADDREPAVTFELPEHTGPIWHGYVTNVRPGQLYGYRVYGPYDPANGHRFNPNKVLLDPYAKAIGRPLRWDDSLFGYDVDAEEDDRSFNTQDSAPHAPLAAVVEETFAWGNDQSPEIPWQDTLIYETHVKGMTQKHPDVPERLRGTYLGMASEPVLDHLKTLGVTTVQLLPVHAKLHRRELLRKGLREYWGYNTLSYFAPEPEYAANGPTSAVRDFKMMVRALHDAGLEVIIDVVYNHTCEGNQMGPTLSWRGVDNRTYYKLNPDDERYYMDYTGTGNTLDPGDSYVLQMIMDSLRYWVTEMHVDGFRFDLASALARELYDVDMLGSFFKVVQQDPVLSQVKLIAEPWDVGPGGYQVGSFPWQWAEWNGRYRDTIRRFWRGDRGMNGDVATRVTGSSDLYERSGRRPFASINFVTAHDGFTLQDLVSYERKHNEENKEGNEDGHDDNHSTNCGVEGPTNDPEVIERRERRKRSIMATLLLSQGVPMILGGDELSHTRRGNNNPYCQDNEISWYDWDLDEREQKFLEFVQRLTAFRQEHPSFRRRHFLDPVDESDGSGDVLWWHPDGREITDGDWHDEGLHAFGYLLRGQNLAPDSQGRPRTDDSFLVLMNQGGAPVEVEVPAETNELDDVHCAAWHVVPELAEFLDDPGPVEPGGVLTLRPHRLLVLRAEP

SEQ ID NO: 16542 - protein, 342 aa, Frankia sp. EAN1pec
MRLAVIGGDGIGPEVVAEGLRVLRAVHPKVETTDYDLGARRWHETGETLPDSVLAELRGHDAILLGAVGDPGVPSGVLERGLLLRLRFELDHHVNLRPVRLYPGVTSPLAGDPAIDMIVVREGTEGPYAGAGGTLRRGTPQEVATEESLNTRFGVERVVRDAFARASRRPRAHLTLVHKTNVLTKAGDLWARTVAEVGAEFPAVSVDYQHVDAASMFFVTDPARFDVVVTDNMFGDILTDIGAAITGGIGLAASGNLDPSGANPSMFEPVHGSAPDIAGQGLADPTATVASVAMLLDHLGHADEAARVEGAVAASLAARAAAGGARRSTREIGDDLATRAAG

SEQ ID NO: 16543 - protein, 580 aa, Magnaporthe grisea 70-15
MSVGEFLAKQLTAQKLFFNISFWGFHIGIFAYGWYKQFSDPRLAGLNTLTFSVWISRGAGLVLSVDGMLILLPVCRTIMRWIRPKIRFIPLDENIWFHRQIAYAMLIFSITHTAAHYVNFFNVERLQIRAQTAVQIHYAQPGGATGHMMLLCMLLMYTTAHHRIRQQSFETFWYTHHLFIPFFLGLYTHTVGCFVRDTVEPHSPFAGDEYWNHCIGYLGWRWELWTGGFYLLERLYREIRARRETKITRVVRHPYGEFFFFLFFLLFGPSMVGFSVLIRDSADVVEIQFNKPSFKYKAGQWLFLQVPSVSKYQWHPFTITSCPYDPYVSVHVRQVGDFTKALGDATGAGAAQAKLYEGVDPMGMYEVALQNGQQMPMLRIDGPYGAPAEDVFENEIAVLIGTGIGVTPWASILKNIWHLRNGPNPPTRLRRVEFLWVCKDTSSFEWFQTLLSSLEQQSTDAAGLPGGNGVEFLKIHSYLTQKLDMDTTQNIVLNSVGAALDPLTELKSRTNFGRPNFAKLFASMRDGIMDRTYLSGLEGSMKTTVGVYFCGPSAAARDIKAACKTASVNEVEFRFWKEHF

SEQ ID NO: 16544 - protein, 223 aa, Triticum aestivum
  misc_feature (179)..(179): Xaa can be any naturally occurring amino acid
MRQEAASLVITHEDDRQHHHSRPPPPDEEEEDTGAVAPPSCATILLRREGGEAEAGEGEEPLQLVPPLNFAMVDQGVYRSGFPDASNLPFLETLRLRSVLCLCPEPYPEANQEFLRAHGIRLFQLGIDGSKEPFVSIPEDRIREALKVILDTRNHPVLIHCKRGKHRTGCVVGCLRKLXRWCLTSVFDEYQRFAAAKARVSDLRFIELFDVSSLKHLPASFSC

SEQ ID NO: 16545 - protein, 419 aa, Bacillus cereus ATCC 14579
MIEIKVPELAESITEGTISQWLINVGDKVEKGGSVVELETDKVNVEIIAEDSGIVSKLLGEPGDTVEVGATIAILDANGAPVAVSTPAPAAEQPKQETAETPKAAAPSAEQTATLQGLPNTNRPIASPAARKMARELGIDLNDVRSTDPLGRVRPHDVQAHAAAPKEAPAAPKSPAPAPVAKTEFEKPVERVKMSRRRQTIAKRLVEVQQTSAMLTTFNEVDMSAIMELRKERKDAFEKKHDVRLGFMSFFTKAVVAALKQFPLLNAEIQGDELIIKKFYDIGIAVAAPDGLVVPVVRDANQLNFAEIESEIRELGKKARDNKLSLKELQGGTFTITNGGVFGSLMSTPILNSPQVGILGMHKIQVRPVAIDNERMENRPMMYIALSYDHRIVDGKEAVSFLVAVKDMLEDPKSLLLEG

SEQ ID NO: 16546 - protein, 347 aa, Rhizobium leguminosarum bv. viciae 3841
MTKVRALVLERQHELALRDIDLPLETGPGEVKIRIHTVGVCGSDVHYYTHGKIGPFVVNAPMVLGHEAAGTVVEVGAGVTHLKVGDRVCMEPGIPDPNSKASRLGMYNIDPAVTFWATPPIHGVLTPEVVHPANYTFKLPDNVSFAEGAMVEPFAVGMQAATKAKITPGDTAVVLGAGPIGTMVAIAALAGGCARAIVADLAQPKLDIAAQYQGVIPVNIREKNLAEEVARLTDGWGADVVFECSGSPKAWETIMALPRPGGVIVVVGLPVNPIGFDVSTASTKEIRIETVFRYAHQYERSIALLGSGRVDLKPLISETFKFDDSIKAFDRAVEARPSDVKLQIVME

SEQ ID NO: 16547 - protein, 982 aa, Burkholderia xenovorans LB400
MSDMLNSSTGGCGSGNCACKAQAQQQRSPRSFFDDTDYGTPERHADIDVTLEIDGQSVTVPAGTSVMRAAVEAGVNVPKLCATDSLEPFGSCRLCLVEIEGKRGYPASCTTPVEAGMKVRTQTDRLQSLRRNVMELYISDHPLDCLTCPANGDCELQDMAGVTGLREVRYGFDGANHLKDKKDESNPYFTYDASKCIVCNRCVRACEETQGTFALTIAGRGFESRVAASENVPFMESECVSCGACVAACPTATLQEKTVIMLGQAEHSVVTTCAYCGVGCSFKAEMKGNQVVRMVPHKNGQANEGHACVKGRFAWGYATHKDRITRPMIRAKITDPWREVSWEEALTYAASEFRRIQAKHGRDSIGGITSSRCTNEETYLVQKLVRAAFGNNNVDTCARVCHSPTGYGLKTTLGESAGTQTFASVDKADVIMVIGANPTDGHPVFGSRLKRRVREGAKLIVVDPRRIDIVDTPHVKASHHLQLRPGTNVAVVNALAHVIVTEGLVNEAFVAERCETRAFEQWRDFVALPENAPEATEAATGVPAQAVREAARIYATGGNAAIYYGLGVTEHAQGSTMVMGIANLAMATGNIGREGVGVNPLRGQNNVQGSCDMGSFPHELPGYRHISDTVTRTLFEEAWNVTLQPEPGLRIPNMFDAAVHGTFKGLYCQGEDIVQSDPNTHHVSAALSAMECIVVQDIFLNETAKYAHVLLPGSSFLEKDGTFTNAERRISRVRKVMPPVPGYADWEVTVLLARALGYEMDYTHPSQIMDEIARLTPTFHGVSYKKLDELGSIQWPCNENAPDGTPTMHIDTFVRGKGKFVITKFIATPEKVTRKFPLLLTTGRILSQYNVGAQTRRTENSRWHDEDRLEIHPHDAEERGIRTDDWVGIESRAGQTVLRAKVTERMQPGVVYTTFHFPESGANVITTDSSDWATNCPEYKVTAVQVMPVEQPSQWQRDYSRFNTEQLDLLKQRELANATSGK

SEQ ID NO: 16548 - protein, 429 aa, Bacillus cereus ATCC 10987
MKKFDKSIAAFEEAQDLMPGGVNSPVRAFKSVGMNPLFMERGKGSKVYDIDGNEYIDYVLSWGPLIHGHANNRVVEALKAVAEKGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLEFFAAYYREMVEQGVFLPPSQFEGLFLSTAHSDADIEATIAAAEIAMSKLKA

SEQ ID NO: 16549 - protein, 115 aa, Oryza sativa (indica cultivar-group)
MAVAIEAPFHVLAVDDSLPDRKLIERLLKTSSFQVTTVDSGSKALEFLGLHDHEDSPISTQSDQQEVGVNLIITDYCMPGMTGYDLLKKIKESSYLRDIPVVIMSSDNIPSRINR

SEQ ID NO: 16550 - protein, 522 aa, Oryza sativa (japonica cultivar-group)
MDKAMAFIPPRDLVVVLPFLALLLPLYIYLRYSRSAKANPSLPTEWPLVGMLPSLVANIHNLFDYATALLAASGNSFEARGPPMSSLRFFVTCDPDNVRHIFINNFANYPKGEEFASFFDVMGDSFFNADGESWRRQRARVQHVMSNPRLLASMAACCRGKVEKGLLPILDRMASAGAPFDLQRLLTRFAFDVTAMAVFGVDTCRLSIDMPPLDVANAMDAVMEVGFFRHTVPVSCWKLMRSLRIGPERKLTAAQRLLRRFVAEMIEKRRVAGGACKATDDEQGGVPPPADIVSSYINDPEYVDEDGNPREFMYATFINYMVAGRDTVGTALSWLFFNLTEHPRVVARIREELEPIASSKAGGGGMVVFDPEETKPLVYLQAALFESMRLYPPGPIERKATLAEDVLPSGHTVRAGDNILIPVYSMGRMASVWGKDSGEYRPERWVTEDGKLRHVPAHRFMPFNAGPRLCLGKDISVLQMKSVAAAVAWNFDLEVVAGHAVEPKVSIVMQIKNGLMVKVKKR

SEQ ID NO: 16551 - protein, 322 aa, Silicibacter pomeroyi DSS-3
MTDRSSFIDTARQVVLDEARALDALSESLGDGFAEAVELILRTKGRVIVSGIGKSGHIGHKIAATLASTGTPAYFVHPAEASHGDLGMLSGDDVVLAISNSGEAPELANLLAFTRRFAIPLIGLSSKSESSLMQQADVHLLIPALGEACGFGMVPSISTTLTLAMGDALAIALMKYRDFRPENFRVFHPGGKLGARLSRVSDLMHGGEAVPLIAADTPMSEALLEISRKGFGVVGVTDGAGHLAGIVTDGDLRRHMSGLLDKTAAQVMTANPTTIAPDSLAEEAVAIMNARKITSLFVVDPAEPGVARGLLHIHDCLRVGLG

SEQ ID NO: 16552 - protein, 725 aa, Oryza sativa (japonica cultivar-group)
VEAVVMPERYALGGACRVLAGMPAPLGATALDGGVNFAVYSAGASAASLCLFTPDDLEADEVTEEVPLDPLFNRTGNVWHVFIEGELHNMLYGYRFDGMFAPHCGQYFDVSNVVVDPYAKAVISRGEYGVPGPGGDCWPQMAGMIPLPYSTFDWQGDLPLRYPQKDLVIYEMHLRGFTKHSSSNVEHPGTYIGAISKLDYLKELGVNCVELMPCHEFNELEYFSCSSKMNFWGYSTINFFSPMIRYSSGGIRNCGRDAINEFKTFVREAHKRGIEVIMDVVFNHTAEGNEKGPILSFRGIDNSTYYMLAPKGEFYNYSGCGNTFNCNHPVVREFIVDCLRYWVTEMHVDGFRFDLASIMTRGCSLWDPVNVYGSPVEGDMTTTGTPLATPPLIDMISNDPILGDVKLIAEAWDAGGLYQVGQFPHWKIWSEWNGKYRDIVRQFIKGTDGFAGGFAECLCGSPHLYQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNNNTYCHDHYVNYFRWDKKEESSDLQRFCSLMTKFRKQCESLGLADFPTAQRLHWHGHQPGKPDWSETSRFVAFSTKDETKGEIYVAFNASHLPAVVGLPERPGYRWEPLVDTGKPAPYDFLTDDLPDRAHAVHLFSHFLNSNLYPMLSYSSIILELQPDD

SEQ ID NO: 16553 - protein, 484 aa, Silicibacter pomeroyi DSS-3
MKFQPEASHFINGAYVEDTAGAVIDVIYPATGEVIARLHSATPAIIDQALEAARQAQAQWAAMTGTERGRILRRAADIMRARNHDLSVIETHDTGKPIQETTVADATSGADALEYFGGLAGSLTGEHIPLGGGDFAYTVREALGVCVGIGAWNYPTQIACWKGAPALACGNTMVFKPSETTPLSALKVAEILIEAGAPKGIYNVVQGYGDVGASLVTDPRVAKVSLTGSVPTGRRVYAAAAESIKHVTMELGGKSPLVVFDDADIENAVSGAILGNFYSSGQVCSNGTRVFVQKGIKEAFLSRLAERLATAVIGDPMDPATNFGPMVSEAQMNIVLGYVDKGKAEGARLVYGGTRLDRDGFYLLPTVFADVTDDMTIAREEIFGPVMSVLDFDTEEEVLERANATEFGLAAGVFTRDITRAHRMVAGFEAGTCYINSYNLAPVEAPFGGSKQSGVGRENSKLAINHFSEMKTVFVSMNDIQAPY

SEQ ID NO: 16554 - protein, 520 aa, Bordetella parapertussis 12822
MNAMLTFLRLLRILLVSLRYGLDELVLSSLNHPLATCLLRVMRLGTRPRAPRGVRLRMALESLGPIFVKFGQVLSTRRDLIPADIANELALLQDRVPPFPSAQAAASIEAALGAPPAQLFAQFDVDPVASASIAQVHFAVLHDGREVAVKVLRPGMLNVIEKDLALLRVVAGVIERLGADGRRLKPREVVAEFDKYLHDELDLVREASNCSQLRRNFGPESGRGEMLIVPEVVWEYTASTVFTMQRMYGIPVGQVDRLRAAGIDIPTLARSGVEIFFTQVFTDGFFHADMHPGNIYVSDAPQTLGRYIALDFGIVGSLSEFDKNYLAQNFLAFFHRDYRRVAQLHIESGWVPPETREEELEGAVRAVCEPYFDRPLAEISLGQVLLRLFQTSRRFNVEIQPQLVLLQKTLLNVEGLGRQLDPNLDLWKTAKPYLEHWMRQRIGLTGLRQSLAKEAGQWSQMLPSLPRLVHEHFSRPNLTPHLLAEMNRLRRAQEQGNRLTAALTAVLAVAVAVALWALNR

SEQ ID NO: 16555 - protein, 472 aa, Allium sativum
MSTSNGSTENIQKPLRKIPDITGTPILTAIKDRLDFFYNQGQYEYFQSRVKKNNSTILRMNMIPGPFASNPKIVALCDAASFPTLFDPSKVSKVNSLTGNYMPALSFTGGYRVCAYLDPSEPTHTKIKQVFFNAQAAKKDTFIPTFVSTFNSMFDKMDAEVESKKKAEFTKFNEAAVFEFVGLALVGPKPAREVFDSAKKSVFFQFHPFITAGLPALVEELAFHMFPFPSFVAKSSYKILYEYFSTGGSWILDNAEEIGLSREEAIHHLIFTWAINAYLGIRTCLMRLFKWIVASGPDLQEKLAREVRSVVRSEEGKITFAGIEKMELVKSVAYESFRFDPPVQVQYGTAKSDLIIESHDGKYQVKKGEMLCGFQPMATRDPKVFDRADEFVPDRFMGDGKKLVKHVLWANGYGTDAPKADDKICAGKDLGVLVGRLLIAVMFLRYDKIGGVVGKTMEEVDVIVNELTKVAV

SEQ ID NO: 16556 - protein, 353 aa, Salmonella typhimurium
SQKYLLIDRDGTLISEPPSDFQVDRFDKLAFEPEVIPVLLKLQKAGFKLVMITNQDGLGTQSFPQADFDGPHNLMMQIFTSQGVSFDEVLICPHLPADDCDCRKPKVKLVERYLAEQAMDSANSYVIGDRATDIQLADSMGITGLRYHRETLNWTMIGEQLTKRDRYAHVVRNTKETQIDVSVWLDREGNSKINTGVGFFDHMLDQIATHGGFRMEITVKGDLYIDDHHTVEDTGLALREALKLALRDKRGICRFGFVLPMDECLACALDISGRPHLEYKAEFTYQRVGNLSTEMIEHFFRSLSYTMGVTLHLKTKGKNDHHRVESLFKAFGRTVRQAIRVEGDTLPSSKGVL

SEQ ID NO: 16557 - protein, 265 aa, Arabidopsis thaliana
MAYPKGINKAHDSFSLFLNVPDNESLPTGWRRHAKVSFSLVNQGSEKLSQRKVTQHWFVQKAFTWGFPVMITHTELNAKMGFLVNGELKVVAKIEVLEVVGKLDVSKESSPIMKTIDVNGFQVLPSQVDSVKRLFEKNLDIVSKFRLKNPYLKTACMNLLLSLTETLCQSPQELSNDGLSDAGVALAYLIETGLKLDWLEKKLDELKEKKKKEESCLVRLREMDEQLQPFKKRCLDIEDQISKEKEELLAAREPLSLYDDIDNNV

SEQ ID NO: 16558 - protein, 148 aa, Bacillus subtilis
MEKTFIMVKPDGVQRQLIGDILSRFERKGLQLAGAKLMRVTEQMAEKHYAEHQGKPFFGELVEFITSGPVFAMVWEGENVIEVTRQLIGKTNPKEALPGTIRGDYGMFVGKNIIHGSDSLESAEREINIFFKNEELVSYQQLMAGWIY

SEQ ID NO: 16559 - protein, 459 aa, Aspergillus oryzae
MSSAIGKKALLLGAGFVCEPAVQALSEAGVQVTVACRTLSVALALAANYKSTTAIALDVANEPENLRAAISQTDIVISLIPYVHHALVISAAIQYSKPVVTTSYISPALWALDDQAKAAGITVLNEIGLDPGIDHLYAVKTIDEVHKAGGQVKAFTSYCGALPAPEHSDNPLGYKFSWSPRGGLLALLNSAQWYRDNDIATVDGKDLMAAASPQRIFPGFNLVGYPNRDSVGFRDFYNIPEAHTVFRGTLRYAGFPEIIRALVSIGYFSQERMAALERSGTTWVQLTASLLGLSESSSPKDVQNAVRRKIEAFVTDKDDVDRALSGLRWIGLFDPTPVVGHGTPLDTLCAVLETRMAYQPGERDMIVLQHIFDIEHADGSVEKRSSTLVEYGEPLGPGYRSAMAKLVGLPCAVGVLAVLEGRIPATGMVAPWSSAEIASLLRDELKDKFGIELKERVIT

SEQ ID NO: 16560 - protein, 1159 aa, Aspergillus oryzae
MATLNSLKEALGQKAVTTPSSSRQQLSDTQYSAGFDIFAGGPEYQDFIIPQLPQLLAPLFNSRLHVSVLEIGPGPKSVLGYLPHSLRKKVRRYAAFEPNELFATKVEKWLCTSLEAEFPLPCLASPPGIHRLPFVLNSNINSDASTSTNISDERFDLVLFCHSMYGMKPKDKFIEQALEMLVEAPQGGMVVVFHRDGTLSLNGLVCHRTACFPTGAIRVLDEDEVLDNFASFVAGFVMEDTEADKATRLEWRKVCRALGRREEAYPDHLLFSSPSVMAAFTQHATTLPELTAQVPLVKDKTVKNREAFHHGSASIVRPTEVQHVQQCVQWARKHEVGLTVVGGGHSGQCLWPNVVSVDMSAFDHIHILTAGKDGGESSSASVVIAGAGCKTGDIVRKTMAAGLTVPLGARPSVGAGLWLQGGIGHLARLYGLACDAIIGAVVVSVDSGEALCIGHVPSQHRPAGAVRPKNEYDLLWAIKGAGSNFGIVVSITFKAYVAPVHLIRSWVIPLSDSLEARRRLSDSDNLIASKLPRNCSADAYLYWEFGQLHLGITMFEASTTRLISDTSTPTPPPVDVDTILGLDGKIDVVDGIGLFDAEMYMSQMHGGHGGCKTSAFKRCVFLKNIGAVNVADILTTAVGTRPTPLCYLHLLHGGGAVSQVASGATAFGCRDWDYACVITGVWPRDQDGTEIAHAVERWVYNVARDLLPLSSGVYGADLGPDPRDAILAAKAFGPNRPRLARLKHCSDPHNVLAYACPLPRVSMKQRLIILVTGDSCAGKDYCADIWVSALLAYNHKGLTARAVSISDATKREYATATGADLNRLLSDRAYKEQHRPALTAFFQDQVRHRPRLPEEHFLNVVDSAADVDVLLITGMRDEAPVATFSHLVPDARLLEVRVQAGEEMRRARGGCHGSDDDSNDNKNNDNGRLNLTALDHHPDLIFHNDTTGDKAAKAFADYYLLPFCHEDLQRLTDMVRQVPDFPRLGIEFRHVLDISQQPGGLTLCTSLLQSHFTGDWAKVDAVACCEAGGFVYASALASQVGVPLALIREAGKLPPPTISVAKSPSHVSLSTSNGMNEKRIEMARGLIPRGGSVVVVDDVLATGNTLCAVLQLLDEAGISSKDVTIMVVAEFPLHRGREFLRQRGFGGVKIQSLLVFDGA

SEQ ID NO: 16561 - protein, 534 aa, Ralstonia metallidurans CH34
MSAPLLISSIIRHAARYYGSTEIVSRRTEGDLHRYTYRDCELRARKLAQALGALGVQQGERVGTLAWNGYRHLEIYYGVSGMGAVCHTINPRLFPEQIAYIVNHADDQYVFFDSTFLPLVEGVAPHCPNVKGWVMMSDRAHMPAESKVDLICYEDLIDAQDGNYEWPQFDENQASSLCYTSGTTGNPKGALYSHRSTVLHSYASALPDALGCSARDVILPVVPMFHVNAWGLPYSVPLVGAKLVLPGPKLDGASLFELFEQEGVTFSAGVPTVWLGLLQYVQANKLKFSTFRRTVIGGSAAPPAMIRALEALDVEVIHAWGMTEMSPLGTSCKLLARHLDLPEEARHKIVEKQGRVIYGVDMKIVDGEGKELPWDGKAFGDLYVRGPWVIDHYFRNDNSPLVDGWFPTGDVATIDEEGYMQITDRSKDVIKSGGEWISSIDVENVAAAHPAVHMAACISAYHPKWDERPLLVVVKRPNMEITREELLGFFEGKVAKWWIPDDVLFVSEIPLTATGKMQKLKLREQLKDYKLPTA

SEQ ID NO: 16562 - protein, 374 aa, Coprinopsis cinerea okayama7#130
MQMAIQTPSTTTAAVAKANGSSSSPGAPTKVVGNAPLDASKLVVTLAKTLKPLPDPESLVFGQTKTDHMLTVHYNPKTGWQTPEIRPPERNMERMAQSAARVALPPFDTSALLELIKQLVRVEKRWIPTQPGYSLYIRPTIIGTRDALGVSASDSALIYAVVTPAGPYFKGESRAISLLAVSETVRAWPGGTGGYKLGLNYAPGFAPQREALQKGYDQILWLLGDKITEVGAMNVFVIVKRDDGDLDAFTPPLDGTILPGLTRASVLQLLQAHTSPSHTFNLPNTPSSLKIHTTERVLTMSEIVAWSEQGKLLEVFGVGTAVVVCPVGKIGYEGKDMTLPRHEGGLGPVAKAVSDAIISIQTGRQEFEGWSVPV

SEQ ID NO: 16563 - protein, 525 aa, Mycobacterium avium subsp. paratuberculosis K-10
MIHPRLPDLSFFRYVSVNSKLRCGSGPAPIAASRRRPMTKNSDHRCYDELFIGGQWRKPANPQQLDVISPHSEQPIGHAQAAGPEDVDAAVAAARRAFDHGPWPRMSHAERMAKIEQLATIYAAHMDEMADLITDEMGSPRSFSRMGQGAAAATLIHLTLAAARDFPWTERRQGVLGEVHLHRAPVGVVGAIVPWNVPQFLIMPKLIPALIAGCTVIVKPAPETPLDALWLAEMIEQLELPQGVVSVLPGGTDVGEALVRHPGVDKIAFTGSSAVGRRIAALCGERLKRVSLELGGKSAAIILDDADIDKTVAGLKSAGLMNNGQACVAQTRILVSDRKHDEVVDALAAMMAELNVGDPADESTDIGPLVAQRQQRRVQEYIKSGRSEGARMVLGGEDSPAGRGWYVRPTLFADATNDMRIAREEIFGPVLTVLRYRDEDDAIRIANETDYGLAGSVWTADVAHGLEVAAAVRTGTYGINMYTLDIGAPFGGFKQSGIGREFGPEGLHEYVELQTLVCKGQLPPL

SEQ ID NO: 16564 - protein, 355 aa, Yersinia pseudotuberculosis IP 32953
MGQQVLSHQSVSSQWLANQSATSTLPLLDLSLLSGSDTERQAFLTALRHAARDVGFFYLTGHGIDTSLLRQIQILSRQFFALSDEEKLSIAMIRSPHFRGYNRAASEFTRGQPDWREQFDIGAERTPLPQIAGAPSWTRLQGPNQWPTALPELKPVLLQWQEEMTRMSLRLLRAFALALDLDEQAFDALYGDKPNEHIKLIRYPGREATQSGQGVGAHKDSGFLSFLLQDTQRGLQVEVEEGQWIDAVPREGTFVVNIGELLELASNGYLRATVHRVETPPAGIDRLSIAFFLGARLDAVVPLYPLSAALAAEARGPASDPHNPLFRDVGLNYLKGRLRSHPDVAERYYSDALCS

SEQ ID NO: 16565 - protein, 743 aa, Silicibacter pomeroyi DSS-3
MHVAGSPDVDHLSEYERRYSRRGLLIRYARGRVRNFAGRQIMTFAGSFILAMTEGLHTAMLAAFAALLGEVIDCLYLHRLPERLRQGQGYRRLLIGSTLTALVQALTISFCVWLAWTGARSGLSPLFIGSFLAGAAINAGLVLPFHRPAAVARLAVYAGIGQYLFLIEAMEPGRLGDALLLNAAGAVMLAFMVGLFLNFVNWGFRQHRRTTLDLIEQGRDLLRHQKEAQLLSLVARNANDSVILADSEGRIVWTNESFTRTTGYSLDEAKGRYPGELLNGDKTDLEVSNAIADAVEAGRPFRTEILNVTKDGREIWMETNLVPVLDRNGKVEVTVAIERDVTAAKAQAEELAAARVAAEEGARAKAEFLATMSHEIRTPMNGVVGMAELLSETKLSIEQRQYVDTIRSSSTALLAIINDILELSRLDARKMELHPVNFDPVSCVRDTMRLLKPQAQAKGLRLSLETGADVPPLVYGDDGRLRQVLINLLGNAIKFTERGGVTLRLRSEAQDPGYLLTLEVEDTGIGIAAEKIERVFERFSQADADTTRLYGGTGLGLTISRELVALMGGRITVDSTLGQGSCFTLCLPLGSPDDDAGQSDGQVLSPAELDRLRGLRVLVADDNRVNRLLMGKFLADLPIRLDFAHDGQQAVAMTQRQKPDIVFMDMSMPVMSGIEATRQIRAAEGRQPLIVALTANTFDSDREACLAAGMDDFLSKPVGRADLFRCLLHHLPPTDAAPRTASG

SEQ ID NO: 16566 - protein, 393 aa, Idiomarina baltica OS145
MSVIAMTDLDLQNKRVLIREDLNVPVKDGKITSDARLRAALPTIKLALEKGAKVMVMSHLGRPTEGEYEEQYSMAPVADYLNDALEQPVSLAKEYLDGIDVAQGQVVVFENVRFNKGEKKNDDALAQQLANLCDVFVMDAFGTAHRAQASTHGVAKYAPVACAGPLLAAELDALGKALDNPKRPLVAIVGGSKVSTKLTVLESLSTVVDQLIVGGGIANTFIAAQGHNVGKSLYEKDLVPEAQRLMAAAKAKNAEIPLPVDVVTGQAFSADTVAETKAVESIKDSDMVFDVGPKTSEMLAEKLKAAGTIVWNGPVGVFEFEAFSKGTESMANAIASSEAFSIAGGGDTLAAIDQFNIADKISYISTGGGAFLEFLEGKKLPAVEILEQRAQDA

SEQ ID NO: 16567 - protein, 333 aa, Paracoccus zeaxanthinifaciens
MNVQEDVRKPLDRLAEALAPEMEAVNALIRERMASRHAPRIPEVTAHLIEAGGKRLRPMLTLAAAKLLGYGGPYHVHLAATVEFIHTATLLHDDVVDESRQRRGRPTANLLWDNKSSVLVGDYLFARSFQLMVEPGSMRTLEILSNAAATIAEGEVLQLTAAQDLATNEDIYLQVVRGKTAALFSAATEVGGVIAGVPDAQVRALFDYGDALGIAFQIVDDLLDYGGTAEAIDKNTGDDFRERKLTLPVIKAVARATPEERAFWSRTIEKGDQKDGDLEHALELLARHGAMADARRDALDWAARARASLQILPEHPIRDMLSDLADFVVERIA

SEQ ID NO: 16568 - protein, 363 aa, Triticum aestivum
  misc_feature (176)..(176): Xaa can be any naturally occurring amino acid
MADDDQQWKIPPNVQELAAAGPEEPPSRYVVRDHDRPALAGAGSDVTDPIPVVDLGRLSSGDADEAAKLRSALQTWGLFLAVGHGIEPALLGEMMAVTREFFNLPLEEKQRYTNLVGDKKEYRIEGYGGDMVLSETQVLDWCDRFYLVVDPESRRLHDLWPTRPPSFRDVLHRYSXRCRELADAVLREAAGAAGLPDQGRLADMLDEKAVTYVRLNCYPPCPRPDRVLGFRPHSDGGALTVLLAETAGLQVRRDDDAGGGGWHDVPVVPGALVVNLGDTVEVVSNGVLRSPVHRVVAGAERGRVSMAMFYTVDPEREVEPAPELVSEERPRRYEKTKKSGDYVRKLLESLARGERAIDKVKVV

SEQ ID NO: 16569 - protein, 661 aa, Idiomarina baltica OS145
MSERRHLANAIRALSMDAVQQANSGHPGAPMGMADIAEVLWRDYLKHNPNSPSWADRDRFVLSNGHGSMLIYSLLHLTGYDLSIDDIKQFRQLHSKTPGHPEYGYTPGIETTTGPLGQGIANAVGMALAEKTLAAQFNRDEHNVVDHFTYTFLGDGCLMEGISHEACSLAGTLGLGKLIAFYDDNGISIDGEVEGWFTDDTAQRFESYNWHVIRDVDGHDADAIKQAIESARSETQRPTLIICKTVIGFGSPNKQGQESCHGAPLGDDEIALARKQLNWSYDRFEVPQDVYQAWDAKDKGDAIEASWNKHWTAYEQAYPELAAELKRRLAGELPGDFESELQAYIEQLQANPENLATRKASLNVLNEVGPKLPELLGGSADLAGSNLTLWQGAKGVTADDASGNYVFYGVREFAMSAIMNGVTLHGGFKPYGATFLMFMEYARNAVRMAALMKQPSIFVYTHDSIGLGEDGPTHQPVEQLANLRLTPNLNCWRPCDAVETAVAWRSALQSNDKPTALVFSRQGMQQQTRDAEQLNNISRGGYILKDCDGTPDSILIATGSEVDLAVAAREQLAAKGMNVRVVSMPSTDVFDDQDAEYREHVLPSAVRKRVAVEAGIADYWRKYVGLDGTVIGMNSFGESAPAKALFEHFDITVEAVVRAAS

SEQ ID NO: 16570 - protein, 340 aa, Paracoccus zeaxanthinifaciens
MISHTPVPTQWVGPILFRGPVVEGPISAPLATYETPLWPSTARGAGVSRHSGGIQVSLVDERMSRSIALRAHDGAAATAAWQSIKARQEEVAAVVATTSRFARLVELNRQIVGNLLYIRIECVTGDASGHNMVTKAAEAVQGWILSEYPMLAYSTISGNLCTDKKASAVNGILGRGKYAVAEVEIPRKILTRVLRTSAEKMVRLNYEKNYVGGTLAGSLRSANAHFANMLLGFYLATGQDAANIIEASQGFVHCEARGEDLYFSCTLPNLIMGSVGAGKGIPSIEENLSRMGCRQPGEPGDNARRLAAICAGVVLCGELSLLAAQTNPGELVRTHMEMER

SEQ ID NO: 16571 - protein, 230 aa, Streptococcus suis
PWTDKDGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYAA

SEQ ID NO: 16572 - protein, 436 aa, Xanthomonas campestris pv. vesicatoria str. 85-10
MSADTATAGVASRLAAARVLTAVFDQGRSLKAELAATLPGIGDPRDRALVEAICFAVIRRRPAYDVALRQWLERALPPRDAELKALLMVGFAQLDVLQLPAHAALSATVDACRALGRPRQAGMVNAILRRAQREGFPAVADDAGWPSWLRKQLRADWGDRAEAIFTASAQMAPMWLRVQRSRTDPARYVARLAELDIVAHTDAVLPDAVRLHNAVPVSQLPGFAEGDVSVQDGSAQQVADALTLAPSARVLDACAAPGGKAAHLLERHPGLQLTALDVDARRLERVQQTLQRTVPDAQVALQAADAADPDAWWDGRPFDAVLLDAPCSATGVVRRQPDVLLHRRADDIDALCALQARLLDATWRTLRPGGQLLYTTCSLLARENQAQVEAFLQRTPDAQAQPLGAQFGHAAGAGRQRFPGEAHCDGFFYALLLKAS

SEQ ID NO: 16573 - protein, 343 aa, Thermus thermophilus HB8
MRALAKLAPEEGLTLVDRPVPEPGPGEILVRVEAASICGTDLHIWKWDAWARGRIRPPLVTGHEFSGVVEAVGPGVRRPQVGDHVSLESHIVCHACPACRTGNYHVCLNTQILGVDRDGGFAEYVVVPAENAWVNPKDLPFEVAAILEPFGNAVHTVYAGSGVSGKSVLITGAGPIGLMAAMVVRASGAGPILVSDPNPYRLAFARPYADRLVNPLEEDLLEVVRRVTGSGVEVLLEFSGNEAAIHQGLMALIPGGEARILGIPSDPIRFDLAGELVMRGITAFGIAGRRLWQTWMQGTALVYSGRVDLSPLLTHRLPLSRYREAFGLLASGQAVKVILDPKA

SEQ ID NO: 16574 - protein, 571 aa, Bacillus licheniformis ATCC 14580
MKGRRRVSHNKLNEQVIETRLRGFEVLATPLLNKGVAFPPEERDALGLTGLLPPKVLTLEEQAKRAYKQFQSQPDDLSKNVYLTALHDRNEVLFYRLLNDHMTEMLPIVYTPTVGTAIQQYSHEYRKPRGLFLSVNDPEGMKTAFENLAAKRSRIDLIVATDAEGILGIGDWGVGGIAISIGKLAVYTAAAGIDPNRVLPVVIDAGTNQERLLNDPLYVGNQHSRIRGERYESFIDQYVQIATETFPGVLLHWEDFGTQNARQILKKYKDKICTFNDDIQGTGAVTLAAVLAAVKISKMPLKDHKVVIFGAGTAGIGNAEQIRAALVQEGVSEEESYRRFWCVDRNGLLTDDMNDLQDIQQPYARPADEVKDFSRNGPGDAIDLLEVVKRVQPTILIGTSTVSGAFTEEIVKEMAKHVKRPAIFPMSNPTPLSEARPEDLINWTEGRALVATGSPFAPVEYSGTRYAIGQANNAFVFPGLGLGTLVSKARLITDNMFYASAAAIAGMVDTGRPGAALLPEVEDLRTVSATVATAVIKAAIEDGVAENEPDDVIQAVQDAMWHPVYRPIRAI

SEQ ID NO: 16575 - protein, 445 aa, Nicotiana tabacum
MAKAVDAAAAAAAAIAPVDTTVVNEDVALVENETCNDQNVQFDSLPSMKYASFLNSDGSVAIHAGERLGRGIVTDAITTPVVNTSAYFFNKTSELIDFKEKRRASFEYGRYGNPTTVVLEEKISALEGAESTLLMASGMCASTVMLLALVPAGGHIVTTTDCYRKTRIFIETILPKMGITATVIDPADVGALELALNQKKVNLFFTESPTNPFLRCVDIELVSKLCHEKGALVCIDGTFATPLNQKALALGADLVLHSATKFLGGHNDVLAGCISGPLKLVSEIRNLHHILGGALNPNAAYLIIRGMKTLHLRVQQQNSTALRMAEILEAHPKVRHVYYPGLQSHPEHHIAKKQMTGFGGAVSFEVDGDLLTTAKFVDALKIPYIAPSFGGCESIVDQPAIMSYWDLSQSDRAKYGIMDNLVRFSFGVEDFDDLKADILQALDSI

SEQ ID NO: 16576 - protein, 213 aa, Oryza sativa (japonica cultivar-group)
MGEEAKAAAAWAEIAVTDAAAVPKPTPPPAAVAVDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVESREYEK

SEQ ID NO: 16577 - protein, 332 aa, Aspergillus oryzae
MTSSHICRAPPAESKPQMSDEGLCKLPGFFYVTNFGLSPEEIDRQFAIGQELFELPESEKLKHRADLEAGNYNGYRPLGAIEILPGLRDNIELYNVFKFIPRYARSHPEVILRHYEEIERFHRFIYDHIVTKLFRLIAILLELPEDYLVNGHPYDGPSDCHLRYMIYRARSAEENARHQNLWSRGHTDFGSLTLLFRQPVAALQVKTPEGAWKYVKPYPNSITVNIADALQFWTNGYLKSSVHRVIAPPPDQAHIDRLGVLYFVRPGDGLDLKTVDSPLLRRLGLKKDEGDEAQVSAGEWVRARVRRNWDKPPKANDENIELGGVKTTIFHE

SEQ ID NO: 16578 - protein, 227 aa, Brassica napus
  misc_feature (36)..(36): Xaa can be any naturally occurring amino acid
SIICLKSPIASDISLKSFSFTYHSLSLSLPFRTSRXESEMTWSVFRSINSPTLDLSAALRSTRSPLFAAGAGCATLAGVSLFRMSSRSPPFASLSVSASASEKKEVVATEKAPAALGPYSQAIKANNLVFVSGVLGLIPETGKFVSDNVEDQTEQILKNMGEILKASGVDYSSVVKTTIMLADLGDFKKVNEIYAKYFPAPSPARSTYQVAALPLNAKIEIECIATL

SEQ ID NO: 16579 - protein, 373 aa, Acinetobacter baumannii
MSRLGVILIMTIKNRREALTQLQAEVDVVIIGGGQAALATAYFLKRKKIPFVILDDQAQAGGAWSHAWESLRLFSPNTWSSLSGWMMPTTEQTYPTRNEVIDYLSAYEQRYQFLIIRPVHVDHIEQKDDYLDVYVGDQYWRAKAVVSATGTWSQPYIPHYKGHERFEGLQTHSAHYLNPEPFINKKVIIVGGGNSGAQILAEVSKVADTTWVTVTPPQFLSDDVDGRILFLRATERLKAQQKGRVIDQPVGGLGDIVMIDSVKEARERGVLHSREPFTSFEEHSVIWADGTRQAVDAVIWCTGFKASLDHLRSMNVVEPDQTVAVNDGRSIKVNSLWLVGYGEWTGMASATLIGVSRTARATVDQIAAYLVNL

SEQ ID NO: 16580 - protein, 351 aa, Staphylococcus aureus subsp. aureus MW2
MKALVKTREGHGNLELLDKEVATPLDDKVKIKVHYAGICGTDIHTYEGHYKVNFPVTLGHEFSGEIVEVGADVKDFKVGDRVTSETTFYVCNECEYCKSKDYNLCNHRKGIGTQVDGAFTNYVIAREESLHHIPDEVSYQSAAMTEPLACAHHGVSKIQVNSGDVAVVMGPGPIGLLVAQVLKSKGATVVVTGLDNDKVRLDKAEALHMDYVVNLQQTDLKTYINGITDGYGADVVVECSGAVPAARQGLDILRKKGFYSQIGIFKDAEIPFDMEKVIQKEITVVGSRSQKPADWEPSLQLMADGLVNAEALVTKIYDISKWDEAYQHLKSGEGIKALLKPLDLDENEGEN

SEQ ID NO: 16581 - protein, 160 aa, Zea mays
  misc_feature (121)..(121): Xaa can be any naturally occurring amino acid
  misc_feature (129)..(129): Xaa can be any naturally occurring amino acid
  misc_feature (141)..(141): Xaa can be any naturally occurring amino acid
MEQTFIMIKPDGVQRGLVGQIICRFEQKGFTLKGLKLITVDRPFAEKHYQDLSAKPFFSGLVDYIISGPVVAMIWEGKNVVLTGRKIIGATNPAASEPGTIPVGDFAIDIGRNIIHGSDSXVESANREXWALWFPGWNLVXNWQSSLHSWDLRMILSIVL

SEQ ID NO: 16582 - protein, 535 aa, Ralstonia metallidurans CH34
MSTTVSPSTSPDPDATPDRIALDPAGTDVTPLYDLTTIRRVEHAGLAATPPFTLMSRAGAAAADWLHAWVPNGRILCLAGPGNNGGDALVAALRLHQRGRLVETWLIGEADLLPADAARAWLEARAAGVPLLALPNDADTGIPPWPNGCAAIVDGLLGIGLNRAADGNMARWIDHLNNSHLPVFSLDIPSGLFADTGAGNPAVRAQRTLTFLAAKPGLLTLDGRDCAGEVDIAPLGLDYPPAEHPVAVVNQPPGFSHSLPRREHADNKGSFGSLAVIGGSHGMTGAPLLGARAALYLGAGRVHVGFLAQPAPAIDPVHPELMLHAVTELSPGAMSAYVVGPGMGTGASARKQLTQLIDICANAATAAPLVLDADALNLLATDGTLAQQLVESGVAHVMTPHPLEAARLLGSTVADIQRNRLAAATALATRWQATIVLKGSGSVIASPDGAPPAINPTGNAALSTAGTGDVLAGMIGALIAQGMPIVAAARAAVWIHGRAADRLVASGTGPAGMTASELYLPARDIFNALLRGGGA

SEQ ID NO: 16583 - protein, 541 aa, Ralstonia metallidurans CH34
MPTDLQAWNALRQHHDVVRETPMQQWFAEAGAAQRVDAFSLEASGLYLDYSKNRITGETLALLMKLAEEAGVPARRDAMFAGEHINATEDRAALHVALRALPDAPFKVDGASVMPAIHDVLRRMREFAGRVRSGVWTGSTGQGITDIVNIGIGGSDLGPRMVCRALAHLADPRGPRVHFVSNVDGTELAETLQRLDPARTLAIVCSKTFTTLETMANACSMRDWFLRHGVAENQLARHFVAVSTNRDAVVDFGIDPNNMFEFWDWIGGRFSLWSSVGLSIALAVGFDAFEDLLLGARAMDDHFRTAPLAQNMPVVMAMLGIWYRNFHDMPTSCMAPYSTSLELFPAFLQQLEMESNGKSVQLDGRPVDADTAPVVWGTAGTNGQHAYFQMIHQGSQIVPVDFVAPLVPPRELPGHHVKLLANCFAQAEALMRGRSAEELQAAGVDAARIPHMVFEGNRPSNMLLMENLTPHVLGALIALYEHRTFVQGIVWNINSFDQWGVELGKILARPIEAELSGNATEAHDASTAALIARARRSLARS

SEQ ID NO: 16584 - protein, 710 aa, Bacillus licheniformis ATCC 14580
MPGISRPFEAYLDEMRTITVLVPKSRASSCSPPFLLEDDQGERIELSVKAQVELEEQFKYVLESSCTVPFGRVHKVCCEESVWTDLQIGSVTRSAAFDKAFFYDGRLGAFYSKGSTLFKVWAPTASAAAIKLEDPDSLQTNTFQMMRRKKGVFEVTVEGDLNGWSYLYELYVNGKPLLTVDPYAKAVTANGEKGVVLDPEEVKVEKHRAPRLHSPCDAVIYEVHIRDFSIHEDSGMRHKGKYVAFTEDGTETSGGFSTGIAYLKELGVTHIEVLPFHDFAGVDELSPDQSYNWGYNPLHFNAPEGSYSLDPQNPKCRITELKTMIQSLHKHGFSVIMDAVYNHVYKRETSPFEKTVPGYFFRHNEYGFPSDGTGVGNDIASERLMVRKYILDSVRYWLEEYDVDGIRFDLMGILDIETVRQISTLAENVKPGVPLFGEGWDLNTPLDSGQKATLQNAGKVPAVGFFNDRFRNAVKGSTFELSDRGYALGDTGKKAALQHGIAGSPGFLQPAQSINYVECHDNHTFWDKMALCFEEDADTKRLRQRLAVSIVLLSQGVPFLHAGQEFCRTKNGDSNSYRSGDDINKLDWEKRAELCEDVEYVRQLIRLRRSHPAFRLQKEEEVKEHLSFMDGTGEVTAYKLKNIAAIDPWNEIIVVHCPFAKKETLKLPDQKQYLLHCDPFTFFNGKVQAEKRLRLNGIGTYVLYEPKGIF

SEQ ID NO: 16585 - protein, 377 aa, Triticum aestivum
  misc_feature (272)..(272): Xaa can be any naturally occurring amino acid
  misc_feature (280)..(280): Xaa can be any naturally occurring amino acid
  misc_feature (293)..(293): Xaa can be any naturally occurring amino acid
  misc_feature (305)..(305): Xaa can be any naturally occurring amino acid
LPAKEAEDNGLPRETVSKGSTRRNGSMKSKDGSNNKEMRETRLSARLSNSSSNGISNGISRVMSVGSNEAAPRRGMVLPFSPLSMCFDDVNYYVVMPAEMKQQGVTDDRLQLLRDVTGSFRPGVLTALMGVSGAGKTTLMDVLAGRKTGGYIEGDIRISGYPKNQATFARISGYCEQNDIHSPQVTIRESLIYSAFLRLPEKIGDQDITDEIKIQFVDEVMELVELDSLKDALVGLPGISGLSTEQRKRLTVAVDLVANPSIIFMDKPTSGXDPRPAAIXVLKTGRNTFDTGXRTLVCPIQQPSXIEFFGGFWMSYLYLKRGGPGNFILWKLCSPLHGKCFAHFGAGFLGVRLRPGLSSPRAPVVLYGDDHSVGKNT

SEQ ID NO: 16586 - protein, 258 aa, Zea mays
  misc_feature (236)..(236): Xaa can be any naturally occurring amino acid
MARTGLADATAPEADAMPAASKDAADVRMISTKELQAHAAADDLWISISGDVYDVTPWLRHHPGGEVPLITLAGQDATDAFMAYHPPSVRPLLRRFFVGRLSDYTVPPASADFRRLLAQLSSAGLFERVGHTPKFLLVAMSVLFCIALYCVLACSSTGAHMFAGGLIGFIWIQSGWIGHDSGHHQITRHPALNRLLQVVSGNCLTGLGIAWWKFNHNTHHISCNSLDHDPDLQHLXPLFAGSTKLLHNLWSVCYERTL

SEQ ID NO: 16587 - protein, 258 aa, Xanthomonas campestris pv. vesicatoria str. 85-10
MTTHRWRLDGQTALITGASAGIGLAIARELLGFGADLLMVARDADALAQARDELADEFPERELHGLAADVSDDEERRAILDWVEDHADGLHLLINNAGGNVTRAAIDYTEDEWRGIFETNVFSAFELSRYAHPLLTQHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAASYITGECIAVDGGFLRYGF

SEQ ID NO: 16588 - protein, 127 aa, Arabidopsis thaliana
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGGYGGGGGHHGGGGHGLNEPVQTKPGV

SEQ ID NO: 16589 - protein, 476 aa, Streptomyces avermitilis MA-4680
MRTAYSVETVRSAERSLMARLPEGALMQRAAAGLAAACAQLLGRVYGRRIVLLVGSGDNGGDALYAGARLARRGAGVTAVLLAAGRAHASGLAALRRAGGSVTGTGPAEELIRRADLVVDGIVGIGGKGGLRPDAALLAESVERSGAAVVAVDLPSGVDADTGEVPGAAVRADLTVTFGTHKPGLLIDPAREYAGSVRLVDIGLELPDGPDLEALQHADVARLLPVPGAESDKYRRGVVGIAAGSARYPGAAVLAVAGALRGGAGAVRYVGPAGDAVLARFPETLVSDKGPKQAGRVQAWVVGPGAGDDAPVVAEVLAADVPVLVDADGLRLAGRDAVRGRTAPTLMTPHAGEAAALLGVSREEVERARLVSVRELAGRYGATVLLKGSTTLVADSGGGAVRVNSTGTSWLATAGSGDVLSGLAGSLLAAGLPALDAGSVAAYLHGLAGRYAADGAPMGAHDLAETIPEAWRDVRD

SEQ ID NO: 16590 - protein, 356 aa, Salinibacter ruber DSM 13855
MSHALSDGPAPSGALESVMTLEQFILDRRGRFPQSTGAFSRLLRDVSVAAKIINHNIRRAGILDVMGESGTVNVQDEKQKKLDEIADRELERALRRGGECCLVGSEEQADTISLSPRGDFQERFAVFFDPLDGSSNTDVNASVGTIFSVYTLPEGADEGDALDVALRPGAEQVAAGYVAYGSSTMFVFTTGNGVNGFTLDPGIGEFLLTHPDLQIPQAPAMYSINEADIEDFSPELRAFLQWLKTKDPDTGHRIRARYIGSFVSDFHRNLLTGGLYMYPATSDHPDGKLRLMYEANPMAFLVEQAGGRASTGHQRILDLQPEGLHERTPLFIGSAPLVKAAEAYLQGRGAEAVGGA

SEQ ID NO: 16591 - protein, 341 aa, Glycine max
  misc_feature (289)..(289): Xaa can be any naturally occurring amino acid
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDALMKILTERGYTFTTSAEREIVRDMKEKLAYIALDYEQELETAKTSSAVEKSYELPDGQVITIGAERFRCPEVLFQPSMIGMESPGIHETTYNSIMNADXIKVVAPPERKYSVWIGGSILASLSTFQQMWIAKAESHESGPSIVHRKCFSIV

SEQ ID NO: 16592 - protein, 319 aa, Rickettsia rickettsii
MTNTNNYRIIAKRVISSEASALEKLSENIPEDFNRIIEFLLSFKGRIILTGIGKSGYIARKIAASFSSTGMPAFYLHPAEASHGDLGMVTRNDIVIMLSNSGETKELFNIIEYCKNSSIKIAAMTMNKNSTLAKRSDFLLIVPEYQEASVIGVPTISSLIMLSLGDALMTVIHEKRGFTKDDFKIYHPGGTIGANLTKIKNLMRSGDEIPLVYEDTSFAKTIIIMNKKRLGCTLVTDKNQNLVGIITDGDLRRHINDQIHLKTASSIMTKNPIHISSEIFAKEALNLMKAKNITNIPIVDDNIIIGIIHIHDLLRIGVS

SEQ ID NO: 16593 - protein, 388 aa, Arabidopsis thaliana
MSAYRGGVNSFAVIGLSSKPLHVYGHPSYRCEWVSLDPTQDPISTTGFKILTDWGYGRIYTTVVVNCTFSSISAVNPQNSGGTLILHATTGDPTLNLTDSISVLTEPPKSVDFDLYNSTKKTKKYDYLYCGSSLYGNLSPQRVREWIAYHVRFFGERSHFVLHDAGGIHEEVFEVLKPWIELGRVTLHDIRDQERFDGYYHNQFMIVNDCLHRYRFMTKWMFFFDVDEFLHVPVKETISSVMESLEEYSQFTIEQMPMSSRICYSGDGPARTYRKWGIEKLAYRDVKKVPRRDRKYAVQPENVFATGVHMSQNLQGKTYHKAESKIRYFHYHGSISQRREPCRQLFNDSRVVFENTPYVLDTTICDVGLAVRTFELRTIGDRLLRTRQ

SEQ ID NO: 16594 - protein, 92 aa, Salinibacter ruber DSM 13855
MFSPDDVDRIVEHMNDAHSEDLIRYAEAYGDVIEAKGARMTGIDAEGFDLEVEQEKATVPVRIDFDAPLDTVDEARAVLVEMAMAARDAAER

SEQ ID NO: 16595 - protein, 411 aa, Brassica napus
MAATAGATPSSHLLLSSSRHVAASPQPRILFPSLSGKRVAVGKNHHATGVRCMAVAADATAETKPAAKKKSGYELQTLTSWLLRQEMKGEIDTELTIVMSSIAMACKQIASLVQRAGISNLTGVQGAVNIQGEDQKKLDVVSNEVFSNCLRSSGRTGIIASEEEDVPVAVEESYSGNYVVVFDPLDGSSNIDAAVSTGSIFGIYSPNDECLPDSDDTSALGSEEERCIVNVCQPGNNLLAAGYCMYSSSVIFVLTLGKGVFAFTLDPMYGEFVLTQENIEIPKAGKIYSFNEGNYQMWDENLKKYIDDLKDPGPSGKPYSARYIGSLVGDFHRTLLYGGIYGYPRDAKSKNGKLRLLYECAPMSFIVEQAGGKGSDGHHRVLDIQPTEIHQRVPLYIGSKEEVEKLEKYLA

SEQ ID NO: 16596 - protein, 337 aa, Escherichia coli
MNVLICQQPKELVWKQREIPIPGDNEALIKIKSVGICGTDIHAWGGNQPFFSYPRVLGHEICGEIVGLGKNIADLKNGQQVAVIPYVACQQCPACKSGRTNCCEKISVIGVHQDGGFSEYLSVPVANILPADGIDPQAAALIEPFAISAHAVRRAAIAPGEQVLVVGAGPIGLGAAAIAKADGAQVVVADTSPARREHVATRLELPLLDPSAEDFDAQLRAQFGGSLAQKVIDATGNQHAMNNTVNLIRHGGTVVFVGLFKGELQFSDPEFHKKETTMMGSRNATPEDFAKVGRLMAEGKITADMMLTHRYPFATLAETYERDVINNRELIKGVITF

SEQ ID NO: 16597 - protein, 119 aa, Zea mays
  misc_feature (102)..(102): Xaa can be any naturally occurring amino acid
MASSFAVATVPSLAAPAAKKRSGGVTYVEGMNAYSGLKGLNKVNMLGVRKTADYSFAKVVASLSPAGRKRRGGAFGAQMNAAAEIFRIAATMNGLVLVGVAXVGVPCCLRVEAAVEESE

SEQ ID NO: 16598 - protein, 149 aa, Crocosphaera watsonii WH 8501
MERTFIMIKPDGVQRGLVGEIIGRFEAKGFTLVGLKSLSVSRELAEEHYDVHKERPFFGGLVDFICSSPVVAMVWEGDGVVASARKLIGATNPLSAEPGTIRGDFGVSVGLNLIHGSDAIETAQKEINLWFSEKELLSWEPTVNAWLYE

SEQ ID NO: 16599 - protein, 126 aa, Pseudomonas fluorescens PfO-1
MSTLRPAQTTEKTAVDTLFTKIINREIPAKIIYEDDQVLAFHDIAPQAPVHFLVIPKKPVRTLNDLTEDDKALAGHILFTAQRLALELGCEEGFRVVMNCNEMGGQTVYHIHMHVLGQRQMNWPPG

SEQ ID NO: 16600 - protein, 646 aa, Arabidopsis thaliana
MSLTERLYNHLSLFDLLLSLLGLFVFCCLREKLTNKRGPMLWPVFGITLEFFFHINDVYGWVTRSLKKCRGTFLYRGVWLDGSYGAVTCVPANVEYMLKTNFKNFPKGTFFKSRFNDLLEEGIFNADDDSWKEQRRIIITEMHSTGFVEHSFQTTQHLVRKKLLKVMESFAKSQEAFDLQDVFLRLTFDIICLAGLGADPETLAVDLPQVPFAKAFEEATESTLFRFMIPPFIWKPMRFLDTGYEKGLRIAVGVVHGFVDKMIVDRICELKEEETLDNRSDVLSRIIQIESHKRENEIDPSTIRFFRQFCTSFILAGRDTSSVALSWFCWVIQKHPEVENKIICEIREILRQRGDSPTSKNESLFTVKELNNMVYLQAALSETLRLFPPIPMEMKQAIEDDVLPDGTFVRKGSRVYFSIYAMGRMESIWGKDCEIFRPERWIQAGKFVSDDQFKYVVFNAGPRLCIGKTFAYLQMKMIAASVLLRYSIKVVQDHVIAPRVTTNLYMKYGLKVTITPRSLEEKKLESCNFFDMFSRLKKCFHPIYAVAAQTDTPWLVSVMRAEEKPIFLALLYLKSPPLEISSVRNSQTESYLTSPIWQSIGSDARVHSVTKKLGPTIWPVFGITPEFFFHRNDVYGWATRCLKKCR

SEQ ID NO: 16601 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFMDMLDGISSFVLLDTRDNSFIVARDAIGVTSLYIGWGLDGSVWISSELKGLNDDCEHFESFPPGHLYSSKERAFRRWYNPPWLSLAIPSAPYDPLALRHAFEKLWIKRLMTDVPFGVLLSGGLDSSLVAAVTARYLAGTKAAKQWGTKLHSFCVGLEGAPDLKATKEVAEYIGTVHHEFHYTVQDGIDAIEDVIYHIETYDVTTIRASIPMFLMSRKIKSLGVKWVISGEGSDVFFGGYLYFHKAPNKEEFHQETCRTIIVLHRYDCSRANKSTFVWGLEARVPFLDKEFIRVAMNIDPECKMIKKEEGRIEKWALRRAFDDEEHPYLPKHILYRQKEQFSDGVGYGWIDGLKAHAEKHVTDRMMLNAANIFPFNTPTTKEAYHYRMIFERFFPQNSCRLTVPGGTSVACSTAKAVEWDAAWSNNLDPSGRAALGVHASAYGNQVKAVEPEKIIPKMEVSPLGVAI

SEQ ID NO: 16602 - protein, 468 aa, Bacteroides thetaiotaomicron VPI-5482
MKTTINLGYIIFLSVVAALGGFLFGYDTAVISGTIAQVTHLFQLDTLQQGWYVGCALIGSIVGVLFSGILSDSIGRKRTMILSAILFSTSAIGCAFCIDFNQLVVYRIIGGIGIGVVSIVSPLYISEVSVAQFRGRMVSLYQLAVTVGFLGAYLVNYQLLAYSESGNHLPIAWLEKIVVTEVWRGMLGMETLPAIIFFIIIFFIPESPRWLIVKGQERKATYILEKIYNSFKEADFQLNETKSVLVSETRSEWSILLKPGILKAVIIGVCIAILGQFMGVNAVLYYGPSIFENAGLSGGDSLFYQVLVGLVNTLTTILALLIIDKVGRKKLIYYGVSGMVVSLILIGSYFLFGNAWNISSLFLLAFFLCYVFCCAISICAVIFVLLSEMYPTKIRGLAMSIAGFALWIGTYLIGQLTPWMLQNLTPAGTFFLFAIMCVPYMLIVWKLVPETTGKSLEEIERYWTRSER

SEQ ID NO: 16603 - protein, 172 aa, Brassica napus
MSLASPIQCIRIINPSSSSSSSLTTSSSLRFSTSKPCVFIIRCSQAEGPLRRPSAPPTLREPSPPQKPVPPMPSSSPTPPQKAVAVDGKSVVTTVEFQRQKAKELQDYFKQKKLEAAGQGPFFGFQPKNEISNGRWAMFGFAVGMLTEYATGSDLVDQVKILLSNFGILDLE

SEQ ID NO: 16604 - protein, 884 aa, Saccharophagus degradans 2-40
MLEDIDALETQEWLDALASVIKYSGSERASFLLSQLANTATKTGVRLPSAITTPYANTIAAKDEARSPGDAHLERKIRSLVRWNAMAMVMRANDNDEGLGGHISSFSSSATLYEVGFNHFFRGDDGDQRGDLIYFQGHISPGIYARSYLEGRLSEEQLDNFRREVDGNGLSSYPHPWLMPDYWQFPTVSMGLGPISAIYQAHFMRYMSARQMCERGDRKVWAFLGDGECDEPETLGAISLAGREQLENLIFVINCNLQRLDGPVRGNGKVMQELEGIFRGAGWNVIKVVWGAGWDKLLEKDTTGLLQKRMDEVVDGELQNYKANGGAYTRKHFFGKYPELLKLVEDMSDDEIFALARGGHDPQKVYAAYSEAVNHKSQPTVILAQTVKGYGLGAAGESANITHSVKKLDIESLKKFRDRFGIPVSDEDLKSVPYYRPSPDSPEMVYMQERRNALNGYLPARVNDFEALTIPELDKFKALLKSSGEREISSTMAFVRFISTLVKDKNMGANVVPIVPDEARTFGMEGMFRQLGIYSSEGQKYTPHDHDQIMYYKEDKKGQILEEGINEAGAMSAWIAAATAYSTYRKPMVPFYIYYSMFGFQRIGDLAWLAGDIQARGFLVGATSGRTTLNGEGLQHQDGHSHLMANTIPNCRTYDPTYSYELAVIIRDGLQRMYGDKENVFYYITTMNENYQHPDMPLGAEEGIIRGIYKLKDGKKAAKKKRVQLMGAGSILREVEAAAELLRDDWGVESDIWSVTSVNELARDGQKAQRHNLLNPEAALRKPYITEVLEAAEGPFIISTDYMKSYSEQLRAYIPGTYTVLGTDGFGRSDTRAKLRGFFEVDRYYVTVAALKSLADEGKVPAKDVTAALKKYGIDSDKPDPMTV

SEQ ID NO: 16605 - protein, 878 aa, Rickettsia rickettsii
MKKLIYYFGSNGSDGNARMKNILGNKGAGLAEMSNLKLPIPDGFTITTELCNYFYTHNNNFPKNFQSDLKKAITELEIITGKIFGSTSNPLLLSVRSGSTVSMPGMMDTILNLGMNNEVCNALADSCGDKRFALDSYKRFLEMYGSTVLSIPSDLFEQIYEKHKMQADIHKDSDITVELLEKIIDDFKRLHIKYTKQLINDPYEQLESAIKAVLHSWMSNRAVIYRKINNISEDCGTAINIQAMVFGNLGKTSATGVAFTRSPATGEKKLFGEFLINAQGEDIVSGTRTPMPIIANDSNSMQAMMPEVFKELSQIAQKLEEHYLDMQDIEFTIENNKLYILQTRTAKRTAIAAINIAVQMVEEKLISKEQALMRIDPESLNQLLHTRIDYSKGLTSIAEGLPASPGAATGIAVFSPYDAEKLSHHHKVILVRHDTSPEDINGMHVSSGILTIRGGMTSHAAVVARGMGKPCVCGTSNLSIDEKKQILTAGDIVIKQGDIITIDGGSGKIFLGEMPLIQPTFSEESKLILDWADEISSLKVRANAETVNDALVSVKFGAQGIGLCRSEHMFFDKNKIPLVRDMIIAPDIERRKLAVQKLLPLQTEDFKALFRVMKDKPVNIRLLDPPLHEFLPTTEEDKKNLANSLNLPLSMINQRLHAMHEVNPMLGHRGCRLGICSPEIYQMQIEAIFTAIFELHKKEHIECNLELMIPLISNVGEIQKLKMDIYAVIEELEQRYSYKFSFTLGTMIELPRAALGSKKIAKEVDYFSFGTNDLTQTTYGISRDDIASFLPYYLEEKIFESDPFTTLDEEGVGELIEIAIKRGKSSNANLKLGACGEHAGNPASIEFFHRMNLNYVSCSPYRIPIARIAAAQAKIKHG

SEQ ID NO: 16606 - protein, 756 aa, Haemophilus influenzae R2866
MTEQLRQAALDFHEFPIPGKIEVTPTKSLATQRDLALAYSPGVAEPCLEIEKDPAASYKYTARGNLVAVISNGTAVLGLGNIGALAGKPVMEGKGVLFKKFAGINVFDIEVNEHDPDKLVDIIASLEPTFGGVNLEDIKAPECFYIEQKLRERMNIPVFHDDQHGTAIISAAAIINSLRIVGKKIEDVRLVASGAGAASIACLNLLLSLGMKRENITVCDSKGVVYKGRDDKMDQTKKDYAIEDNGWRKLGDAIPNADIFLGCSAAGALTQDMVKTMAAHPIILALANPNPEITPPEAKAVRPDAIVCTGRSDYPNQVNNVLCFPFIFRGALDVGATTINEEMKRAAVYAIADLALEEQNEVVTSAYGGEGATFGADYVIPRPFDPRLIVRIAPAVAKAAMESGVATRPIQNWDAYVEKLTQFVYKTSLFMRPIFSQAKSAKQRIILAEGEENKALHATQEVISMGLANPILIGRRSVIEEKIKKLGLRLTAGVDFEIVDNEDNPRYEECWKHYYELTKRKGITPAIAKRVVRSNTTVLASTLLSLGYADALVCGLFGSYGKHLASIRDIIGLKDGVKTAAALNSLVLPTGNVFLTDTHVNSNPTAEELAEITLMAAEEIHRFGIEPAVALLSHSNFGSSDSLGAPKMREVLQIVKERNPHLMIDGEMRGDLAMNEAHRKELMPDSPLKGSANLLVFPDLSASRISYSLLRGTTTAITVGPILMGMNKSAHILNPGASVRRIINMIAYAAVKAQQE

SEQ ID NO: 16607 - protein, 202 aa, Salinibacter ruber DSM 13855
MANEPTYTFEYPEEQWYPPDSYRGRPVLVEEDDRPRCVSCNLCARACPPLAISMQSKEVNNVKEREPEWFEINMLRCIYCGFCEEVCPEEAIVMSKEHDLTFQSRDEAVFDLDDLLRPSEQMQDRLEYLDQYKNKQFGQQWDFKKENNLHSVKDQHFLDWLAEEGMDDLDTTHQREDRMATEGDQDWGGDRQGPPQTKHAAE

SEQ ID NO: 16608 - protein, 873 aa, Clostridium symbiosum
AKWVYKFEEGNASMRNLLGGKGCNLAEMTILGMPIPQGFTVTTEACTEYYNSGKQITQEIQDQIFEAITWLEELNGKKFGDTEDPLLVSVRSGARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 16609 - protein, 135 aa, Chlamydomonas reinhardtii
MARTKQTARKSTGGKAPRKQLATKAARKTPATGGVKKPHRYRPGTVALREIRKYQKSTELLIRKLPFQRLVREIAQDFKTDLRFQSQAVVALQEAAEAYLVGLFEDTNLCAITAKRVTIMPKDIQLARRIRGERA

SEQ ID NO: 16610 - protein, 422 aa, Sinorhizobium meliloti 1021
MQERHHVVVVGGGFGGLQLVNDLKGAPVKVTLIDRRNHHLFQPLLYQVATTVLATSEIAWPIRRLYRDRQEVTTLLGEVAGVDMIAKEVTLAHGQSIPYDTLVLATGATHAYFGHDEWAAVAPGLKTLEDATTIRRRVLIAFEQAEVEEDTARRDALLTFTIIGAGPTGVELAGIIAEMAHRTLPGEFRRIDTRLARVVLVEAGPRILPAFSEELSAYASRELEKLGVEVLTGTPVTDCTDEGVTIGESFVPSRTLVWAAGVQASPAARWVGADADRAGRVKVGPDLTAPHHPDIFVIGDTASVIQEDGKPVPGIAPAAKQQGAYVAQVIRGRLTGSPAPGPFRYRHQGSLATIGKRAAIIDFGRIKLRGSLAWWIWGIAHIYFLIGTRSRFAVAWSWLWTYLSGQHSARLITQKDTLREER

SEQ ID NO: 16611 - protein, 248 aa, Triticum aestivum
MPGSIAFGRFDDSFSLASFRAYIAEFISTLIFVFAGVGSVIAYTKVSGGAPLDPSGLIAVAICHGFGLFVAVAIGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWVYWAGPLIGGGLAGVVYRYLYMWDDHSPVAGNDY

SEQ ID NO: 16612 - protein, 329 aa, Aspergillus oryzae
MFPSLDFSRFHDPSQREEFCRQFVSTLKEYGFAKLINHGISCAQIDLAFAAARRFFQLPLEQKLKSPHPATAHPHRGFSPVGLENIGAVSDYGSAAGSPYLKDMKNIWPPKGVDDAFQPTFTAFFEAGYRAELTILKALSIGLGLPEHKLGQLHADQTNELRITHYPAVARGEFAHSTRIATHTDFGTITLLFQDAVGGLREFFFFFFVHLSGHVGHVVVLMQVAEMEVPPHSGQFADIESGGPYECILNVGDCLQKWTGLHSARHRVHLPDRSKEEQINGIVPERFSIAYFAKPDRAAILRPLLLEGVPEEKYLTANEFQHMRIAGTY

SEQ ID NO: 16613 - protein, 87 aa, Synechococcus elongatus naegeli
ADLANGAKVFSGNCAACHMGGGNVVMANKTLKKEALEQFGMYSEDAIIYQVQHGKNAMPAFAGRLTDEQIQDVAAYVLDQAAKGWAG

SEQ ID NO: 16614 - protein, 304 aa, Staphylococcus aureus subsp. aureus MW2
MTNKVVILGSTNVDQFLTVERYAQPGETLHVEEAQKAFGGGKGANQAIATARMQADTTFITKIGTDGVADFILEDFKAAHIDTSYIIKSTEAKTGQAFITVNAEGQNTIYVYGGANMTMTPEDVINAKDAIINADFVVAQLEVPIPAIISAFEIAKAHGVTTVLNPAPAKALPNELLSLIDIIVPNETEAELLSGIKVTNEQSMKDNANYFLSLGIKTVLITLGKQGTYFATKNQSQHIEAYKVNAIDTTAAGDTFIGAFVSRLNKSQDNLADAIDFGNKASSLTVQKHGAQASIPLLEEVNQV

SEQ ID NO: 16615 - protein, 295 aa, Francisella tularensis subsp. holarctica
MIDKIWKNGEIISYQDAKVGINTHSLHYGSSVFEGIRAYDTPNGIGVLKLREHMQRFMYSMNVLGMTCKYTLDELCQAVLDTVKASGKKSCYIRPLAYFAEGGVNVLPAKDHPVDITIYCIDMGKYMAADKVDIKVSKYIRIHPRSTVCDAKIGGHYVNSILASRETLGTHYHESLLLDAYGFVAEGAAMNVFFVKDNEVITTPLGTILDGITRRLIIQIAKDLEYKVTERLFKVDELINADEVFFCGTAAEITPVASIDDNKLKRSDYTITNQIKEVFEKLKQGQVYKEALTYI

SEQ ID NO: 16616 - protein, 877 aa, Francisella tularensis subsp. holarctica
MSKFVYAFSEGNKSMRDLLGGKGANLSEMLNSGLPVPDGFTVTTEACLKYYDDRQKLSNEVKEQIFAHIKDLEKRTGKTFGGGNNPLLVSVRSGARVSMPGMMDTVLNLGLNDTVAQAMVAKTNNEQFVYDSYRRFIMMFADVVMDCEKKPFDKVLEDKKAKRKVKNDCDLPAQDYKDIVTEYKKIYKDLVGKDFPTDPIEQLLAAVEAVFKSWNAERAIIYREINNISNNWGTAVNVQEMVYGNSGNNSGTGVAFTRNPSTGENELFGEYLINAQGEDVVAGIRTPAHISTLKDKMPEVFNDFVKIAKNLEKVYKDMQDMEFTIEDGKLFMLQTRNGKRTAKAALKIAVDMAKEDLITNEEAVMMVEPHLLEQLLHPKFDEKALASKRPLGSALGASPGAASGRIYFDVESLLAAKARGEEKTILVRIETSPEDIAGMNACNGILTLRGGMTSHAAVVARGMGKCCVSGLESARIDEEKKTITFERGQVFTEGDYLSLDGTKGTVYRGIIKTVDPEVTKDFEDFMKFVDSVRKLRVRCNADTYKDASIARAFGAEGIGLCRTEHMFFEEDRISYVRQMILAKDKKERQRALDKLLPVQQQDFEELFEAMDNLAVTIRFIDPPLHEFLPHEVDEIDDLAREFNISYSELEARIEALSEVNPMMGHRGCRLAVTYPEIIEMQTKAIIYAAISSKRMGIEVKPELMIPLVSTLGEFKLLSGIVREVADTILKREKIDIDYKVGVMLETPRGAIGAGMLAAAGSEFFSFGTNDLTQMTFGFSRDDANKFIKDYLEKGILSFDPFARLDIKGVGKLMQIAKEGVKAVNPNAKMGICGEHGGEPYSVGFCHDLDLDYVSCSPFRVPIARLAAAQAKIYADRR

SEQ ID NO: 16617 - protein, 338 aa, Brassica napus
  misc_feature (104)..(104): Xaa can be any naturally occurring amino acid
  misc_feature (260)..(260): Xaa can be any naturally occurring amino acid
MLEKGKNQNLIGHISKFGLASLHICSLEFSGSEIGSPLPHLPNRSFLALNWIWVSKSHLLFFFASSPLEKSDMQDQLVCHGCRNTLMYPRGATNVRCALCHIVXNMVPLHPHPPPPPPPHHAHAGMDMAHIVCGGCRTMLMYTRGASSVRCSCCQTVNLVPGPPPSNQVAHINCGNCRTTLMYPYGASSVKCAVCQFVTNVNMSNGRVPLASNRPNGTAAPGTMPSTSTQSTPPSQTQTVVVENPMSVNESGKLVSNVVXVGVTTGQKITQELSDLKEIISSVLVCAYYIYISLTTFLTQGKGLLRITCLSFLLGFFLIKVDAHKGFTFCPMIWHLYL

SEQ ID NO: 16618 - protein, 347 aa, Triticum aestivum
  misc_feature (262)..(263): Xaa can be any naturally occurring amino acid
  misc_feature (282)..(282): Xaa can be any naturally occurring amino acid
  misc_feature (299)..(299): Xaa can be any naturally occurring amino acid
  misc_feature (308)..(308): Xaa can be any naturally occurring amino acid
  misc_feature (315)..(315): Xaa can be any naturally occurring amino acid
  misc_feature (331)..(331): Xaa can be any naturally occurring amino acid
  misc_feature (337)..(337): Xaa can be any naturally occurring amino acid
MPATAGRVRMPANNRVHSSAALQTHGIWQSANAAAAAANAAAEAAAPPSSDPGASSENAYTSFQGLLALARVTGSNSDETRGACKKCGRVGHLTFQCRNFLSVKELAMDDDIQAGMLSAAHAKAKFEEITKKASGARDADEEGSDEEDEDEIDSDSSDSDIDPELEKIIAERERAKSRGGKRSGEQDKKTSRHKSKSRGRSKHRRSRKSDSEDDSEEERTKDKKKNRRKKHRSSDEDSESDSDRKRHRKSRKDRKRRRTHRXXDDSSDDDESGGEGRRHHRXHKRRHHRRDASGSDSDXSESPHERKXSSKQKSXKRSESHGLGEDERHCXQGASRXGEKSREHKRG

SEQ ID NO: 16619 - protein, 471 aa, Ralstonia metallidurans CH34
MQRIAHIYINGEFVTPHGDEWFDLYNPSTEEVIGQVRLGDAQDARRAIAAAQAAFPAWSRTTREERIAALHRMHRAVAAREDELMEAILLEYGAPQVRGRWMATYPADVIAQAIDTLESFAFEEHVGSAKVIQVPVGVAGLITPWNSNAGFICNKLATALAAGCTAVIKPSEMSAMQTQIVAQALHEASLPPGVFNIVNGRGEIVGEEIARNPGVAKISFTGSSAVGQHLVVTGAETMKRVTLELGGKSPTIVLPDADFATVMPLVLQAGFANSGQACIAGTRILVPRNRLTEFEHIAKEAVSHVRSGDPRDTDTDIGPMVSQKQWERVQNYIRIGQQEGATLLAGGEGRPDGMHAGWFVKPTLFTHANNQMRIAREEIFGPVLTIIPYDDEADAIAIANDTRYGLSALVLGTNLESCERVARQIDSGRVLVNTLAHEPRAPFGGFKHSGLGREMGRWGMSAYLEPKTLLT

SEQ ID NO: 16620 - protein, 307 aa, Bacteroides thetaiotaomicron VPI-5482
MDYTIIDAHAHLWLRQDTVVDGFPIRTLENGRSLFMGEIRQMVPPFMIDGVNSAEVFLSNMDYAQVSAAVITQEFIDGIQNDYLMEVVSRYPDRFFVCGMCEFRKPGYLEQAKELIGKGFKAIKIPAQRLLLKEGRVMLNCPEMMQMFRWMEERGVILSVDLAEGAIQVLEMEEIIQECPRLKIAVGHFGMVTLPDWKEQIKLARHPNVMIESGGITWLFNDEFYPFKGAIKAIREAAELVGMEKLMWGSDYPRTITAITYKMSYDFVVKSPELSEAEKTLFLGGNARKFYGFAELPELPYIKNMSE

SEQ ID NO: 16621 - protein, 248 aa, Cocos nucifera
MGYLNSIAGIQADGSPVSGGGLSRNGKFSYGYASSPGKRASMEDFYDTRIDGDDGEIVGLFGVFDGHGGARAAEYVKQNLFSNLIRHPKFISDTKLAIADAYNHTDSEFLKSENNQNRDAGSTASTAVLVGDRLLVANVGDSRAVICRGGNALAVSKDHKPDQSDERQRIEDAGGFVMWAGTWRVGGVLAVSRAFGDRLLKQYVVADPEIQEEVVDGSLEFLILASDGLWDVVSNEEAVAMIKPIEDP

SEQ ID NO: 16622 - protein, 338 aa, Bacteroides thetaiotaomicron VPI-5482
MKAVQIVNPSEMKVVELEKPTVGAGEVLVRIKYVGFCGSDLNTFLGRNPMVKLPVIPGHEVGAVIEEIGPDVPAGFEKGMNVTLNPYTNCGKCASCRNGRVNACEHNETLGVQRNGVMCEYAVLPWTKIIPAGNISSRDCALIEPMSVGFHAVSRAQVIDNEYVMVIGCGMIGIGAIVRAALRGATVIAVDLDDEKLVLAKRVGASYAVNSKTENVHERIQEITAGFGADVVIEAVGSPVTYVMAVDEVGFTGRVVCIGYAKKEVAFQTKYFVQKELDIRGSRNALPADFRAVINYMKEGKCPVEELISKIAKPEDALEAMKEWAADPGKVFRILVEM

SEQ ID NO: 16623 - protein, 318 aa, Magnaporthe grisea 70-15
MADGKRAVDSSRVWTTLITNLDYLPGLLTLDHALRKHKSKYPLVALYTDTFPESGRTALASRCIAAQRIEYLLPTKSSRDYSEDPRFYDCWSKLTPFSLEQYDRVVQLDSDMLVLQNMDELMEMELDAPEVSAAGGPDSKRVFAASYACVCNPLKRAHYPKDWVPENCAFTTQHGEPDKAQVEGADPAKVPLPILNGGLQVVNPSRVLFQQIVEHMENNAASLDFADQSLLSELYKDRWVALPYVYNALKTLRWPGVHDAIWRDDKVKNVHYILTPNPWDQLDAEGNTKSEEETMGWWADVNKERREGEKAKGINDGF

SEQ ID NO: 16624 - protein, 130 aa, Triticum aestivum
  misc_feature (18)..(18): Xaa can be any naturally occurring amino acid
MVRVSVLNDALKSMYNAXKIGKRQVMIRPSSKVIIKFLTVMQRHGYIGEFEYVDDHRSGKIVVELNGRLNKCGVISPRFDIGVKDIKGWTARLLPSRQFGYIVLTTSAGIMDHEEARRKSVGGKVLGFFY

SEQ ID NO: 16625 - protein, 287 aa, Synechococcus sp. CC9311
MTTAPETSGNWIDEHHNGVRYGLEGRVLVEETSPFQRITVIDSQRYGKGLLLDGCWMTAEHQERHYHEALVHPALCSAKAIERVLVIGGGDGGTARECLRYPGVKHLDMVEIDGRVVDLSQEHLPSIGGGCWHDPRFHLTIGDGIAWAAEAENAFYDVVLVDGSDPTGPAEGLFNRAFFSNCCRILKPGGVFATQSESPEAFRQVHIDMVKLIRELFGHADPLYGWVPMYPSGWWSWTFAAKDAPRYLTVQSERAAAVAEGSAIWSPRWQQGAFNTIPAFIERELNQ

SEQ ID NO: 16626 - protein, 337 aa, Ostreococcus tauri
MDARRTPSATTSQRRSLFGFGKKRGVDAVAADATTSGSAVSDALVTVSDVAPALGSLASEVVPVAVQSWPTTAALMYAMEYFHVAHGLEWWLAIVGATVFMRTVTFPLVVMQMRNTARMQLCKPELEALQAKMKSNPSQDPELATAYYAEMQKVWKKYDVNPFKSFAPVLINAPVFISFYFAISKMAAGVPSFETGGPSMYPDLSIADPTYSLPILSSLTFLASVELGTVEGMQTSQSAQMKWFLRALAVAMVPLTASFPQGVFVYWITSNMFSGVQTSITRTKGFKAAMGIPDVSAVADAPADAALSRVQLDQFQKKYGPTPTLHKRPPSKGKKQR

SEQ ID NO: 16627 - protein, 382 aa, Haemophilus influenzae R2866
MAKKDYYEVLGLQKGASEDDIKRAYKRLASKHHPDKNQGSKEAEEKFKEINEAYEVLGDDQKRTAYDQYGHAAFEQGGGAGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRSCHGEGRVHKKENLSVKIPAGVDTGNQLRLAGKGAAGENGAPAGDLYVVIHVREHHIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 16628 - protein, 103 aa, Chlamydomonas reinhardtii
MSGRGKGGKGLGKGGAKRHRKVLRDNIQGITKPAIRRLARRGGVKRISGLIYEETRTVLKTFLENVIRDSVTYTEHARRKTVTAMDVVYALKRQGRTLYGFGG

SEQ ID NO: 16629 - protein, 412 aa, Salinibacter ruber DSM 13855
MRRRRTKMPPTRRTRPLPRRVEGLSGREKAPSTARLQRNSPGRTQFSMDDTRSYDIAWLPGDGIGPEVTREALRVLEAVGSAHGFSVTATEHRMGGVALDETGMPLPDSTRDACLESDAVLLGAVGGPKWADNTGDQRPESGLLALRKALGVYANLRPVRVPAALADASPLRPDRVGGTDILFVRELTGGIYFGTPEGRTDDGARSTMAYSDDEIERIAHVAFQRARRRDGNVTSVDKANVLEVSELWREVVTEVHDDCPDVTLRHLYVDNAAMQVVRDPRQFDVVLTGNLFGDILSDLAAALPGSLGLLPSASVGGTVGLFEPVHGSAPDIAGQDVANPTAAILSAALLLDEVGETAAADAVRHGVDAALDAGFRTADLAADNEEDASTSAFGREVATRAADSVPQNAPTP

SEQ ID NO: 16630 - protein, 457 aa, Thermus thermophilus HB8
MAEIGVAVVGGGWAGLAAALALKEAGADFLLLEASLRLGGKVRTARQEGFLVEGGPDASVRYKKEVLELAQAFGLEPIGTLPEKPAAYILYRGKRHPLPEGLLQVVPGDLKALARTPLLSLPGKLRALYDLFLPRGAKEDETLREFVERRLGPEVYRALVAPLAGGVYGGEPDDLSMRAAFPQLWELEGRHRSLLLGAMRVRKGRGSREGGSLFFSFAEGLQALTRRMAEALGERVLRGTPVLGLEPARGRWRLHTPKGALLAEAVVLAIPAPQAAGLLRPFLPEATALLKGIPHTPAATVSLAFPGALPVEGHGLLVAKGEGLRARGFTWTHRKWPGRVPEGFSLVRAYFSGEAARLSEEALIRLALEDLARLLPGLPRVHRAWAFRFPEGMPAYRVGHLDRVERLEMALVKAPGLFLAGNYLQGVGLPEVVRSGRRAAQRALAHLSLGEAHGASR

SEQ ID NO: 16631 - protein, 1071 aa, Bacillus subtilis subsp. subtilis str. 168
MPKRVDINKILVIGSGPIIIGQAAEFDYAGTQACLALKEEGYEVILVNSNPATIMTDTEMADRVYIEPLTPEFLTRIIRKERPDAILPTLGGQTGLNLAVELSERGVLAECGVEVLGTKLSAIQQAEDRDLFRTLMNELNEPVPESEIIHSLEEAEKFVSQIGFPVIVRPAYTLGGTGGGICSNETELKEIVENGLKLSPVHQCLLEKSIAGYKEIEYEVMRDSQDHAIVVCNMENIDPVGIHTGDSIVVAPSQTLSDREYQLLRNVSLKLIRALGIEGGCNVQLALDPDSFQYYIIEVNPRVSRSSALASKATGYPIAKLAAKIAVGLSLDEMMNPVTGKTYAAFEPALDYVVSKIPRWPFDKFESANRKLGTQMKATGEVMAIGRTLEESLLKAVRSLEADVYHLELKDAADISDELLEKRIKKAGDERLFYLAEAYRRGYTVEDLHEFSAIDVFFLHKLFGIVQFEKELKANAGDTDVLRRAKELGFSDQYISREWKMKESELYSLRKQAGIAPVFKMVDTCAAEFESETPYFYSTYEEENESVVTDKKSVMVLGSGPIRIGQGVEFDYATVHSVWAIKQAGYEAIIVNNNPETVSTDFSISDKLYFEPLTIEDVMHIIDLEQPMGVVVQFGGQTAINLADELSARGVKILGTSLEDLDRAEDRDKFEQALGELGVPQPLGKTATSVNQAVSIASDIGYPVLVRPSYVLGGRAMEIVYHEEELLHYMKNAVKINPQHPVLIDRYLTGKEIEVDAVSDGETVVIPGIMEHIERAGVHSGDSIAVYPPQSLTEDIKKKIEQYTIALAKGLNIVGLLNIQFVLSQGEVYVLEVNPRSSRTVPFLSKITGIPMANLATKIILGQKLAAFGYTEGLQPEQQGVFVKAPVFSFAKLRRVDITLGPEMKSTGEVMGKDSTLEKALYKALIASGIQIPNYGSVLLTVADKDKEEGLAIAKRFHAIGYNILATEGTAGYLKEASIPAKVVGKIGQDGPNLLDVIRNGEAQFVINTLTKGKQPARDGFRIRRESVENGVACLTSLDTAEAILRVLESMTFRADQMPAVNTNQEAAVTI

SEQ ID NO: 16632 - protein, 94 aa, Crocosphaera watsonii WH 8501
MSDTITPDVSDRICKHMNDDHSNAIVLYAQVFGNVPETETAIMESIDPEGMNLSVKVKGENRPIRVKFDHVLKDSEDAHHTLISMVKKARNPQN

SEQ ID NO: 16633 - protein, 391 aa, Staphylococcus epidermidis ATCC 12228
MVTQNKKILIITGSFGNGHMQVTQSIVNQLNEMNLNHLSVIQHDLFMEAHPIMTSICKKWYINSFKYFRNTYKRFYYSRPNELDKCFYKYYGLNKLINLLIKEKPDLILLTFPTPVMSVLTEQFNINIPIATVMTDYRMHKNWITPYSQRYYVATKDTKDDFIEAGVPASYIKVTGIPIADKFEESIDKEEWLSQQHLDPSKPTILMSAGAFGVSKGFDYMINNILEKSPNSQVVMICGRSKELKRSLKAKFKDNPSVKILGYTNHMNEWMASSQLMITKPGGITISEGLSRCIPMIFLNPAPGQELENAYYFESKGFGKIADTPNEAIDIVSDLTNNEETLKVMSSKMLESKVGYSTRKICKDLLDLIGHSSQPDEIYGKVPLYARFFVK

SEQ ID NO: 16634 - protein, 864 aa, Solanum tuberosum
MNIGQIMGGRELFGGHDDSKKVKGTVVMMKKNALDFTDLAGSLTDIAFDVLGQKVSFQLISSVQGDPTNGLQGKHSNPAYLENSLFTLTPLTAGSETAFGVTFDWNEEFGVPGAFIIKNTHINEFFLKSLTLEDVPNHGKVHFDCNSWVYPSFRYKSDRIFFANQPYLPSKTPELLRKYRENELLTLRGDGTGKREAWDRIYDYDIYNDLGNPDQGKENVRTTLGGSAEYPYPRRGRTGRPPTRTDPKSESRIPLLLSLDIYVPRDERFGHLKMSDFLTYALKSIVQFILPELHALFDGTPNEFDSFEDVLRLYEGGIKLPQGPLFKALTAAIPLEMIKELLRTDGEGILRFPTPLVIKDSKTAWRTDEEFAREMLAGVNPIIISRLQEFPPKSKLDPEAYGNQNSTITAEHIEDKLDGLTVDEAMNNNKLFILNHHDLLIPYLRRINTTITKSYASRTLLFLQDNGSLKPLAIELSLPHPDGDQFGVTSKVYTPSDQGVESSIWQLAKAYVAVNDAGVHQLISHWLNTHAVIEPFVIATNRQLSVLHPIHKLLYPHFRDTMNINASARQILINAGGVLESTVFQSKFALEMSAVVYKDWVFPDQALPADLVKRGVAVEDSSSPHGVRLLIEDYPYAVDGLEIWSAIKSWVTDYCSFYYGSDEEILKDNELQAWWKELREVGHGDKKNEPWWPEMETPQELIDSCTTIIWIASALHAAVNFGQYPYAGYLPNRPTVSRRFMPEPGTPEYEELKKNPDKAFLKTITAQLQTLLGVSLVEILSRHTTDEIYLGQRESPEWTKDKEPLAAFDKFGKKLTDIEKQIIQRNGDNILTNRSGPVNAPYTLLFPTSEGGLTGKGIPNSVSI

SEQ ID NO: 16635 - protein, 165 aa, Triticum aestivum
PFFHGLKPPSITIRAYLERIMTYSPCSVECFVLALVYVDRIMQANWRFVLTSLNVHRLLLTAVMTGVKYHDDCSYNNAYYAKVGGIPLGELNALEVELLFLLGFDLHVSGEVFERYYSELMKHAPIALGQVTTSSPGLPSVTTITSASPTTTSRLQRHPHPEAAC

SEQ ID NO: 16636 - protein, 338 aa, Burkholderia xenovorans LB400
MALQRRTTLTKYLIEQQRETNNLPADLRLLIEVVARACKAISYHVSKGALGDALGTAGSENVQGEVQKKLDILSNEILLEANEWGGNLAGMASEEMEQFFPIPANYPKGEYLLVFDPLDGSSNIDVNVSIGTIFSVLRCPDGQQPTEQSFLQPGTQQVAAGYAVYGPQTVLVLTTGNGVNCFTLDRELGSWVLTQSDMRIPVETREYAINASNERHWYPPVQQYIGELKDGKEGSRQSDFNMRWIASMVADVHRILNRGGIFMYPADKRTPDKPGKLRLMYEANPMAFIVEQAGGAATNGEKRILDIQPKSLHERVAVFLGSKNEVDRVTRYHLETKK

SEQ ID NO: 16637 - protein, 469 aa, Enterococcus faecalis
MAEQTDLLILGGGTGGYVAAIRAAQKGLNVTIVEKYKLGGTCLHKGCIPTKALLRSAEVFDTLKQAASFGIETEAASIDFSKIQQRKEGIIEQLHKGVEGLCKKNKIKILAGEGAILGPSIFSPVSGAVAVTFNDPTREEEIIVPKNVIIATGSSPKTLPNLPLDEEFILSSDGMLELEELPESIAIIGGGVIGVEWASLLNSLGVNVTIIEFLDRLLINESATISKELKKRLEQRGINILLGSKVQEAKVTGQKVQVEVAGQESLTVDKVMVAIGRQPNINKLGLQNTSVKYTDKGIEVNEFYQTTEGHIYAIGDCIDTLQLAHVAMKEGELAVQHLLDETVEPLNYTNVPRGVYTNPEIASVGYTRETLPADKEVVIGTFNFNGNGKSLVYGETDGFIEVIRDKKTDDLLGVSMIGPHVTDLIAEASTAMYLDAAPIEIGEAIHAHPTMTEVLQEAALDTYGLAIHK

SEQ ID NO: 16638 - protein, 644 aa, Coprinopsis cinerea okayama7#130
MTTVAEGPKLTTERVPIKNKVCLMCVLHNIICEESLNWTNGCVVNSVHDGWGIAPKEGMEGNAIEAGETHFMDTIAKDHSYRTLRASGTAVGLSEGLMGNSEVGHLNVGAGRVVWQDIVRIDVAIKKKQFHENPTILEACKRAKEGTGRLHFLGLISDGGVHSHITHLFALLETAKEQGVPEVYIHFFGDGRDTAPRSATKYIQQLGEFTDEHKVGELATIIGRYYAMDRDKRWERIKLAVLGLTTGKPEEEGKSFESVQKEEGWKGAVTVVDENYKKDVTDEFLKPIVVNGEKGRVRDGDTLFFFNYRSDRMREISSVFGGLEEIEGLTVPKDLGIFTMSQYKKEFPFKVAFPPQAMTNVLAEWLAKKGLRQAHVAETEKYAHVTFFFNGGVEKQFEGEDRFMIPSPKVATYDLDPKMSVHGVAEKVAELLDKNEYDFVMCNFAPPDMVGHTGVYDAAVTAITETDKAVGTIYKAAEKNGYILLITADHGNAEQVGRGTVGAGPGIVSWGLGVGLDTLACRPCCGARGDELPAVDGALVTAQSVALKGAIEWQMRRMKDPKTGNPHTAHTTNPVPFIMTGNPKGEKGDAKTLKFADLPEAKPAGEDEAEDDSPALADVAPTILDVMGLDKPEDMSGKSLLAKD

SEQ ID NO: 16639 - protein, 302 aa, Glycine max
MCAHVRQTLADLSSQEVADATRIQYGGSVKPNNIKEYMAQSDIDGALVGGASLKVEDFVQLLEDGFANRESEHGNAVKQAHKPNFDRYYEKYPTTQIEASGLDVGLPEGQMGNSEVGHMNIGAGRIVYQSLTRINKSIEDGEFFDNTVLNNAVKHVKDNGSALHVFGLLSDGGVHSHYKHLFAILELAKKQGIDKVYVHAFLDGRDVDQKSALKYIEETEDKFKELGVGQFASVSGRYYAMDRDKRWDREERAYNAIRNFEGPTFTSAKAGVEANYKNDVTDEFVEPFIVEGQNDGVNDGDA

SEQ ID NO: 16640 - protein, 432 aa, Enterococcus faecalis
MATKEIKMPHLGESVTEAAIVQWLVKPGDSVKRYDPLMEVVSDKVTTEVPSDFEWCSKRISDFSRYRVPIGTAVMTLETEETTEKTEVATLAPVKEASAEQAQEHETVATTSTATSHQKNNGRYSPAVLKIAQEKKIDLTQVTGTGRDGRITRKDVTNFTPTQARTPEKTVSPGTSPSISEEPVASQNESAATASPTETSPDKIVSADPVRKAIAKKMVQSVNEIPHAWLMVEADVTNLVQLRNSLKDEFKQQEGLSLSFFPFFAKAVIQALKKNPKINTSWDDGSIIYHKDVNLSIAVTTDEHLYVPVIQQADNYSIAGLAKEINRLAQEVRQGTLASKEMQGGTFTLNNTGTLGSVQSMGIINHPQAAILQVESINKRLVPTADGGFKVADMVNLCLSIDHRILDGQQAGKFLRDVKDNLAKYNADTDVY

SEQ ID NO: 16641 - protein, 354 aa, Thermotoga maritima MSB8
MKIAVLPGDGIGPEVVREALKVLEVVEKKTGKTFEKVFGHIGGDAIDRFGEPLPEETKKICLEADAIFLGSVGGPKWDDLPPEKRPEIGGLLALRKMLNLYANIRPIKVYRSLVHVSPLKEKVIGSGVDLVTVRELSYGVYYGQPRGLDEEKGFDTMIYDRKTVERIARTAFEIAKNRRKKVTSVDKANVLYSSMLWRKVVNEVAREYPDVELTHIYVDNAAMQLILKPSQFDVILTTNMFGDILSDESAALPGSLGLLPSASFGDKNLYEPAGGSAPDIAGKNIANPIAQILSLAMMLEHSFGMVEEARKIERAVELVIEEGYRTRDIAEDPEKAVSTSQMGDLICKKLEEIW

SEQ ID NO: 16642 - protein, 1099 aa, Thermotoga maritima MSB8
MPKREDIKRILVIGSGPITIGQAAEFDYSGTQALKALKSAGYEVIIVNSNSATIMTDPEFSDAVYIEPLTVEFLEKIIEKERPDALLPTLGGQTALNLAVELAERGILDKYGVQLIGAKLESIKKAEDRELFKETMEKAGLEVLRSRLVNNLADALETAREFGYPVIIRPSFTLGGTGGGIAFNEEELRDIVTKGLIESPVHTVLIEESVLGWKEYELEVVRDGAGNFIVVCSIENLDPMGIHTGDSITVAPAQTLTDVEYQRMRDAAYKVIDAIGIETGGSNIQFALDPETGRMVVIEMNPRVSRSSALASKATGYPIAKVAALLAVGFTLDEIPNYITGKTMAAFEPSIDYVVVKIPRFQLEKFPGADPRLNTQMKSVGEVMAIGRTFKEALGKALRSLELDAAPKLDLEHIREHLANPTPERISYVFAAFRNGMDVEEVHELTKIDRWFLREMKACIELEEELKLKKFDVEILKKAKQWGYSDREIAEIWGVSEKEIRKMREDNRIFPVYKMVDTCAAEFEAQTPYYYSTYNGVENEAVPSDREKIMILGSGPNRIGQGIEFDYTNVHGVWSFQEEGYETIMVNSNPETVSTDYDTSDRLYFEPLTVEDVLEIVRNEKPKGVVVAFGGQTPLKIAKYLVEERVNIIGTSFESIEIAEDREKFAKLLKQIGLKCPPFGTASSVEEALRVAENLGYPVLVRPSYVLGGRAMAIVDTPQELEMYVKEAAVVSPGYPVLIDKFLEDAIELDVDVVSDGKYVWIAGLMEQIEEAGVHSGDSACVLPPVSLSEKLVEEIEETVYKLVKALKVVGVANIQLAVKDEEIYIIEANPRASRTVPFVSKAIGIPVARIAAKIMVGRNLPELLSEYFPYPTRPGVKVDKLGESEILPTPWPKMFSVKEVVIPFHKFPGTDVLLGPEMRSTGEVMGIGEDFAEAFAKAQIAAGNPLPTTGAILATVADKDKREAVPLLAHLADMGFEIYATRGTAKALQSHGVEVKVVPKVGEGRPDVIDLLEQGKISLVVITQSSDEPALVAVSHGKEPFKVEGRRTVGYMIRTTALKRKIPYLTTVESLRAAVAAIRKMKKGSIVKVRRLTDTWKM

SEQ ID NO: 16643 - protein, 329 aa, Oryza sativa (japonica cultivar-group)
MAMHRFSLCCVVLLVLAPLAAVAWRPWPPRNGSGEVEGIGASKKFEGSSDFVKLQYHMGPVLAADITVHPIWYGRWPAEQKRTIRAFLRSLSPPGSGLRRWRHPVAVRGGVVAHRAAVHRPDLGERVRGGEARAGESVVRDAVTARTRPLPVDSSGVYLVLTSPEVVVENFCGQVCGFHYFTFPSVVGYTLPYAWVGNSAARCPEVCAYPFAIPSYVGGGRRAEAPPNGDVGVDGMVSVIAHELAELASNPLANAWYAGEDPSFPTEIADLCEGIYGTGGGGAYTGQLLTDGRSGASYNVNGVGGRKFLVQWVWNPILSYCSGPNALDQ

SEQ ID NO: 16644 - protein, 589 aa, Oryza sativa (japonica cultivar-group)
MLHILPPFHNEEDLKQFRQWGSKTPGHPENFETPGVEVTTGPLGQGIANAVGLALAEKHLAARFNKPDSEIVDHYTYCILGDGCQMEGISNEACSLAGHWGLGKLIAFYDDNHISIDGDTEIAFTEDVSARFEALGWHTIWVKNGNDGYDEIRAAIKEAKAVTDKPTLIKVTTTIGFGSPNKANSYSVHGSALGTKEVEATRENLGWPYEPFFVPEDVKSHWSRHVPQGAAFEADWNAKFAEYEKKYPEDAATLKSIVSGELPAGWADALPKYTPESPADATRNLSQQCLNALAKVVPGLLGGSADLASSNMTLLKMFGDFQKDTPEERNVRFGVREHGMGAICNGIALHSPGLIPYCATFFVFTDYMRAAMRISALCEAGVIYVMTHDSIGLGEDGPTHQPIEHLVSFRAMPNILMLRPADGNETAGAYKIAVLNRKRPSVLALSRQKLAQLPGTSIEGVEKGGYIVSDNSTGNKPDFIVMSTGSELEIVAKAADELRKEGKTVRVVSFVCWELFDEQSAEYKESVLPEAVTARVSLEAGSTLGWQKYVGSKGKAIGIDKFGASAPAGKIYQEYGITAENVIATAKSL

SEQ ID NO: 16645 - protein, 203 aa, Cucumis sativus
VLTGDSGVGKSNLLSRFSKNEFRFDSRPTIGVEFAYRNIKVADKLVKTQIWDTAGQERFRAITSSYYRGALGALLVYDITRVATFDNIKKWLRELREFGNPEMVIILVGNKCDLHQSREVQEEEARHLAELENLFFMETSAKDNLNVEEAFLEMVRRIHAIASQKTLDLHKKFEKLVAFPNGKEIISIHEVTPTKPNSNCCSL

SEQ ID NO: 16646 - protein, 541 aa, Thermus thermophilus HB8
MEGERMNAFPSTMMDEELNLWDFLERAAALFGRKEVVSRLHTGEVHRTTYAEVYQRARRLMGGLRALGVGVGDRVATLGFNHFRHLEAYFAVPGMGAVLHTANPRLSPKEIAYILNHAEDKVLLFDPNLLPLVEAIRGELKTVQHFVVMDEKAPEGYLAYEEALGEEADPVRVPERAACGMAYTTGTTGLPKGVVYSHRALVLHSLAASLVDGTALSEKDVVLPVVPMFHVNAWCLPYAATLVGAKQVLPGPRLDPASLVELFDGEGVTFTAGVPTVWLALADYLESTGHRLKTLRRLVVGGSAAPRSLIARFERMGVEVRQGYGLTETSPVVVQNFVKSHLESLSEEEKLTLKAKTGLPIPLVRLRVADEEGRPVPKDGKALGEVQLKGPWITGGYYGNEEATRSALTPDGFFRTGDIAVWDEEGYVEIKDRLKDLIKSGGEWISSVDLENALMGHPKVKEAAVVAIPHPKWQERPLAVVVPRGEKPTPEELNEHLLKAGFAKWQLPDAYVFAEEIPRTSAGKFLKRALREQYKNYYGGA

SEQ ID NO: 16647 - protein, 187 aa, Brassica napus
MARRKSNAPPKATRQPAKQKFSSAERSSLYASREAAKVLGTALRGDAERRAVASIKSLVFSPSVRNKRGTFALVCETLKHLTVIKEVLEIANALNSKWKRQEPLVYIICYDILFGKEPPLIGDAEKFLMKRKDALVSSLATLLVRKRVKSVEELLDHSQLNGHIKQRYVRVNTLKMDVDSAVKELEK

SEQ ID NO: 16648 - protein, 888 aa, Marinobacter sp. ELB17
MYQDDDPIETTEWLDALESLIEQEGVDRAKYILERLSERASRDGTELPYAITTPFRNTIPLAQEARMPGDLFMERRIRSLIRWNAMAMVVRASKRPGDLGGHISTFSSAATLYDVGFNYFFHGGDEKRESDLVYFQGHASPGIYARSFLEGRFEEAQLDKYREEVDGGGLSSYPHPWLMPDYWQFPTVSMGLGPIQAIYQAHIMKYLDSRELVEMENRKVWCFIGDGECDEPETLGCISKASRENLDNLVFVVNCNLQRLDGPVRGNGKIIQELEGAFRGAGWNVIKVVWGRMWDPLFEQDEDGTMQRAMDEVVDGELQAFTNGGPAATRKQFFGKYPKLAKMIENWTDDDIQTLNRGGHDPYKVYAAYKKAATEANGKPTVILAHTIKGYGFGAAGEATNTAHSLKKLDVETLKSFRDRFAIPVKDEELEDVPYYRPAPDSPELVYMKKRRQDLGGFYPKRRKDSQPLQIPDLDIFKQVLDGSNGREISTTMSFVRILSALVKDKRVGKRVVPIVPDEARTFGMEGMFRQLGIYTSEGQKYVPPDRDQIMYYREDKKGQILQEGINEGGAMAAWIAAATSYSNNNFPLIPFYAFYSMFGFQRVGDLAWAAGDIQARGFLIGGTAGRTTLNGEGLQHQDGHSHILANTIPNCRAYDPAYAYEMAVVIHHGMKEMYEKNTNVYYYITMENENYVQPAMPEGCADGIIKGMYKFSSVEAKGKGKTKLRVQLLGSGAILNEVNAAAELLKDDWGVSSDVWSVTSFNELARDGQHVERWNLMHPDDKGRKAYVTQCLENQAGPVVSSTDYIKLHSEQLRAFIPKTFLTLGTDGFGRSDTREKLRDFFEVDRYHVAVAALSALAKDGEIKHEQVLEAMRKYGIDRNKPNPAHR

SEQ ID NO: 16649 - protein, 1162 aa, Brucella melitensis 16M
MPKRTDIKSILIIGAGPIVIGQACEFDYSGTQACKALKEEGYRIILVNSNPATIMTDPDLADATYIEPITPEVVAKIIAKERPDAILPTMGGQTALNTALSLRRMGVLERYNVEMIGAKAEAIDKAEDRALFREAMKKIGLDTPGSMFANATEIKDEDRKRHEVKRAEVKAQFSGDELDKALDKLETEWQLGEVERKQRYMSHALAKAAQALDVVGLPAIIRPSFTLGGTGGGIAYNRQEFFEIIERGLDASPTTEVLIEESVLGWKEYEMEVVRDHADNCIIICSIENLDPMGVHTGDSITVAPALTLTDKEYQIMRNASIAVLREIGVETGGSNVQFAINPANGRMIVIEMNPRVSRSSALASKATGFPIAKVAAKLAVGYTLDELDNDITGGATPASFEPSIDYVVTKIPRFAFEKFPGSSPILTTAMKSVGEVMAIGRTFQESLQKALRGLETGLTGFDEIAIPNIEEGDEKNAIRAAIGTPTPDRLRMVAQAMRLGLSVEQVHDASKIDPWFLEQIESIVKTEERIREHGLPQDAENLRMLKAMGFSDARLASLTAKDAEDVAKLRADLDVHPVYKRIDTCAAEFASPTAYMYSTYETPFVGQPRSEAEVSDRKKVVILGGGPNRIGQGIEFDYCCCHAAFALGDADYEAIMVNCNPETVSTDYDTSDRLYFEPLTAEDVLEILRVEKQKGTLHGVIVQFGGQTPLKLANALEKAGIPILGTSPDAIDLAEDRDRFQKLLIKLDLNQPKNGIAYSVEQARLVAADLGFPLVVRPSYVLGGRAMQIIHDERGLQAYLLDTVPELVPEDIKAKYPNDKTGQINTLLGKNPLLFDTYLTEAIEVDVDCLCDGKDSLVAGIMEHIEEAGIHSGDSACLLPVHTLSPEIVAELERQTAALATALHVGGLMNVQFAIKDGEIFILEVNPRASRTVPFVAKTVGTPIAKVAARIMAGESLEAAFDAYGGKPQPTARPHIAVKEAVFPFARFPGVDTLLGPEMRSTGEVMGLDYDYALAFAKAQLGAGVELPREGTVFVSVRDEDKERVLGPVRKLASIGFKVMATGGTQKFLEANGVESTKINKVIEGRPHVEDAIRNRQIHLVFNTTDSASAVSDSKSIRRATLMQKLPYYTTMAGAESAAEAIAALKAGSLEVRPLQDYFRS

SEQ ID NO: 16650 - protein, 243 aa, Glycine max
  misc_feature (94)..(94): Xaa can be any naturally occurring amino acid
PTRPAMCRTWEVLARKKNDLGELPLPMAIYVVSGDEDGERGGAPVVCIEDASKRCFEFSSGLAAWTPLLLLVPLVLGLDKVNPRYIPLLRSTFXFPQSLGIMGGKPGASTYIIGAQNEKAFYLDPHDVQQVVNISGDTQEPTSTSSYHCNIMRHIPLDSIDPSLAIGFYCRDKDDFDDFCSQASKLAEESNGAPLFTVTQSRSFSKQVSNDVSGDNTGFQEDDFPGMDCGNDTVTNEDDWQLL

SEQ ID NO: 16651 - protein, 344 aa, Aspergillus nidulans FGSC A4
MAANKALVFKKIPDGYPVPGEHLTIEPAAYDASAAAPADGVFLQSLYTSFDPYMRGRMRSAEIKSYAPPFYLDKPIESASIAKVIRSNNGSYKEGDLVIGRLPIQEYVAVEKDELSRIRHLENPLGIEDIRVFLGALGMPGLTAYSSLYEIGQPKKGETIFVSAASGAVGQLVGQLAKHEGLKVIGSVGSDEKLNYIINDLGFDGGFNYKKEKPADALARLAPNGIDIYYENVGGEHLEAALEAINNFGRVVVCGMISQYNSAPYPIKNIAYVLTKRLTMRGFIVGDAGMGDKYTKEHQENVQKWIKDGSFKTLIHETEGIENAAEGLVGIFYGKNLGKAVLKF

SEQ ID NO: 16652 - protein, 377 aa, Methanocaldococcus jannaschii
MFINGDVMLSKRLLNFESFEVMDILALAQKLESEGKKVIHLEIGEPDFNTPKPIVDEGIKSLKEGKTHYTDSRGILELREKISELYKDKYKADIIPDNIIITGGSSLGLFFALSSIIDDGDEVLIQNPCYPCYKNFIRFLGAKPVFCDFTVESLEEALSDKTKAIIINSPSNPLGEVIDREIYEFAYENIPYIISDEIYNGLVYEGKCYSAIEFDENLEKTILINGFSKLYAMTGWRIGYVISNDEIIEAILKLQQNLFISAPTISQYAALKAFEKETEREINSMIKEFDRRRRLVLKYVKDFGWEVNNPIGAYYVFPNIGEDGREFAYKLLKEKFVALTPGIGFGSKGKNYIRISYANSYENIKEGLERIKEFLNK

SEQ ID NO: 16653 - protein, 386 aa, Medicago sativa
MAIHHHHHNHQQLQQHTSSLFDALYCDEEEKWEDDDEGEVVDEGAQSDVTTTNYDILDSTSLLPLLLLEQNLFNEDEELNTLFSKEITQQETYYEDLKNVINFDSLSQPRREAVEWMLKVNAHYGFSALTATLAVNYLDRFLLSFHFQKEKPWMIQLVAVTCISLAAKVEETQVPLLLDLQVQDTKYVFEAKTIQRMELLILSTLKWKMHPVTTHSFLDHIIRRLGLKTNLHWEFLRRCENLLLSVLLDSRFVGCVPSVLATATMLHVIDQIEQSDDNGVDYKNQLLNVLKISKEKVDECYNAILHLTNANNYGHKRKYEEIPGSPSGVIDAVFSSDGSNDSWTVGASSYSTSEPVFKKTKNQGQNMNLSPINRVIVGILATATSP

SEQ ID NO: 16654 - protein, 785 aa, Burkholderia xenovorans LB400
MSTTPPTATEVEHDADSPSSARKYIDAVLEQSFRHLFGPTATPEQPRRHDVVSIAKLTSALSGYLQPEEIKEVKAAFHFSDEAHLGQYRQSGEPYITHPVAVAEICAGWNLDAQSIMAALLHDVMEDQGVTKAELAERFGAKVAELVDGLSKLDKMEFRNREEAQAENFRKMLLAMARDVRVILVKLADRLHNMRTLGAVPAEKRRRVARETLDIYAPIAHRLGLNNTYRELQDLSFANFNPHRYATLEKAVKAARGNRREVVGKILESVQRAIADAKLDAEVTGREKTIFSIYKKMRDKQLSFSQVLDVYGFRVVVESALECYTCIGALHALYKPVPGKFKDYIAIPKVNGYQSLHTTLVGPFGAPIEFQVRTRKMHEIAEAGVAAHWLYKNGGADLNDVQKRAHQWLKSLLDIQSEAGDSSEFLEHVKIDLFPDAVYVFTPKSKIMALPRGATALDFAYSIHSDLGNQCVAVKINNELLPLRTELKSGDIVEVITAPYSKPNPAWLGFVRTGKARSAIRHYLKTMRLNESVQLGERLVDQALKGYGLALSDVTPEAWEKLVQWTGNKNRQEIFADIGLGRRVAAVMAKRIEVLMSGRDADDDGSRSDSNAPHAPPVVITGTEGMSVQLSACCRPIPGDDIMGYIGIGLGMAIHTTDCRVAQRIHRRDPGRWIDVAWAPQPGRLFDVAVKVLVKNTKGVFARVAADITSADANIVHIAMDEDLSQESTVLRFVIQVSDRVHLANVMRRVRTNPDVMRIARERPSEEGHHRHEGGMRIDRERADY

SEQ ID NO: 16655 - protein, 62 aa, Brassica napus
MRGILVDWLVEVAEEYTLVPDTLYLTVYLIDWFLNGNYVERNRLQLLGVTCMLIASKYEEIY

SEQ ID NO: 16656 - protein, 418 aa, Rhodococcus sp. RHA1
MATAEQTFVIVGAGLAGAKAAEALRTGGFDGRIVLIGDETDRPYDRPPLSKAYLQGTTAREKIYIHPAGWYTDHDIELRVGTPVTALDRTEHEVVIDGVERLGYDKLLLTTGSSPRRLQVPGADLDGVHYLRRVTDCETMKAAFAAADRVAIVGAGWIGLETAAAARAAGCAVTVVGRSKLPLLAVLGAEVAETYAALHRDHGVELRLNSGVREIVGKDNRATGIRLTDGTVVEADAIVVGVGIVPNTALAETAGLAVDNGIVVDEHLATTDPDVFAAGDVANTFYPLLGTHLRLEHWSAALNQGPVAAENMIGRVTAYDQVPYFFSDQYDSGMEYSGYVPHGSYDSVVFRGDVAAGEFIAFWMRDGRVLAGMNVNTWGVTDAIEALVRSGERVDPAKLADPDELLRYLADRVPGGAR

SEQ ID NO: 16657 - protein, 226 aa, Brassica napus
  misc_feature (213)..(213): Xaa can be any naturally occurring amino acid
MAEPTQPLLNDSNSSPPRSLDDTIESYIGSFGWAQFLQATLVSFSGVFDAQQTFISVFTDFEPKWHYTESFCHDSISNICILPKTSWSWDFPPHVSVISEWGLQCSGSFVKGLPESSFFVGCLIGGLILSTLADSSLGRKNMLFLSCLLMSISAMLTVFSPNIWVYAFLRFVNGFGRATIGTCALVLSTELVGKRWRGLVGIMSFFGFMLGFXSLPAMAYMNRGNS

SEQ ID NO: 16658 - protein, 502 aa, Caulobacter crescentus CB15
MATLEAFWRLTGAGWALVRADALIPRELEPLLPPSAKLAGRVLRLFAGPAARKGRPGERLAAVLERQGPAAIKMGQFLSTRADIFGAAFADDLSRLKDRLPAFPLSVAKAEIARNLGKPLDEIFAEIGEPVAAASLAQAHPATLVDGQKVAVKVLRPGVERQVARDTAVLRLAARLAETLVPVSRRLRPTEFVEVVIRALELEMDLRFEAAGCAELGEAMAKDPYMRAPAVCWEGVGKRVLTLSWAEGAPLSDPAALDLPGLDRKALAENVTRGFLAQALDHGLFHADLHEGNLFIAAPAAITAVDYGIVGRLGPGERRYLAEILYGFLNRDYARVAKIHFDAGYVPAHQDMDAFAQALRAVGEPVFGRNAREVSMGRLLAQLFEITALFDMALRPELVLLQKTMVTVEGVARRIDPTHDLWAAADPVVRRWIGRELSPAAKARDFAEEAIRAIKALARLAETPTTPPPVAAERLHTWPLLWFLVGAATAGAAFVTGVLLAR

SEQ ID NO: 16659 - protein, 130 aa, Xanthophyllomyces dendrorhous
MVRISVLNDCLNNIVNAERRGKRQVLIRPSSKVVVRFLSVMQQHGYIGAFEIVDDHRAGKIVIELNGRLNKTGVISPRFNVQVDEIESWVNLLLPARSFGLIILTTSAGIMDHEEARRKHVGGKLLGYVY

SEQ ID NO: 16660 - protein, 1028 aa, Thermus thermophilus HB8
MPPRRDLKKILIIGSGPITIGQAAEFDYSGTQAVKALRGAGYRVVLVNSNPATIMTDPELAERTYIEPLDLEHLEGILAREAPDALLPTLGGQTGLNLAMALHEEGILQKYGVELIGAKAEAIRKGEDREAFQEAMQRIGLEVPRGQLVGSVEEGLHFAREVGFPVVVRPSFTLGGTGGGIAHDEAELVEVLSRGLTLSPVHTALVEESVLGWKEFELEVMRDHADTVVIITSIENVDPMGVHTGDSITVAPAQTLSDVEYQRMRDAAKAIIREIGVETGGSNIQFAVDPKTGRQVVIEMNPRVSRSSALASKATGFPIAKIAALLAVGYRLDELPNDITRKTPASFEPTIDYVVVKIPRFAFEKFRPLRNTLGELKDELTTQMKSVGEVMAIGRTFKEALMKALRGLERDVRALAGVRTEELEKKLYPNPDRVYAVMELLRRGMPVEELYQATRIDPWFLHQMKEVVEAEEWLKTHPPKDREDWRFYKGLGLTDRRIGELVGKGEKEVRAERKALGVVPVYKTVDTCAAEFEAYTPYHYSTYELEDEVWPSQKPKVVILGSGPIRIGQGVEFDYATVHAVWALKEAGYETIMVNSNPETVSTDYDTADRLYFEPLTLEDVLNIVEHEKPIGVIATLGGQTPLKLAKGLEEAGVRLLGTPFSAIHQAEDREAFHALCQRLGIPQPEGRVAQSPEEALRLAPEVGFPLLVRPSYVLGGRAMQVVRDEGELKRYLEEVYAPLEERPSILLDRFLEGAVELDVDALSDGQEVMVAGIMEHVERAGVHSGDSATLLPPVHVPEEALKKVRDYTRRLALALGVRGLLNVQYAVVGEEVYVLEANPRASRTVPFVSKAIGVPLAKLAALIAVGKTLKELGVRDLDPVPPYYAAKEVVIPWIKFPGVIPELGPEMRSTGESMGIDQDPYLAYYKAELGAGQRLPLSGRVRFIGEGLEDLKALYQEAGFALTEGEDYDLLISLVPDPELRRAVERGLPFITTREGAWWSLKAILRARESGLRVQSLQDWHQKAPRG

SEQ ID NO: 16661 - protein, 426 aa, Zea mays
MSSSMQSSYLPATTESVAKAQEAKDASESISILYHVLEDPSSSADALRVKELAITNLTNYLTKENRAEDLRNLLTQLRPFFALIPKAKTAKIVRGIIDAVAKVPGTSQLQISLCKEMVEWTRAEKRTFLRQRVEARLAALLLENQEYTEALTLLSGLIKEVRRLDDKLLLVDIDLLESKLHFSLRNLPKAKASLTAARTAANAIYVPPSQQGTIDLQSGILHAEEKDYKTAYSYFFEAFEAFSSLEDPKAIFSLKYMLLCKIMVNQADDVAGIISSKAGLKYLGPDVDAMKAVADAYSKRSLKYFETALRDYKAQLEEDPIVHRHLSSLYDTLLEQNLCRLIEPYSRVEIAHIAEMIELPMNHVEKKLSQMILDKKFAGTLDQGAGCLIIFEDSKTEEIFPATLETITNVGKVVDSLYMRSAKIMA

SEQ ID NO: 16662 - protein, 371 aa, Oryza sativa (japonica cultivar-group)
MTNKWSVLREEFTFSEGNVPFKTCHASTIVEVQKNMFLVAYFGGTQEGADDVKIWLQRYYNGSWHSPEVVDEVPNVPLWNPVLFQLPSGEILLFYKVGKTVESWSGCMKCSSDGGVIWSKREQLPPGILGPIKNKPFLLKDGHLLCGTSVESWNSWGAWLEVTKDHGKTWKKYGPIYVRGKTMGVIQPVLYQTSSGTIRMLLRPSDEVGRICVAESKDSGVNWSYAQPTELPNPNSGIDGVKLKDGRVVLVYNSTSRGVLKVAVSQDDGDKWEDVLTLEETHGVEFSYPAVIQTSDGLVHVTYTYKRTQIKVVLPMLFGLLMVITSFIIFHVKNEFLLVTALCSMSFYNQARFDAVSNQTCGFVSGVKFEL

SEQ ID NO: 16663 - protein, 363 aa, Bacillus subtilis subsp. subtilis str. 168
MAELNKTKVRKELRTERPSIYSFELDEIKQWLTDNGEKPFRAAQIFEWLYEKRVSSFEDMTNLSKDLREKLNTRFVLTTLKTAVKQTSQDGTMKFLFELHDGYTIETVLMRHEYGNSVCVTTQVGCRIGCTFCASTLGGLKRNLEAGEIVAQVVKVQKALDETDERVSSVVIMGIGEPFDNFNEMLAFLKIINHDKGLNIGARHITVSTSGIIPKIYEFADQQMQINFAISLHAPNTEIRSRLMPINRAYKLPDLMEAVKYYINKTGRRISFEYGLFGGVNDQVEHAEELADLLEGVKCHVNLIPVNYVPERDYVRTPRDQIFAFEKTLKSRGVNVTIRREQGHDIDAACGQLRAKERQDETR

SEQ ID NO: 16664 - protein, 455 aa, Salmonella enterica subsp. enterica serovar Typhi str. CT18
MSFDSLGLNPDILRAIAEQGYREPTPIQQQAIPAVLEGRDLMASAQTGTGKTAGFTLPLLQHLITHQPHAKGRRPVRALILTPTRELAAQIGENVRDYSKYLNIRSLVVFGGVSINPQMMKLRGGVDVLVATPGRLLDLEHQNAVKLDQIEILVLDEADRMLDMGFIHDIRRVLAKLPAKRQNLLFSATFSDDIKALAEKLLRNPLEIEVARRNTASEQVTQHVHFVDKKRKRELLSQMIGQGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRITTPGYEPDPSIKAEPIQNGRQQRGGGGGGRGRGQNQGGAGRSQQPRRQDSGAAKAKPKPRTGEGKPAGDKARPPRRPRRITPAQ

SEQ ID NO: 16665 - protein, 134 aa, Burkholderia xenovorans LB400
MADSQHGSHLPRTENPATLSKPGGHYSHVAIANGFVFVSGQLPITPQGGKLSEASFEVQAEQVLANVQAALESAGSSVAQLVQVRVYIVDVEHWMSFNQIYARWAGEARPARAVVPVPQLHYGFRIEVEATALV

SEQ ID NO: 16666 - protein, 427 aa, Burkholderia xenovorans LB400
MSKNETLFERAQRTIPGGVNSPVRAFRSVGGTPRFIERAQGAYFWDADGQRYIDYIGSWGPMILGHVHPEVLEAVQRVLGNGFSFGAPTESEVEIAEEICKLVPSIEQVRMVSSGTEATMSALRLARGFTNRTRIVKFEGCYHGHADSLLVKAGSGLLTFGNPTSAGVPADIAKHTTVLEYNNVAELEEAFKAFGNEIASVIVEPVAGNMNLVRATPEFLQALRRLCSEYGSVLIFDEVMCGFRVALGGAQEVYGITPDLTCLGKVIGGGMPAAAFGGRRDIMAHLAPLGGVYQAGTLSGNPIAVAAGLKTLQLIQAPGFYDTLAARTTRLAQGLANVAREARVPFAADSLGGMFGLYFTESIPTSFAEVTQSDVPRFNAFFHKMLDAGVYFAPSAYEAGFVSIVHDDAIIDATIDAARGAFASLAA

SEQ ID NO: 16667 - protein, 343 aa, Brassica napus
  misc_feature (13)..(13): Xaa can be any naturally occurring amino acid
VDPRVRWTLMSFXKLGFSEHEILESLDEENVVGGGASGKVYKVVLTNGETVAVKRIWTGSVKETEDTDPEKGDRPGVQDEAFEAEVETLGKIRHKNIVKLWCCCTTRDCKLLVYEYMPNGSLGDLLHSSKGGTLGWETRFKIILDAAVGLSYLHHDCVPAIVHRDVKSNNILIDGHYGAKVADFGVAKVVDLTGKAPKSMSVIAGSCGYIAPEYAYTLRVNEKSDIYSFGVVILEIVTRKRPVDPELGEKDLVKWICSTLDQKGVEHVIDPKLDSCYKEQISKILNVGLLCTSPLPINRPSMRRVVKMLQEIGGGDEESLNKTRSGKLTPYYYEETSDQGSVA

SEQ ID NO: 16668 - protein, 202 aa, Glycine max
MGSSGFSWKLADHPKLPKGKTVAVVVLDGWGEATPNEYNCIHKAETPCMDSLKKGAPERWRLVRAHGTAVGLPTEDDMGNSEVGHNALGAGRIFAQGAKLVDLALASGKIFEGEGFKYIKECFENGTLHLIGLLSDGGVHSRLDQLQLLLKGVSERGVKRVRVHILTDGRDVLDGSSVGFVETLENDLANLRAKGVDARIAS

SEQ ID NO: 16669 - protein, 84 aa, Triticum aestivum
  misc_feature (40)..(40): Xaa can be any naturally occurring amino acid
TYHYYRPAQNNWDLGAPAVSAYCATWDASKPLSWRSKYGXIVDQCANGGLDLDWDTVFTKIDTNGIGYQQGHLNVNYQFVDCRD

SEQ ID NO: 16670 - protein, 362 aa, Arabidopsis thaliana
MATVTDLPDDLVREIFSRVPLTSLRAVRSTCKKWNAISKYDILGKKAAAKNQFLEFMVTDSRVCSLRLDLQGIRSEEDLIDLSIKQISIPNKVDQVEISQVYHCDGLLLCIAKDNSSVMVWNPYLGQTKLIQPRKKLHRYDKFALGYDNNRNHKILRFLYEGSPRNVIIDVYDFSSDSWRVLDIDIDWHELFSHNSVSLKGNTYFFGRKGPRLPMLFKPPSRRFEYLTLSCVRNEKLAVLYSHLNRFGTIEICISTKIDPSAVSWTTFLRIDMTLINGLPDNFFVHSYATSFFFDEEKKVAVLFGTNRYRGRETCQYYQRACIVGDSGYFKAVNIELVFNSQLQSCQLVSSSYVPSLVQLQD

SEQ ID NO: 16671 - protein, 900 aa, Glycine max
MAEEEEDDESFGDFTFASFPSQPTSNDTNPVDDDDDWGDFMNHSNQINGKPFDAFGVPTDPTNKHVNDNNGVAVQAEAAKKPKGAIPLSIFGEEEEEEEEQQEKPASANVFSNGGGGAVKRGSDSNGSVGISDLISSLYNQQRPQVDSHNNGSVSVSNVDAPNSTNSNGSKLNSDEVDEDDDGWEFKSAEWETGTKSQDVKAETPKHDSGALDVGTVLDSSNGISDKAGGWHMEFEFSPRFASQDHINPQPSPKNESNDIGTGFAMFNQNFGEFSSGSGPGPNQNLEAPKKAGICATNMELLKFNGATPHGTIDSSLTSESHQSDEWNFGFNFNSSYVGEDNHSSDSYFKTKNNQDDNNRNNASPTNIDVDSHVNFFDSESDVTQHEKPLTSPENRREALPLSIFGDETPDTDEHPVSQDLSPYTPSSPIRNSFTSPGSNFSINDIWNLYNQAENQSSSNVTPKASENQIHAPPEVSGSSLVTGNDDLDDDFWDYKDAATETRFTNESAQKTSSPQVNENGLQSSPTFLNSDLTNGDDDFEDDSWEFKEATSGTINQDHTSTLDHRGLPQLSTKLEQVDYAEFYSKVKDELCNYVLFHLQNLKKTQNVAALSGEDAKAKALQEEISEFSKILHQDTMSIPNEYLSEDYCPRNVRFNELLEVLKEPKFQPVESEYQLASRLSMAEKDIKYGMELLKDTVSTLRILKLGSREEQSSYLTIWSKIAFVCSQELKHGAYVWKQAVLQNVHDQILSSQKGVQYILALGEIYRVAEIIEASAKLHKPWMLSGAIDHKSLCALLNECYSIWLASGLEEALLSIANQNNFELDGISRELVESIKYIHELDEHALQSFVISGEQTTCQLSALPAGFIPGLNLVKWNGKHYIVKLANLWINLISSDPPKK

SEQ ID NO: 16672 - protein, 487 aa, Methanocaldococcus jannaschii
MWWILMESIKKVMVFGSGPIVIGQAAEFDFSGSQACKALKEEGIYTILVNSNPATIQTDTDMADKVYLEPLHPTIVEKIIEKERPDAILPTMGGQTGLNLALELHRRGILDKYGIKLLGSNIRTIEIAEDRELFAEAMAEINEPVTKCKAVNSVDEAVEFAEEIGYPVIVRPAFTLGGTGGGIAHNKEELIDITSKGLKYSIINQVLIDESVLGWKEFELEVMRDRKDTCIIVCGMENIDPMGIHTGESIVVSPIQTLPDEFYQKLRNAAIKIIRHLGIEGGCNIQFAVNKEMTEYRVIEVNPRVSRSSALASKATGYPIARIAAKIAIGKTLDEILNDVTKETPASFEPTLDYVVVKIPRWPFDKFKTVDKKLGTSMKSTGEVMAIGRSFEEALQKAIRSLDIGRFGIIGDGKDKDYTDEEIEEILKNPTDERIFVIAKALEKGWSVEKIVELTDIDEFFIKKIKNIVDMKKELEKLKEEIKKLNA

SEQ ID NO: 16673 - protein, 394 aa, Staphylococcus epidermidis ATCC 12228
MKLSLNSSSKFLRAPSIRQFSNRIKAIDDCVNLTIGQPDFPMPDVVKNAYIKAIKNDKTSYSHNKGLFETREAISQYFKRKYNFLYSEEEIIVTNGASEALDTSLRSIIEPGDDILIPGPIYAGYIPLVETLGGNPVYIDTTQSDFKVTPELIESHLTHKTKAILLNYPTNPTGVILERSEVKNIVDTLVNKHIFIISDEIYAENTFKEQHTSFAEFPEIRDQLLLIGGLSKSHSATGIRIGFLLGPEYLIEKLTFMHAYNCICANVPAQIACTTALNEGINAPLYMNRDYIERRNYLKEKLESLGFELTAQPEGAFYIFPSIKRFTENDFEFCVDVLEKAHLAMVPGSSFTDIGKGYIRISYAYDMETLKKGMHRLENYLQQHYPEQMTTPTK

SEQ ID NO: 16674 - protein, 131 aa, Sulfitobacter sp. EE-36
MMQKQTEGTAMDFDTSTLKFNEAGLIPAIAQDATTGEVLMMAWMNAQAVTQTLETGRVTYWSRSRQSFWIKGDTSGHVQELVELRIDCDRDCLLVKVHQTGAACHTGRRSCFYTLVEDGAERITLDVMDDE

SEQ ID NO: 16675 - protein, 1061 aa, Coprinopsis cinerea okayama7#130
MKSILIALAALIQLATATPYSRQPSAHPFTFIPHGGGGGDHPAEPGSSTFWEKVFVSVALVLIGGVFAGLTLGLMGLDELHLRVLSASSDDPKEKKNAQKVLKLLEKGRHWVLIVLLLGNVIVNSTLPLFLDSALGGGLAAVVVSTFAIVIFGQKLTFNRVIPQAICVRYGLSIGAACAPLVLAMMYIFAPIAWPLAKLLDWALGKHDHHTYKKAELKSFLQFHRTGEEPLRDDEIAILNGVLELNTKKVEQIMTPMKDTVILSADTVLDHSAVDAILTSGYSRFPVHEPGNPLAFMGTLLIKKLLTYDPAKALPVSSFPLTILPEAHPTINCFQALDYFQTGRAHLLLISRTPGQAGGAIGVITLEDIIEEIISEEIVDETDRYEDNRSKRQARRVTTASIMRGIVERERRRGESSERSALLGGGINIGSQTNSLEVRGYGSIPEGISQSPTAHEDEDLQRTPKNSHIKFTYKNYTVAALDAGLVNFAKERSWTSPMTLEDWSLSVAGLACATSCIGKSNKNKRNREATVGRLIEVFDYIEDSLEALVRSAVDPVIFAAALDMEAILTLVATNISNMINLDPRLEAHVFSSPILTNIVLRMWTMRKPDNEGEVYLNYSPDPDGVDILDLVANYLSRQDGVNTITLALLSSRVKLREFANAFVARLVQLAQNPPPSTADAISGRSRHFSRLYTIASALAKDLTIYGALRRAGFLQCWAQSLSILLANPRPRDFNALVLISHAFLLAWDSKGDAVSAVRDVLEGGIIDPLAKALSVVRLGGDLEKINTAKLLIVKLAEYSFCPRTLSVMDMQMLKVGKTVHQQIEEKKEVGERWEALVSTLEWRNMIRRLTSKMKLNICDNAMHPHDFEDRAYLKDGHVPFKGCSDCHMVIYCSKKCQLEDWRNRHRDECSDMRRAYIDSKNSKRRYHQSTRDYHVKFTEWMFNKSQMSIDISLMEKGLQNTQVVTISDSSRGLNIRSLDHRTWHEYYSYRLPSLCPAIDKRADDMIEEFKRNGTETSYLMDTAFTNGPEEAVSVLVRLERYYDKLTKGPRWTAIQSVARVV

SEQ ID NO: 16676 - protein, 272 aa, Triticum aestivum
  misc_feature (66)..(66): Xaa can be any naturally occurring amino acid
MAARSRARRLLPLLTFVALGMVLGSLLQLAFFRRLDDHSHTGHFDNDQEAADLRLGYVKPEVISWXPRIIVFHNFLSSEECDYLREIARPRLEISTVVDVATGKGVKSDVRTSSGMFVNSEERKFPVIKAIEKRISVFSQIPVENGELIQVLRYEPSQYYRPHHDYFSDTMVHLQFNPQRGGQRVATMLMYLTDGVEGGETHFPQAGDGGECSCGGRMVRGLCVKPNKGDAVLFWSMGFDGNTDSNSLHSGCAVVKGEKWSATKWMRQKMTF

SEQ ID NO: 16677 - protein, 822 aa, Burkholderia vietnamiensis G4
MAGLAPTFGRGAMTNHWVDIKNADVILVMGGNAAEAHPCGFKWVTEAKAHRKARLIVVDPRFTRTASVADYYAPIRTGTDIVFLGGVINYLLTNDKIQHEYVKNYTDFSFIVREDFAFNDGIYSGYDAEKHAYPDKSSWDYERGDDGFVKVDPTLQHPRCVYNLLKQHYGRYTAELVQQVCGTPKEKFLKVCEMLATTAVPGRAGTVLYALGWTHHSIGAQIIRTGAMVQLLLGNIGIAGGGMNALRGHSNIQGLTDLGLMSNLLPGYMTLPMQAEQDFDGYIKKRAQQPLRPNQLSYWKNYKAFHVSFMKSWWGDAASADNNWAYDYLPKLDKQYDLLQAIELMSAGKMNGYICQGFNPLAAAPSKAKTAAGLARLKWLVVMDPLATETSEFWKPHGDFNDVDASKIQTEVFRLPTTCFAEENGSLVSSSRVLQWHWKGAEPPGEARSDLEIMSGLFLRMRKMYQAEGGKYPDPIVNLTWPYANPESPTPEELAMEFNGRALADLPDPKDPTKTLVKKGEQLAAFAQLKDDGTTASGCWIFCGAWTQAGNQMARRDNADPTGIGQTLNWAWAWPANRRILYNRASCDVSGKPFDPTRKLIGWNGSAWKGADVPDFKADEPPENGMGPFIMNPEGVARFFARAAMNEGPFPEHYEPFETPLAANPLHPDNPQALNNPAARVFADDRASFGKVSEFPHVATTYRLTEHFHYWTKHARLNAIIQPEQFVEIGEDLAKEVGVAHGDRVKVSSKRGYIVAVALVTKRIKPLTIDGKKVQTVGVPLHWGFKGVAKPGYLANTLTPSVGDGNSYTPEFKSFLVKVEKA

SEQ ID NO: 16678 - protein, 350 aa, Coprinopsis cinerea okayama7#130
MIRYRLTLGLMGLDELHLRVLAASSEDVNEKQNAQKVLNLMQGRRHWVLVVLLLSNVVVNESLPIFLDNALGGGVSAIILSTAAIVIFGIIPQAVSVRYGLAIGATCAPLVSAMMLVMAPITYPVARLLDWALGAGERHTYRKAELKSLLQFHKTGEEPLRDDEINILSGVLELGSKNIETLMTPLQDTFVLSSDDILDQKAVNAIMNSGYSRFPVHLPGRPKAFIGLLLVKKVLHIALLTYDPKQALPVCAFPLSILPEAHPSINCFQALDYFQTGRAHLLLVSLTPGHEGGALGVVTLEDIIEEMITEEIVDETDRYSDNQSKVIAPRAATELIMNNINPVNVGASTM

SEQ ID NO: 16679 - protein, 1453 aa, Ustilago maydis 521
MAAVGPTALGNASGADSYIASQQTVHRDETLPHTAAQSETNSAEASSDHHVDVGSAERQFNELSRQLSSKYAKDSDVEKHQPFDLRNWLSGTLEQADQMGNKRKSLGVSWSDLRVIGTASRDFNVPTIPSMALFEIIGPIFSILKLFGIDPAKSKTRDLLQAFDGCAKPGEMVLVIGRPNSGCSTFLKTIANKRNGFIDTKGQVLYGGIGADEMAKRYLGEVVYSEEDDQHHATLTVARTIDFALRLKAHAKMLPDHTKKTYRKMIRDTFLKMVNIEHTKHTLVGSATVRGVSGGERKRVSILEGLASGASVFSWDNSTRGLDASTALDYVKSMRVLTDLLEATMFVSLYQASEGIWEQFDKVLVIDQGRCVYFGPRTEARQYFIDLGFADRPRQTSADYITGCTDKYERIFQDGRDESNVPSTPEALEAAYRASRFYTQAIQEREAFNQIATADAKATHDFRQAVVDAKHRGVRTKSQYTVSYFAQVQALWLRQMQMILGDKFDIFMSYVTAIVVALLSGGIFFNLPTTSAGVFTRGGCLFILLLFNSLSAFAELPTQMMGRPILARQTSFAFYRPSALTLAQLLADLPFGVPRATLFVIILYFMAGLDRSASAFFTAWFIVLIAYYAFRALFSFFGAITTNFYSAARLAAIVMSMLVLWAGYVIPQAAMRRWLFWISYINPVFYAFEALMINEFKRITFTCEGAQIIPSGPGYPTQLTANQICTLAGATPGSDQIAGIAYLTASFGYQESHLWRNVGILIAFLVGFVAITALVVEKMDQGAFASALVVKKPPSKQEKELNQKLQDRRSGATEKTEAKLEVYGQAFTWSNLEYTVPVQGGQRKLLDKVFGYVKPGQMTALMGSSGAGKTTLLDVLADRKTTGVIGGERLIEGKPINVSFQRQCGYAEQQDIHEPMCSVREALRFSAYLRQSHDIAQADKDQYVEDIIELLEMHDIADAIIGYPGFGLGVGDRKRVTIGVELAAKPSMLLFLDEPTSGLDGQSAFTICRLLRKLADNGQTILCTIHQPSALLFETFDRLLLLERGGKTVYSGPIGKDGRHVIEYFAARGAQCPPGVNPAEYMLDAIGAGSQPRVGERDWADWYLESDYHQDNLRMIEQINRDGAAKPKSEERQSEYAAPWLYQFKVVLRRTMLSTWRQPSYQYTRFFQHLAFALLTGLLFLQLGNNVAALQYRLFVIFMLAIIPAIIMAQIMPFWIMSRSIWIREETSKTFAGTVFAATQLISEVPYALVCGTVFFVLIYYLTGFNTDSNRAAYFWVMTFLLEMFAISIGTMIASFSKSAYFASLFVPFLTIVLNLTCGILSPPQSMSSSLYSKFLYNVNPIRFTISPLIANELYGLDVHCAANEYSHFNPPANQTCQQWAGMYIARIGGYLANPQATSDCMYCTYLNGQQFYTPFGISFSERARDAGILIGFIAFNCIATIVFTKLFRFSNR

SEQ ID NO: 16680 - protein, 196 aa, Burkholderia vietnamiensis G4
MLQMSRRQFLKVTATSLAGSSLALLGFSPTQALAEVRQYKLARTVETRNTCPYCSVGCGILMYGLGDGAKNAQSSIIHIEGDPDHPVNRGTLCPKGASLIDFIHSPNRLTRPEYRAPGSDTWQPISWSDALDRIAKLMKADRDANFVETTDDGARVNRWLTTGMLAASAGSNEVGYLTHKAVRSLGMLVFDNQARV

SEQ ID NO: 16681 - protein, 436 aa, Ostreococcus tauri
MVVKEATTETATTNGETFAAPRAPSPATAVKPKTRSRSVSSLRPALKLEVESGPSRGATMIASLGVDEFSFGRGQKNRFVVEGAEVSTVHAEVRWDGSSWMMRDMGSLNGTRLNGATISVESRVPGPWEKISHGDVIKLGERSGSPHVSVHFFRDESITKDSALHLHHVVRADGSKGPKSEDRVLVECPLRGNPAVGVFAVFDGHGGHMASERARTLFPEVLARRLAGKVPGPEGVRTLLEEAFIESDETMAVEYEGCTASVVLVWRDTKTGGLMLQAANVGDSSVAIGSAPAPSGKTHDAHYLTPEHKVRHAEEKDRLNKAGAELPPEATRLYGLALSRALGDKFLKDQNVGLIAHPFVTEVIHIEPESREKVLTIASDGIWDVINPAEVYDVLQEGDSCAHTALQRLVASARRRRSVDDISIIMVRLADRPFDD

SEQ ID NO: 16682 - protein, 491 aa, Oryza sativa (japonica cultivar-group)
MAVTIQSVKARQIFDSRGNPTVEVDVGLSDGSFARGAVPSGASTGIYEALELRDGGSDYLGKGVLKAVSNVNTIIGPALIGKAVSNVNTIIGPALIGKDPTEQVDIDNFMVQQLDGTSNNWGWCKQKLGANAILAVSLAVCKAGAMVKKIPLYQKLQHIANLAGNKTLVLPVPAFNVINGGSHAGNKLAMQVKYCLNNKTMSMHDSVIFSAHLAAVQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 16683 - protein, 265 aa, Oryza sativa (japonica cultivar-group)
MAAGPRGRLLLVALVSAAAVVAGALLPGCAAAAAAGEKVPLALYYETLCPYCSRFIVNHLAGIFEDGIVDAVDLRLVPYGNAHVVGANNTISCQHGSEECFLNTVEACAIDAWPDLRVHFRFIYCVEDLVVNHKQREWESCFGKLNLDPKPVTDCYKGERGHQLSLKYGRQTDALQPPHKYVPWVVVDGQPLYEDYENFEAYICKAYKGHPPKVCEGLARPPTPTVLEVAEAVNRVSYYDSGDIRLKPDEDGHAKIKKVVPDDDD

SEQ ID NO: 16684 - protein, 735 aa, Chlamydomonas reinhardtii
MAATYSLATSPLTRSTPIPFSTKRVPSGRSSGALPVPGSQARLSGAGAVALDGLEGGRDDWHQRYSLSTSGRRRSVASGSPSNTGSSEAKNVVMASNNVTVGFSVGASSSAFSDASSFSFPARSAPAGPVARPPRTGVSLLSRALSTGEKEQDLLAHLPPVLPSTDAADPLLFFPGIPLELLREAQAEFPIFNNELLVHAYGLAARAHQNQQRKNGESLLSHCVAVAKTVAGLGLDAETVAAALLHECVDMVSRSQLEEFMPPSVVSVLEHVNTISEMSRLYRQHSATGSFSDETFQRLLVGFEDVKAVIVKLSDRLAELRTISVLPADRQAALARETLEVYSVVANRLGVWCLKAELEDLAFSVLHPQEYNWLKEAVRTRQDPVALETAINSIKGALQAQGVAYEDISGRPKNLYGIFMKLQKDGKPLTIESLNSLYDLMALRVVVAHKHECYTALRAVQSVYRVMPSRSKDFIKDIKKPNGYQSLHETVYGEGDVPVEVQIRTHKMHYIAEYGFAAHWKYKEQMDSEDEWLEKETQYKRWLTQYKLRVHDKKVRPQGSPPTDSSLKSLGVAYMDMPEEQQRGLLDPFLQHERFKLQVPAKTEVSVLLQTCDGIETKDFPLGTTANQLWRDLGLGAQPGYALTVNSRLPSGEAALQSGDLVQVLPLSTILSRSPPQSAPLAAVLEDWEEEQAHAAAEAAALAASANNYLEVYSRDGMTTWSMGPNAGAAVPAGM

SEQ ID NO: 16685 - protein, 525 aa, Methanosarcina barkeri str. Fusaro
MTQARRPLMLIIFDGWGYREAKEGNAVMTARTPNLDRLEKECPWCFLKASGEAVGLPKGMMGNSEVGHLTIGAGRIVNQDLTRINISIKNGDFFKNPVFLNAISNVKANASSLHLMGLASCGGIHSYMPHLHALLKLVQEKDLKKVYIHAFLDGRDEPPKAALGDIKKLDAFCKEHGNAKIATVSGRYYAMDRDKRWDRTKLAYDALTRGVAPYTAPNAETAVSNAYSRGETDEFVKPTIITEQVITEQVITEQAEKPVATVQDNDSVIFFNFRADRARQITWAFVKDDFDGFMREKRPEVYFVCMTQYDETLEVPIAFPPIKLENVLGEVLSKHGLIQLRIAETEKYAHVTYFLNGGEEKRYKDEDRCLIPSPKIATYDLKPEMSAYEITDEVIRRIQSGKYDVIVLNFANMDMVGHTGIFEAAVKAVEAVDKCIGRIVEVLKEKGGVALITADHGNAEEMIDLKTGEPHTAHTSNPVKCIYFGNSEIKALRNGKLCDVAPTILELLGIPKPQEMTGKSLLVKD

SEQ ID NO: 16686 - protein, 450 aa, Acinetobacter sp. M-1
MTKHYDYIAIGGGSGGIASVNRAAMYGKKCALIEKSEIGGTCVNVGCVPKKVMWYAAHVAESIQKYGPDYGFNTKVEVFDWQVLIKNRQAYIDRIHQSYQNSLSKNNVDLIQGAAYFIDQHTIEVNGERFTADHILIATGTQPSLPKIDGVEYGIDSNGFFELSALPKTTAVIGSGYIAVELAGVLNALGSQVGLFIRKDLPVRRFDSFLSETLVEVMQTDGITVHTQAVPLKVTKNADGSVVLHLENGERHTVDCLIWATGREPNTASLNLEKTNVQLDERGYIQVDKFQNTSQQGIYAVGDIIGKMELTPVAVAAGRRLSERLFNHKSDEHLDYDNIPTVVFSHPPIGTVGITEQEAIEKYGQKEVKVYNSSFTAMYSAITQHRQPTKMKLVCVGENEKIVGIHGIGFGMDEILQGFAVALKMGATKKDFDNTVAIHPTSAEEFVTMR

SEQ ID NO: 16687 - protein, 459 aa, Rickettsia rickettsii
MQEFDLVVIGSGPAGYTGSIRAAQLGMKVACIEKSDTLGGTCLNIGCIPSKALLNSSEKYEAALKHFENIGITADVKLDLQKMLANKDKVVLDLTKGIESLFAKNKVTRIKGEAKISSSNIVEVNKEQIKAKNILITTGSSVIEIPNIKIDEEFIVSSTGALKLSKVPENLIVVGGGYIGLELGSVWRRLGAKVTVIEYAPSIVPMLDKEIATQFMKLQQKQGIEFKLNTKVLSAEVKSGKVNLTIEEDDKSSVVTSDVVLMAVGRKAYTQNLGLESVGIITDKQGSIEINDQFQTAVSNIYAVGDVVKGAMLAHKAEEEAVAAVEIMAGQAGHVNYNLIPSVIYTYPEVASVGETEEQLKEKGINYKVGKFPFLANSRARAIGSTEGMVKILADSKTDRVLGAHIIGADAGTLIAALTAYMEFGAASEDIARTCHAHPTLSEAIKEAALSVDKRTINI

SEQ ID NO: 16688 - protein, 291 aa, Saccharophagus degradans 2-40
MLRGSMVALVTPMQADGSLDWEALHKLVDWHLQEGTDAIVAVGTTGESATLDVKEHIAVIRAVVDQVNGRVPVIAGTGANSTSEAIELTQAAKDGGVDACLLVAPYYNKPTQEGLFLHHQKIAASVAIPQLLYNVPGRTAVDMLPETIVRLSHVDNIVGVKEATGDIARVGQILESAKAGFLLISGDDDTAVDFIAAGGVGEISVTANVAPKLVAQMCELAAQGKVEEARAINARLADVHTAMFLESNPIPVKWALAKMGLMPNGIRLPLTPLDAKYHLQVEQALRAANLL

SEQ ID NO: 16689 - protein, 130 aa, Aspergillus nidulans FGSC A4
MVKTSVLNDALNAINNAEKAGKRQVLIRPSSKVIIKFLSVMQKHGYIGEFEEVDDHRSGKIVIQLNGRLNKCGVINPRYPVQLGDLENWAVQLLPSRQFGFVVLTTSAGIMDHEEARRKHVAGKLLGFFY

SEQ ID NO: 16690 - protein, 181 aa, Thermoplasma acidophilum
MLRELGVDTKIVPNDIDSSELDGLDGLVLSGGAPNIDEELDKLGSVGKYIDDHNYPILGICVGAQFIALHFGASVVKAKHPEFGKTKVSVMHSENIFGGLPSEITVWENHNDEIINLPDDFTLAASSATCQVQGFYHKTRPIYATQFHPEVEHTQYGRDIFRNFIGICASYREIQKENFQH

SEQ ID NO: 16691 - protein, 338 aa, Oryza sativa (japonica cultivar-group)
MRPVSSAEEVGALLSRSDSSGRRRRSSPVQSASPRPAGCGCGGPRRQSSFRDDVGHAASETYLVTRLTFSLLQYLGLGYRWMSQLLALTIYAILLMPGFLQVGYYYFFSSQVRRSIVYGEQPRNRLDLYIPKDINRPCPVVAFVTGGAWIIGYKAWGSLLGRRLAERGIIVACIDYRNFPQGTIGDMVSDASQGISYVCNNIASYGGDPNRIYLVGQSAGAHIAACALIEQAVKESSGQSISWSVTQIKAYFGLSGGYNMHSLVDHFHERGLNRSIFFSIMEGEESLSRYSPEIVVKQSSSQTIALLPPIVLMHGTEDYSIPSSARFLLMPSADVHLR

SEQ ID NO: 16692 - protein, 679 aa, Oenococcus oeni PSU-1
MIDTQFENIPLKELNRQDEQQAVNAIRFLSLDMIQKANSGHPGLPLDAAPMAYTLFQKFLNFNNRDPYWINRDRFVLSAGHGSALLYSLLHLNGFKVGIDDLKRFRQLDSLTPGHPEWKHTPGIDATTGPLGQGLTMAVGMAMAEKHLSAIYNRPGFNIFDHETYVIVGDGDLMEGISQESMAIAGEKRLSKLIVLFDSNDVSLDGSLKLSTGEKIQDRIIGNGWDYQFVADGNNLSDIDEAIREAKKSDKPSFIEIKTIIGYGTPLQGSSKVHGAAIGEENVAKTRDFYHWPYQPFEIPKDVYDLFNDSHQAKDRYYKSWQESFQLYAEAFPRLAEQLENNDSTLNTDNLKLAENNDQELATRVSSSEVMQQIADQNRTFWGGSADLSSSNKTYLKDQGDFTDLTPQGSNVFYGVREFAMAAITNGILLHGNSRAFASTFFIFSDYMKPAIRLAALQKLASIFIFSHDSLAVGEDGPTHQPVEQLETLRTTPGIDVYRPADQNETLAAWKAIAKTTNRPTALVTSRQKLPVLRETKDAPVERGAYIVSSAKKDLPDAILIASGSELHLALEAKRELEKEGYDLSVVSMPSMEAFQRQSEEYQASVLPKQVVNRLSIEMASSLAWGRYTGIFGKNLAVDTFGKSGKANDVIDDYGFNLAHISRMVKKMIDENKNLQIVK

SEQ ID NO: 16693 - protein, 403 aa, Magnaporthe grisea 70-15
MTTATSNGSAQDKAAVGILKTPISAPLEGCTPPAKDPLTKEQEIKYDWLLEQVKKWTEVPSTKGKGGPLTDAERMWLTRECLLRYLRATKWVEKDAEKRLRETLTWRRDFDVADLTWDHISPEQETGKQVILGFDKEGRVCHYLCPGRQNTQPSHRQVEHLVFMLERVLDLLPAQREKLVLLINFKQGKNRSYTAPGIGQAREVLNILQTHYPERLGRALIVNVPWVVQGFFKLITPFIDPLTRDKLKFNEDMSNYVPKEQLWTEISGGALEFEYDHSTYWPALRKMCEERQVEKEKRWTAGGKQIGELEDYLGGKASQGITPPVAATTEVAATATATSTAPVAAPAATAAASEVAPIAVAQESAAPEKPAVEGAKKEESGAVSEKQGDKVEDLKVDELKVAE

SEQ ID NO: 16694 - protein, 228 aa, uncultured cyanobacterium
HEVAGAGQHELGMKYAELIEAADNVMIYKYIVRNVARKYGKTATFMPKPVFNDNGTGMHVHQSLFKGGQPLFFGEGTYANLSQTARWYIGGILKHAPSFLAFTNPTTNSYKRLVPGFEAPVNLVYSLGNRSAAVRIPLTGPNPKAKRLEFRPGDALANPYLAFSAMMMAGVDRIKNQIDPGDGFDEDLFELPAERLASIPTVPASLNGSLEALNADKNYLMEGGVFTE

SEQ ID NO: 16695 - protein, 196 aa, Caulobacter crescentus CB15
MARTAEVVRETKETQIRVWIDLDGTGVSTISTGIGFYDHMLESFARHGGFDLKVETKGDLHIDMHHTVEDTGIVLGQAIHKALDGFKGIRRFGSAYIPMDETLTRCAIDLSNRPYLIWKVEFKRPKVGEMDTELFKEFHHAFAMNSGACIHLETLYGDNTHHVAESGFKALARALRQAVEIDPKTGGQAPSTKGVL

SEQ ID NO: 16696 - protein, 282 aa, Ostreococcus tauri
MALVHDEVVARLRSHCARGRKPMVVGVSAPQGCGKTTLTRMIVDMVRSTPRRFIDGVSDGNVTAATVSMDDFYLTAEAQTALAESNPTNAMLQYRGNAGTHELELGTKTLDALAQINDAQSSISLPRYDKLARTGRGDRKPESEWDQVSAPIDVVLLEGWMLGFEPIEDEKARAINPDLVAVNEHLKSYKAALWGTERVAWWIIFKVQDPKWVYDWRLEAERKAGGGLSDEQVKDFVDRFIPAYDAYLPALYENPPPGSLVVVVDKYREVQMVSVVSNEHDT

SEQ ID NO: 16697 - protein, 170 aa, Photobacterium sp. SKA34
MAGQSIIVMGVCGCGKSTIGEGIAHSLNAKFIDGDDLHPRVNIQKMVSGTPLNDTDREPWLERIRDAAYSIENKNEVGIIVCSALKKKYRDQIREGNKNVSFIFLDGDRELILERMRARKGHFMRDTMLTSQLETLERPVDEMDVFTVSIDGSINEIIEDAVQQLREANL

SEQ ID NO: 16698 - protein, 485 aa, Magnetospirillum magnetotacticum MS-1
MTDLDASLLKTHAYIDGHWAEADDGRRFDVLDPATGHLLASVPDMGGAETRRAIEAAEMAWGPWRRRTAKERAAILMAWFEQIIAHKDALARLLSAEQGKPLPEAQGEIVYGAAFIQWFAEEGKRAYGDLIPTTASDRRLLVMKQPIGVVAAVTPWNFPMAMITRKCAPALAAGCPVVVKPAEDTPLSALVLAELAERAGLPRGVFNIVTTRQPGAVGGEMTANPLVRKLSFTGSTRVGKMLMAQCAETVKKVSLELGGNAPFIVFDDCDLDAAVAGALASKYRNSGQTCICTNRFLVQAGVYEEFGRKLAEKAAAMVVGHALKGPVQQGPLINAAAVAKVASHVADAVSKGARVLTGGRPHELGGGFWQPTVLADVTAQMLCFQEETFGPVAPLVRFETEEEAVELANASQFGLAGYFYSRDLARVFRVAEAMECGMVGVNESLISNEVAPFGGIKESGLGREGSKYGLDDFMETKYVCIGGLS

SEQ ID NO: 16699 - protein, 393 aa, Acinetobacter sp. M-1
MHPIVIIGSGMAGYTVAREFRKLSPEQELVMICADDAVNYAKPTLSNAFAGNKAPEQIALGDATKMATQLNMRIDADTWVKAINAENHELTLEKNGQTITQPYSKLVLAVGANPIRLAIAGDGSDDIHVVNSLVDYRIFRENLANRKDKRVVILGAGLIGCEFANDLLHSQYDVTVIDLAPQPLGRLLPNHVAEAFKTNLEQAGIKFALSTTVEKVTKINNGEDYEVTLANGKTLVADIVLSAIGLQPNISLAKAADIQTSRGIITNTLLETNQADIYAVGDCAEVNGTLLPYVMPIMQQARALAKTLSGQSTAVHYPAMPVAVKTPAAPLTVLPAPLNVDVNWETEEFDDGMLAKAADGEGTLRGFVLLGPTAGKQRLTLTKLVPDLIPAQV

SEQ ID NO: 16700 - protein, 345 aa, Ostreococcus tauri
  misc_feature (345)..(345): Xaa can be any naturally occurring amino acid
MAVLNDYTKVLSAEAQRAHAREQEPSDSERVIADKTRRQALERMDAVVGEIWEGLPPNTLLLFTSGVGDAHTLRLAQEQKWKRHQSIGGWGAWTDEAEHDLRRLYDRTKHAVTLAATFNANAFRRRHRSHDALPQTVETFLQPAPLTRRTQTHSIHARALDRLPIDRALPKARRASHEPLARARIALCVSPSSLSLHRRATDRRPAERDRRESAADGEDGAKKTAEGASKRARARSVAPPWASVVMACCSHDHDCDASTCANASLHAFVDVPGVVAFNAVNDENAGRVCGPWESRHDDAREALVSDDDGELVIRIPFTADVKLRGIMVIGGGGGRAPREMRAFAX

SEQ ID NO: 16701 - protein, 390 aa, Magnetospirillum magnetotacticum MS-1
MFPDNLLAVFDRTDVIFEHGEGAWLTAADGRRFLDFGAGVAVNALGHAHPRLVAALGEQAGKLWHCSNLYRVPGQERVAQRLVDASFADTAFFCNTGAEAMELVIKIARRYHHCAGHPERNRIIACTGSFHGRTIATLAAAGTAKYLEGFGPVAQGFDHVPYGDLEAVQGAIGSNTAAILVEPVQGEGGIRPGDPAYLRGLRALADEFGLLLLMDEVQTGIGRTGKLFAHEWSGIAPDVMGLAKGLGGGFPVGAVLATEKAAACMTPGTHGCTFGGNPLAMAVAEAVLDEIMAPGFLDRVQAVAAMLRGKLDDLARRYPQAIAEVRGQGLMLGLKTVPLNTEFNAKLFAAGLLAVGAGDNVVRLVPPLIIGEAEVVRAVEIIEGVCASFS

SEQ ID NO: 16702 - protein, 485 aa, Silicibacter sp. TM1040
MTHPAQPKASHFINGEYVEDTSGTPIPVIYAATGETIATVYAATPAIVEQALTAAEAAQKEWAKMSGTERGRVLRRAADIMRERNHELSVLETYDTGKPLQETLVADATSGADALEYFGGLAGSLTGEHIQLGEDWVYTVREPLGLCVGIGAWNYPTQIACWKGAPALACGNAMVFKPSETTPLCALKVAEILMEAGAPAGLYNVIQGMGEVGGKLVTDPRVDKVSLTGSVPTGKKVYAAAAEGMKHVTMELGGKSPMIVFEDADIESAISGAINGNFYSSGQVCSNGTRVFVHKDIKEKFLARLAERTATAKLGDPMDESVNFGPMVSERQMEIVLGYIEKGKSEGARLICGGNRADMDGFFVEPTVFADVKDDMVIAREEIFGPVMCVLDFESEDEVIARANDTEFGLSAGVFTKDFTRAHRVIGQLEAGSCFINSYNDAPVEAPFGGVKASGVGRENSKEAIKHFSQVKSVYVRMGDCEAAF

SEQ ID NO: 16703 - protein, 147 aa, Nicotiana tabacum
MERVNNYKLCVALLIISMVMAMAAAQSATNVRSTYHLYNPQNINWDLRAASAFCATWDADKPLAWRQKYGWTAFCGPAGPRGQDSCGRCLRVTNTGTGTQTTVRIVDQCSNGGLDLDVNVFNQLDTNGVGYQQGHLTVNYEFVNCND

SEQ ID NO: 16704 - protein, 380 aa, Acremonium chrysogenum
MTTTYKILVLPGDHIGPEIMAEAIKVLTTIETHRPNLHFNLTTDLVGGTSIDTHGVPITQSVLDAAKASDAVLFGSIGGPEWAGVHPTPESGLLQLRQHLDAFANLRPCEFLVPSLVGASPIREHVVKGTRFIVVRENCGGAYFGEKKEEEDVASDLWVYTRPEIERLARVSAAVARIMGRSEDDNQAATVWSADKANVLASGRLWRRITSDIFAKEFPDITLQHQLADSMAMLMVRDPRRFNGVIHTDNTFGDILSDISGAITGTLGLMPSASLCGVPGEGHRSNGIYEPVHGSAPDISGKGLANPVAQILSVAMMLRYSMGLEKEATAVERAVVKVLDAKSEGGLEIRTGDLGGRATCSQVGDAVCEVLGPLLQGKKA

SEQ ID NO: 16705 - protein, 581 aa, Coccidioides immitis RS
MLDFGLRVLPLISRLPKSPRRPWQRAPCRCTIPLLTRRGVASASSNQRKPYYVTTPIFYVNASPHVGHLYTLVLADILKRWQVLLGNNDAQLLTGTDEHGIKIQQAAASHGLEPIKLCDQNCQTFKDLAQKANVQHDHFIRTTDPEHRDAVQYFWEMLDHRGYIYTAKHEGWYSVSDETFYPSNAVHATLDPATGRKIMSTIETGKEVEWSSETNYHFRLSAFKDRLLDFYRENPTFIRPKRYMDNIVQSVSSGLTDLSISRPVQRLTWGIRVPGDDTQTIYVWLDALINYLTYAGYPFTPGKENQSIWPANVHVVFARSSQKADACPGADLDARFHCVYWPAFLMALDLPLPRQVLSHAHWTIGREKMSKSTGNVVNPMYALARFGVDPLRFYLAHDGGLSDDADYENAFVTERYKKTLQWGVGNLTSRLVRSKKWNVRRSIEWGVEGRFPPPSEADRKHQQLLEGIRNVTRSWMDDLNPRKAVESVVGIIHESENTEPTELSRVIYNTAESLRIAGILLQPFMPEKSARLLDMLGVAGDPEKRSFEAAIFGADEHYGVPLVELKKGTEATLFPPLVTEN

SEQ ID NO: 16706 - protein, 150 aa, Oryza sativa
MAARRGRGRGREWEDAGAFVGSLVGYGQGLLTNKGMKGSLSSAGSSAKTFAALSGVQSFILCLLRRLRGKDDMINAGVAGCCAGLALSFPGAPQAMFHSCVTFAAFSCIMDGLNKQQAAMAATLASKPSTIKHQEGDVLPPFTLPPLLNA

SEQ ID NO: 16707 - protein, 433 aa, Marinobacter sp. ELB17
MEKITHITAREILDSRGFPTVEVDVLLDNGVVGCGRVPSGASTGSREALEKRDLDSPRYNGKGVLQAVNAVNTRIAPALVGQMVFEQSQIDRLMCEMDGTPNKAEFGANAILAVSLGVADAAAKARKLPLFRYLAELYGCASPSVLPVPMMNIINGGAHADNNVDIQEFMIQPVGAPSYSEALRMGVETFHALKALLKEKGLSTAVGDEGGFAPNLQSSEEALELIIEAIEKAGYRPGTDIVLALDCAASEFYSDGCYDLKGAGKKYSSEEFADYLVSLAKAYPIASIEDGMDENDWAGWKLLTEKVGERVQLVGDDLFVTNTVLISEGIQKGIANSVLIKFNQIGTLTETLEAIAMAQGAGYTAVISHRSGETEDTFIADLAVATRAGQIKTGSLCRSDRVAKYNRLLWIEQELGAHAFYPGIGAIRCALDS

SEQ ID NO: 16708 - protein, 366 aa, Aspergillus nidulans FGSC A4
MPSYNIVVFGGDHCGPEVTAEAVKILRVIEKSRDDITFNLQDHLLGGCSIDATGSPLTDQALEAAKNADAVFLGAIGGPEWGTGAVRPEQGILKLRKEMGTFANLRPCNFAAPSLVESSPLRPEICRGVDFNIIRELTGGIYFGERKEDDGSGFALDTEPYSRAEIERITRLGAHLALQHNPPLPVWSLDKANVLATSRLWRKTVTEIMAKEFPQLKLEHQLIDSAAMIMVKDPRKLNGIVITSNLFGDIISDEASVIPGSLGLLPSASLSSIPDGKGKVNGIYEPIHGSAPDISGKGIVNPVAAILSVGLMMQYSFALFEEARAVATAVSNVIEAGVRTGDIGGKASTKEVGDAVAAELEKLLKK

SEQ ID NO: 16709 - protein, 528 aa, Oryza sativa
MQPTWLATMPAASSLVVGVAFTAAVAVAVAAAVARRAWRHRGLRLPPGPPGWPVVGNLLQVVFAGKPFIHYIRDLRREYGPIVKLQMGVRTLVVISSAELVHEALVEKGREFATRPAESPIRSIFSSGKFTVNSAVYGPEWRSLRRNMVSGMLSAARLREFRPARLRAMERFVARVRAEAAASRDGASVWVLRNVRFAMFCVLLDMTFGLLDLDEELVVRVDAVMKRVVLAVAARIDDYLPFLRPFLWRQHRQAVALRREQIDTVLPLINRRRAIVRGMRAGSPPDPAVAAPYSYLDSLLDLRVEGRDAVPTDEELVTLCAEMINGGTDTTATAIEWAMARVMDNPSIQARLHGEIMQRVGDARPVDDRDTEGMPYLKAFVKELLRKHPPTYFALSHAAVEPGSKLAGYDVPVDANLDIFLPTISEDPKLWERPTEFDPDRFLAGGETADITGSAGVRMIPFSAGRRICPGVGMGTAHIALMVARMVQAFEWRAHPSQPPLDFEDKVEFTVVMKRPLLAMVTPRKLSF

SEQ ID NO: 16710 - protein, 268 aa, Marinobacter sp. ELB17
MRKPILIGNWKMNGSLQSNQALVSRLLPRLRPLRKVVDIAVCPPLPYLFQVRDLLGYTGITLGAQNASGFVSGAHTGESSATMLKEMGCVYVLVGHSERRSLYGETDADIAARFAAVRGLGMTPVLCVGESLQDRESGRTAEVVQAQIQAVIKKVGLAGLAEGVLAYEPVWAIGTGKTATPEQVAETHFGIRQFIAGCGEPKAKVISQALRILYGGSVKPANAVAIFSLDDVDGGLIGGASLHADDFAAIAEALGATYPEAVGESESH

SEQ ID NO: 16711 - protein, 470 aa, Saccharophagus degradans 2-40
MTDSALPSGENKSFVILISCIATIGGFLFGFDSGVINGTVDGLVTSFGVTKTAVGVHVAFMLLGCAVGAAAAGRLADLYGRRAMLIVAAILFIVSAWGSGVATGIVEFDIYRLLGGLAVGAASVMAPAYISEVAPARYRGRLTTIQQVAIISGLTAAFLSNYVLAHTAGSSLEPFWMGIATWRWMFWIEIAPAAIFFFALMVIPESPRFLVASGKKDKALTVLTKLYGAQAAPGKVAEIDSSLDHDHKPRLSDLISKVTGKVRPIVWVGIGLATFQQLVGINVIFYYGSILWQSVGFSEDHALLINVVSGAVSIGAVVLSLVLVDKIGRKPLLWIGSAGMAVTLTLTAIAFATGTLDANGDLQLSDNMGILALVAANVYVIFFNMSWGPVMWVMLGEMFPNQIRGSGLAVAGLFQWGSNWAITMSFPALLAGLGLAVTYGFYALCAFISIIFVIKYVNETNGVELEDMEG

SEQ ID NO: 16712 - protein, 358 aa, Acidithiobacillus ferrooxidans
MKKIAIFAGDGIGPEIVAAARQVLDAVDQAAHLGLRCTEGLVGGAALDASDDPLPAASLQLAMAADAVILGAVGGPRWDAYPPAKRPEQGLLRLRKGLDLYANLRPAQIFPQLLDASPLRPELVRDVDILVVRELTGDIYFGQPRGLEVIDGKRRGFNTMVYDEDEIRRIAHVAFRAAQGRRKQLCSVDKANVLETTRLWREVVTEVARDYPDVRLSHMYVDNAAMQLIRAPAQFDVLLTGNMFGDILSDEASQLTGSIGMLPSASLGEGRAMYEPIHGSAPDIAGQDKANPLATILSVAMMLRHSLNAEPWAQRVEAAVQRVLDQGLRTADIAAPGTPVIGTKAMGAAVVNALNLKD

SEQ ID NO: 16713 - protein, 228 aa, uncultured cyanobacterium
HEVAGAGQHELGMKFAQLIQAADNVMTYKYVVRNVAKKYGKTATFMPKPVFNDNGSGMHVHQSLWKEGQPLFFGEGTYANLSQTAQWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGDGEDRDLFELPAEELSKIATVPASLNGALEALNADRGFLTAGGVFSD

SEQ ID NO: 16714 - protein, 228 aa, uncultured cyanobacterium
HEVAGAGQHELGMKFAQLIEAADNVMTYKYVVRNVAKKYGKTATFMPKPVFNDNGTGMHVHQSLWKGGQPLFFGEGTYANLSQTARWYIGGILNHAPAFLAFTNPTTNSYKRLVPGFEAPVNLVYSEGNRSAAVRIPLTGPSPKAKRLEFRSGDALANPYLALSAMLMAGLDGIKNQIDPGDGEDRDLFELVAEELSKIATVPASFNGALEALNADRAFLTAGGVFTD

SEQ ID NO: 16715 - protein, 118 aa, Bacillus subtilis subsp. subtilis str. 168
MKTMQKLIEDITKEQLRTDLPAFRPGDTLRVHVKVVEGNRERIQIFEGVVIKRRGGGISETFTVRKISYGVGVERTFPVHTPKIAKIEVVRYGKVRRAKLYYLRELRGKAARIKEIRR

SEQ ID NO: 16716 - protein, 520 aa, Sulfitobacter sp. EE-36
MTDISHDRLLIIDFGSQVTQLIARRLRELNVFCEIHPFNTVDDAFLKDFAPKAVILSGGPSSVFAEGAPMPPQSVFELGVPILGICYGQQVMMHCLGGKVERGHGTAEFGRAYVTPSEARLELLEGWFLTEKEQVWMSHGDHVSAIAPGFEVYGTSPHAPFAVTGDVSRNFYAVQFHPEVHHTPNGARLYENFVRLAGFKGDWTMSAYRDEAIAAIREQVGDQKVICGLSGGVDSSVAAVLIHEAIGDQLTCVFVDHGLLRKGEAEEVVTMFRDNYNMPLIHADEQELFLGELDGVSDPETKRKIIGKLFIDVFQKHAKEVGDATFLAQGTLYPDVIESVSFSGGPSVTIKSHHNVGGLPEKMGLKLVEPLRELFKDEVRELGRELGLPPSFIGRHPFPGPGLAIRCPGEITREKLDILREADAVYIDQIRKHGLYDEIWQAFVAILPVRTVGVMGDGRTYDFACALRAVTSVDGMTADYYPFTHEFLGETATRIINEIPGINRVTYDITSKPPGTIEWE

SEQ ID NO: 16717 - protein, 228 aa, uncultured cyanobacterium
HEVAGAGQHELGMVYEELIQAADNVMTYKYVVRNVAKKYGKSATFMPKPVFNDNGTGMHVHQSLWKGELPLFFGEGTYADLSQTARWYIGGILKHAPSFLAFTNPTTNSYKRLVPGFEAPVNLVYSEGNRSAAVRIPLTGPNPKAKRLEFRSGDALANPYLAFAAMMMAGIDGIKNQIDPGDGFDGDLFELPAEQLKNIATVPASLNGALEALNADHHYLMEGGVFSK

SEQ ID NO: 16718 - protein, 228 aa, uncultured cyanobacterium
HEVAGAGQHELGMKFAQLIEAADNVMIYKYVVRNVAKKYGKTATFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKIATVSPSLNGALEALSADRAFLTEGGVFTD

SEQ ID NO: 16719 - protein, 613 aa, Medicago truncatula
MRSSWADLAANSAAENAPTPPPSAAAAVANNAANTRPVYVPPHLRNRGPSAPAPAAPAFDNSGSRWAPPPRNDYRGGGGGRGGGGYGNRGGGGWDRREANPFADQDDSEEPVTQEEQENTGINFDAYEDIPVETSGGNVPPPVNTFAEIDLGEALNQNIRRCKYVKPTPVQRHAIPISLGGRDLMACAQTGSGKTAAFCFPIISGIMTGQPAQRPPRGVRTVCPLALVLSPTRELSMQIHEEARKFSYQTGVRVVVAYGGAPINQQLRELERGVDILVATPGRLVDLLERARVSLSMIRYLALDEADRMLDMGFEPQIRKIVEQMDMPPAGVRQTMLFSATFPKEIQRLASDFLSNYIFLAVGRVGSSTDLIDQRVEYVQESDKRSHLMDLLHAQRANGVQGKQALTLVFVETKKGADALEHWLCLNNFPATTIHGDRSQQEREAALRSFKSGNTPILVATDVAARGLDIPHVAHVVNFDLPNDIDDYVHRIGRTGRAGKKGLATAFFNENNTSMARSLQDLMQEANQEVPAWLSRFAARSSFGGGKNRRSGGGRFGGRDFRREGSFSRGGSDYHGAGNSGGGYGASGGYGGGGYGGGYAGNSAGPGVTSAWD
